United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 25

SEQ ID NO: 103378 - DNA, 818 bp, Triticum aestivum
  unsure (1)..(818): unsure at all n locations
  Clone ID: PAT_TA_103378
ggcacgagctctcctccaacaccatggcccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtatgtcggtcactaattaaactgatatgagtttctttgtcattacaagtaattcacttacagaacatccccaatgtataacataatttggtcaatagattattccgaaaccttattatctatttgttttgttgcctatggaaaccatttggctttggatgctcatttagccttgtccataagctgggatccgtgtgtaaaagcaatcaactcataacttagtgaatggaaatactttttattacagcatggactagataaaattatcttagtacctccagagtgcccatcagtttaagggctacccttaagctttcttcattatggacaacccaacaatgcatatgagacctgcccataaggagcaatttttggcttatcaacagatttttctagcattgntggtacagttaatagacttagcaccaagtattgagcatctgcgcattctattcattcangtgtgggccgattgagggcattaagaaagttcgagacctgtcttacctggcaccctttttcacggaggcctctggaacangtcgactacttggatcccgttccagtgggtgccctggctcgangttcaaacaangggtgggttcggctttccgggagcacaaaaanctncccccggatacttatgac

SEQ ID NO: 103379 - DNA, 429 bp, Triticum aestivum
  unsure (1)..(429): unsure at all n locations
  Clone ID: PAT_TA_103379
ggcacgaggttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggngctaagcgatcttgccgaagctgtgggattt

SEQ ID NO: 103380 - DNA, 740 bp, Triticum aestivum
  unsure (1)..(740): unsure at all n locations
  Clone ID: PAT_TA_103380
ggcacgagggaagacagccgagcacgacagcgccaccccaccgcactcccctctttctctcccctactccacctgcaacatcccatccccattcccacctctcccactctcactccccctccgcgctccacccaaatctcgcccccgctcccccccagatccagcccgcccgcccgccatgtcctcctccgaccaggaggaccacgacgaggacgcccccctcgtccgcgacccggccgccccctcctcctcctcccgccgcccctccgcctnctnctccgccgtcggcgaggtgcccgtctcgcagtcgctcatcaaggcggccagcaacgtctgcttctccttcttcgtgctcgccgtgctcgccgtcaccgtcgtcgccgtcacctaccagccgcccgacccctggctccagtcctncggcgncatcaccaccttcctcnccgcgtnctccccaactcctncttnctncagcccgacgactcgctcctccccaccggngaggacttcccttcccctncggcggccccggggccggcgncgncgccagcgcgaagccgncgaacaggccgcaccgggccgggcattaaagcaccgntgcggggggganctgngaancggacgcgccgntnaatggncgaaccggcgtctttgcgcggaaaggggttaacgccaaggcttttttcgnaggncatcgnnttcttaannnnangggcccgtgnccggnccaannccnggca

SEQ ID NO: 103381 - DNA, 907 bp, Triticum aestivum
  unsure (1)..(907): unsure at all n locations
  Clone ID: PAT_TA_103381
ggcacgagattggtctcaaaagcacatgtgttgtatcataaaggattactgatccataccattatgattatttcagtgtcatcacagatccgttctctttttcatgaagttggctgggtgctttggccacatgacaacttccatttgaaatataaaatatataaatcagtgaagttgatgtcatacaactcatgtttcgtcactgtacgaacaaactttgagatctatattgccatcccaacagatcaagacatggattacatattaaaagtgcatcaatgttttgtcgtttaacaccatgtgtggatatatcattgacaaccaatggttttttatgcttgaaaaatacttcatcgctgcaatatgatggtaagatatgttttgtttttctctagagaaacttcataactcaaaaacggttttatttttgcagcattgtagagttcttttgagcgtatgcgattccaaatcatattctgatttttcattcacaatgctttcttcattcccattatcttgaccttcatggtaataatttccacctaaatctagcaaataatcaccggttatgtatagttcaatatttgtgcatcaccagttgtaaagggttcagtatatcaattcgttgaagttggtgctatattcatatgncatttctatcaaatgtacatgatttcatttttggtggggggctanaatcattgggattattctattttttgggcaatttgattggggggaatgancccaaaatttggnnnaanggagccatgggagnggggggctcaaaanntttnttntttnggntggttttaaaaangaatccggcnntntgnnangnaaanggttcccctttnttatgnggaannaagggggggggcnaaaaannttnnngnaaanaacnggg

SEQ ID NO: 103382 - DNA, 343 bp, Triticum aestivum
  unsure (1)..(343): unsure at all n locations
  Clone ID: PAT_TA_103382
ggcacgagnacanatgganggnntgcagagancgngctacactttnaaaaggtgcgnctngncnagcctggngnggaangancggatcctgacnganggcgccgaggcgaaggccnnagtggaggncnggaccgangaagcccaaccgnngatgcggagctccnggagcacaggcggannnngaatgatgctgngncncgtgntgnatggatagcatcactgttgaggancgcaacgctggnctntgatggtnacnngaatgacnatgangcgccatacncatnnntntnggaccaagganncnatttncncacnnggaccntnnaactccncntcttntcct

SEQ ID NO: 103383 - DNA, 714 bp, Triticum aestivum
  unsure (1)..(714): unsure at all n locations
  Clone ID: PAT_TA_103383
ggcacgagaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgcttcaagccaccgggctgcgaggagtccggnaaggcctaaacagttactcaccacgggccacatataaaagtgccattgcagtttttgtaactctgacattgctttggggttttccttctncatttggctttctttacttggtcctaaaaaatatgtgtntgtcccatgttcaatgtaacaacatgggctcga

SEQ ID NO: 103384 - DNA, 679 bp, Triticum aestivum
  unsure (1)..(679): unsure at all n locations
  Clone ID: PAT_TA_103384
ggcacgagccaaggctggcaaggtgagctatccgagctcgcgctgcgacagcatggccaggtcgacccggcgcagcagcatgacgatgacgatgcagcagcactactcgtcggcgtcctacacggagagccttgcgctggctcgggcaaggtcgacgtcgtcgggggccaccgggcgcatgaacatgaacggcatgatcatgatgccgtcggcgtcctacacggagagggagaggcaggggcggtccatctacgcggaggagatgatgacgccggccgagtccttctcggagctggcaatgcaggtggtgccgtcggggcggtacgcggcgagcagccagcagctgttccaggcggcgaagatgagcctggaggagatggccaagatcgaggaggaacagaggtacatcgagagggagatggaaaagggggtggtgtacatcatgggggagaacgangtggtggcgcggnctcactcctcgcttgntcaagaaagtcatcgtcaactacntctacnccttnctcaggaagaactgnaggcaaggggataaanatgctcnccatnccaagaaagccanctgntcaaggncggaatgtcttacnagatctaanttaccncttccaccattaaagggaccggncttggacaacttttnanctaagcccttgcaccccanntn

SEQ ID NO: 103385 - DNA, 402 bp, Triticum aestivum
  unsure (1)..(402): unsure at all n locations
  Clone ID: PAT_TA_103385
ggcacgagccgccgccagcgcgcggcgcggcgctgttcgtccggatccacacggctgcgtgcgaccgcgcggcgtcggccgcgctgctgagggagctcctggcgcatctgggcggcgcgggcgacccggaggaggaggagtcggcggcggtggaggccgggctggaggacaggataccgcagaaggacgcgtggaagccgttctgggcgcgtggggtggacatggtgggctactccatcaacggcctgcgcacgtccacgctgccgttcgaggagaccggcacggccaggtcgacgcanatggtgcgcctcgcgttcggccgcgaggagacgacgcgcctgcttcnatgcgtgcaaggagaacggtgtgaagctttgctcggcatggctgcngcgacgntnt

SEQ ID NO: 103386 - DNA, 679 bp, Triticum aestivum
  unsure (1)..(679): unsure at all n locations
  Clone ID: PAT_TA_103386
ggcacgaggccactcggtgcagctctggacagaggagattggtgatttgggtggtgctgggtacgcctcggctccttgcagtacgtcgtgatgttccggctgtcggtgctgcttcccgcgattgctgcttggggcgctgcttccccgtccatacgatccgtctctcccttccgtctgctcgatctactgctctgccctgatctggtttgtattgtttcatctggtattggatttgttgtttgctgtcttgggctgggttcagtatggtgtttctcgagcaacggagtcattggattgggctctggtttttgtgagatgccgctttcatgcttcaattgttgtggagggcgtcgtgcactgcagaggatgagattggctgattgttgtggactgatgcttcccttcaagtttaacttgctgcttcaattgccaactttgacaggagggagattgatcggtgcacccaccgcatagagccgaaggaagtgtgtcaaatccagcaatacatgggagcccggccatcaacccagcgaacgcaacccaccatttgtctttaccttgcttctaaaccacaacaactcaaatttttgttttccaagatnggaantgcantttcaaccattaaccaatgggntggggaaaagaaaaancnttttcccccnccanggcccccttnaac

SEQ ID NO: 103387 - DNA, 980 bp, Triticum aestivum
  unsure (1)..(980): unsure at all n locations
  Clone ID: PAT_TA_103387
ggcacgaggccaatctagcgaagctggacccccagtatggcctttgtaagcatcctcaccatcaccagcttttgtaatatcttctgaaataatttgcatcgccatattttgtttcgatcccactgctccggactaatccttgttggtacgacgacgtgacatttgtggcggcagacacgagcgtggtgccgccgctgatctacgcggtgatggggacgtcgagggagatcgccatcgggcccgtcgcggtggtgtcgctgctgctgtcgtccatggtgcagaaggtggtcgacccggccgtggaccccgtcacctaccgcacgctcgtcttcaccgtcaccttcctcgccggcgtcttccaggtctccttcggcctcttcaggctggggttcctggtggacttcctgtcgcacgcggcgatcgtggggttcatgggcggcgccgccatcgtcatcgggctgcagcagctcaagggcctnctcggcctcttccgcttcccaacaagcaccgacgtcgtcgccgtcgccaaaggccgtctttttncgcgcttcacgacccctggcacccgggcaacttcttcatcggctgntncttnctcatattcatcctcgcccacgccgatttattcggggagggaangtnccaangaaagctttttttggcttgtccgggnnaatcttcncccgnttggntntttcgggncaattccttgtnccaacggggncggnccggtttaacnncccacccaaagggnccgnannaancanccgggnggnttaaaaaaacatttcccncgaanggggncacccccnggcccttaaancccnnnanctttcnnnnaaagntttnatcnannttnaaangggncccntttaaacnanccnnantggcncccaanaaannnncnntnatttttgnnnccngnnnnttnngncttnacnggnanaccantnnncngnnggnaaaaannttttnncccc

SEQ ID NO: 103388 - DNA, 776 bp, Triticum aestivum
  unsure (1)..(776): unsure at all n locations
  Clone ID: PAT_TA_103388
ggcacgaggatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctnctacgagtacgtcagccagggactcaagaagtacgacttngacaacaccatgggaggcttctacatngctccttgctttcatggacaagcttgatgnccatcttcttcaaagaacttnatgacccttgcccaacatcnagatcccactcatcttgggtatnttgggggagggcaaaggggtcnanggaaaattatttccagtgcgagcttgttcttnncaagangggcnntnaacccaatcntgatgagttgcccgagagctgganagtggcaaangcccggannagccatnccnaagcntcattctnncntcgggttncctngnagggcttgcatnacaattaatcaaagaaaggggtaagnttntgntnnncntcttttntttcaannnaattatttgaacgatt

SEQ ID NO: 103389 - DNA, 673 bp, Triticum aestivum
  Clone ID: PAT_TA_103389
tccaaagcaatgacacaagtggaaaggccaggttgctgggcatctggggtatggcgggtattggaaagtctactttgttgagacaggtttcaaagtcccgctctgagttcatttctgacggggatgatttgattgtgttaattgttgacactggttcagactactcagttgctaaggtgcagaagtgtctgattggacttctaggagtaacagtagcagctgatgttactgaagctggtgttgcgctggctatttctaaccgtctcagggggatgcgctttctggtcatgtttgatgatctttctggtcctatcaaccttgctcgaattggcataccagatgcccctccagctagtcttaaatgccagaaagttgtgttcactacacaaaaacaagcagtctgtgcgtcaatgggtgctgatgaaaccatacacatggtttgtccaagcgagatagaggcagaaaaactgttcaatcatgccgtgggagcagacattctgaaagataaaaggatatcttccctttctcaagatgcgcaggatgagactcaagatgcgcagcaactactccatgtccttcaaatggttgcaataagaggtttatcaaaactcagagaagttaatctcaaaaccgtgggtgtgagcatcacatcaatcagtatatctgctgtccc

SEQ ID NO: 103390 - DNA, 332 bp, Triticum aestivum
  unsure (1)..(332): unsure at all n locations
  Clone ID: PAT_TA_103390
ggcacgaggaacaatggcagcccagggtcttctctctgggaggcagctgntggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtgg

SEQ ID NO: 103391 - DNA, 346 bp, Triticum aestivum
  unsure (1)..(346): unsure at all n locations
  Clone ID: PAT_TA_103391
ggcacgaggcacagccgcgcatccaccgctgctagcaaggtcgagcaagcagcacagagatggctgctgccttctcctccaccgtcggtgccccggcttctacgccgaccaacttnctngggaagaagctnaagaagcaggtgacctcggccgtgaactaccatggcaagagctncaaggncaacaggttcacggncatggcagcggaaaacatngacnagaagaggaacaccgacaagtggaagggtcttgcgtacnanatnttcgacgaccagcaggacattaccagagggaagggcatcnnggactncctnttncangcgcccactggcganggcacccacga

SEQ ID NO: 103392 - DNA, 776 bp, Triticum aestivum
  unsure (1)..(776): unsure at all n locations
  Clone ID: PAT_TA_103392
ggcacgagggccaccgagcgaaccctagccgagattagactaccatccccaatctagcggaggaggacgaggacgacgccgacgagatgctgagggttgcggggaggaggctctcgtcttcgctctcctggcgccccgtggcgaccgtcggagccaggggcccgctcgccggcgccggcggccctgggagagacgacgacgacggttcggcctaccagcggcggttcgccatcgagtcccccttcttcaccgccgcgagaggcttttcttcggctgaaacacttgttccacggaaccaagatgctgggttggctgaactcccagccactgttgctgcactgaagaaccccaactcaaaaatcctttatgaccagtacaaccatgaaagatatcctnntggagatcccagcaagcgtgcctttgcctactttgttctgagtggtgggagattcntatatgcatcactgcttgngtctccttgtcttgaagtttgtcttgagcatgtcagcangttaangatgtgcttncactttgcttncctttnaggttgatcttatccagcattgaacccggcagcacangtgancttgttnaanntgggcntnggaaaaggcccatnctttnatttangccganngggancnannattnattgaacnntttaanggcnttggnccntnacnatantggttgngaatnntttgncaatttcttttgggcgccccntcccccnannanncnnanngnanactcttttnaantccttcngtntaaaa

SEQ ID NO: 103393 - DNA, 628 bp, Triticum aestivum
  unsure (1)..(628): unsure at all n locations
  Clone ID: PAT_TA_103393
ggcacgaggaaacagcaacaagggggaggaagagagggaggggcgccgccaccatcaccaccacaagtacactcagattgggggagcaaagaagtagtatcccttttgcctcaccaccttcttcctcttgtgcaagcaagaaaacaaggggtcttgaacaatgatggcctgtgggtctcgaagcaacgaggtagtggacgagttcgagaagctggtcatcaagatgaacccaccgagggtcaccgtggataatacctccgacatgactgcaaccttggtcaaggttgacagcgcgaacaagtatgggaccttgctagaggttgtccaggtgctgaccgatctgaagctgaccataaaccgggcctacatttcctctgatggggagtggttcatggatgtgttccatgtcgtggatgaggaagggaataagctttatgacggccaagtcatcgacagaattgaacagtctctaggagccgggtcgctcagcttccgcggnacggaccggtgcgtcggcgtcnaggctgangcccgangcggngcanacngtgatcgagctnatcggcgggaccggncgggcctncttgtcggangtntttnnnggngctcaccaaccttnaagtgncaa

SEQ ID NO: 103394 - DNA, 929 bp, Triticum aestivum
  unsure (1)..(929): unsure at all n locations
  Clone ID: PAT_TA_103394
ggcacgagctagcaagctatatacctacatagtacagccatggcccccaccgtgatggcctcgtcggccacctncgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcancacggaggccctccttaagcaggtcgactacctgatccgctccaagtgggtgccttgcctcgagttcagcaaggntgggttcatcttccgtgagcacaacgcatnccctgggtactacgatggccggtactggacaatgtggaagctgcctatgttcggatgcaccgacgccacgcaggtgatcaacgaggtggaggaggtcaagaaggagtaccctgacncctatgtccgcatnatnggattcgacaacatgcgtaggtgcaggcgtnacctttattggcttcaanccaccgggnctgtaaggagtccgggcnnggcctanacagnntnacttacganagggcnattntttaaaagngccctattgnanatttttgatcaaantcttnaacnntttgcntttggggnttttcctttntncnntataatctttttnnttaantttgtgcccttncnnnacaaagnnactgaccnnntcnnanagatntctttttannnnggngncggngggnccnatataatttttacacccggggggggggaccnattttantgnncccnatttcnccctatntaggngtnttntaaaaattnnnttggccnnnggtatanancatngatantggnnaaaacnttgatnttnactncaatctatattcntttgnagcgtantnnnctttntnc

SEQ ID NO: 103395 - DNA, 364 bp, Triticum aestivum
  unsure (1)..(364): unsure at all n locations
  Clone ID: PAT_TA_103395
ggcacgagcatagaaaagattgtgaaggataagagcactgatgatgactttattcggatgacatttctagttctcttaggaactataattgcaccagtgtctcatgaatacgttccgaaaaaatactatgccttagtgcaaaatattaagttgataaggaagttcaactggaatgcattcacttcacgattctgtttatcggagattggtaagcttgtgcaggacggccatgtcaggcagtggccccaggggaacctcgcccttttgcaatacctatactgggagaaggtgcaaccaatcaccggtccaaaatatgatccgttggcattgttganccccgctgatgagnaactgtaccngaaga

SEQ ID NO: 103396 - DNA, 769 bp, Triticum aestivum
  unsure (1)..(769): unsure at all n locations
  Clone ID: PAT_TA_103396
ggcacgaggataagtcagaataagctcaagtctcttcttttttgtagaatgtctcacatttcagttgaaaagtttggaggcaagtctgagttatttgaagaaggctctgcaattttggatgaaagatgagtggagaaaggagacaagggagttccattttgtgaagacaatggcgacatgcttgactcgaggactagtggaagaaggcctatctcatataatttgtttatttaagataaggctacactctacttctgttgatgtatctatcattttcaagaagcagcaacatactactttcagtggtattgccaagctatacattcgcctatgtaaactagattgagaaatggaactaaaaggacgttaacctaaaaaaaaaaaaaaaaaaaaaaaaactcgagagtacttctagagcggccgcgggcccatcgattttccacccgggtggggtaccaggtaagtgtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttccaacagttgcgcagcctgaatggcgaatggagatccaatttttaagtgnataatgngntaaactactgattctaatggttggggattttagaatcccagtcccangctcatttcaggcccctcancctcacagnctgncc

SEQ ID NO: 103397 - DNA, 895 bp, Triticum aestivum
  unsure (1)..(895): unsure at all n locations
  Clone ID: PAT_TA_103397
ggcacgagtttcatttgggtcattctgtttggataaggccgagggagagagctcgagcggcagcgaagaggcgattcatggtgattccgagctattccaccgttcgattttgatttctcctcccttttctcttcgtccgccggctgccgaggttggttccccttgtctctcgcgtccccccgtgtatttttgctggtgttgtggtcttgtagttccagatctaggtgagtttcgtcgtcgtggattcgtggatcatctgtttgttgttgttcatggatccgtggtaggtgctgccgtgttgttctagtccgcccttcgtagtctgcccaatttcccctctccattctgctcgcctgtgttatgtaggagcttgtagttgcaggttctaggtctggtagatggtggaggtaggcgtactggtagttgcagcggttgacttccctgccaatttttctgctagcctgtgctgtctgttcccttgcgttagatgataagttgtaggtggctggtctgttcccttgttgtctgaatttcatgcttctattactgngtgtttttacctccagacttggagtgtacctcaaaatttcaagtatttgttgcagaacccgaactgtagtttcccctacatttacagggtaatactcccaatattacaggncatgcttttctatttgtactggctggaggtaaccgtactggttgttgcancggtcntttccctgtatttttctgccantcctttttccgtnanatgananttggaggnnaactggcttttttttgcntgantatccaangnantttttgnnnnntgnngggggnngctcatgaatttcccctggnnncnnaagngggccgngggnttnccnnngnaaattnccnnccaaanttn

SEQ ID NO: 103398 - DNA, 836 bp, Triticum aestivum
  unsure (1)..(836): unsure at all n locations
  Clone ID: PAT_TA_103398
ggcacgagctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggcttgcgaggagtccggcaaggcctaaacagctcacttacgacaggccatatataaagtgccattgcagtttttgtcaacttttgacatttgctttggggtttccttctccatttatctttcttatttggtcctaaanaatatgggtattgnnccattgttcatggtaccaacatgggcttcgagnaaaacatgcttcgtattgaaaaanggctattcgggggctattgtatatgaaacnggccccctaattttttttcccaaaaaaaaaaaaaaaaaaaaaaacttcggga

SEQ ID NO: 103399 - DNA, 967 bp, Triticum aestivum
  unsure (1)..(967): unsure at all n locations
  Clone ID: PAT_TA_103399
ggcacgaggcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtcccgcatcatcggattcgacaacatgcgccangtgcagtgcgtcagcttcatcgcctttaagccaccgggctgcgaaggagtccggcaaagggctaaaacagctactcacgacaggccatatataaagtgccatttgcaggttttgcaacttctgacattgcttttggggttttcctttctccatttaatcntttcttaattgggtccctaaaaaaanatgnngnaatgnnccnttgnttcattgntaccaaacattnggnttcgaagaaaaaacaatggctcctnnattganaaaangcttattcnggggggcttattggtatttttgaaaacggggaccccttaaatttttttntanccannntttgtncggactattttaaccgtttttaaaanaagnccttaaaaaccccccacgttttgggaacccnttatccnncanccccaaanaangcccgngggaacccttttccaaacccnttccaaanggtntccn

SEQ ID NO: 103400 - DNA, 806 bp, Triticum aestivum
  unsure (1)..(806): unsure at all n locations
  Clone ID: PAT_TA_103400
ggcacgagcaaatctaagatttcaaaagtgcagcagcagggtggtagttatatattaagtttcaggccaacaataacaatgaataagcatgtggttccaagctctgattccttgccagaagtaatccataaacatcatatgggaaacttctttgttactcaagcaaacttctttctcacgatatacattggagtctgcaacatgcagagacagataatgcctgccagacatgaatctcaaaagaacatcttccaagaaggaacttacattaccttgtcgtagttattcataaatgatattgctgtaaggttggtgttattatcaccaaagcattataatccacctccatcttcaaaaatgtacgcagaactgaacggtccgccttccgcggtttcgcccgctgctccggatcgttcggctcgccccctgcggcctcgccagacactgggcatctacaagagtcaagagaccaagccacctgccaccaaggtaatttccctttctgaaatctgaatcctgttcacctcatctccactactattaaacaaatgaacaagaactttccggcatggcacaggccatggaatcggatcttatttgaatgtccatgaaggccctcatctaattagctttagaccttctgctcgcaatgtaccactgcaagcatcaatgactggaacagatgaacctggtactacgaanatggaaacttggtataaggtgggagaatggtcttatagtcnaagangctgatactaaattaattttngggaaaagggtatttggcanttgacatatacatgggc

SEQ ID NO: 103401 - DNA, 958 bp, Triticum aestivum
  unsure (1)..(958): unsure at all n locations
  Clone ID: PAT_TA_103401
ggcacgaggtcgccttcgcatctctccccgcaccgccgccgactgcttcttcgtttgcattgattccgcgcgttggcttcttcttcgtttggatcgattccccgcggcggcttcttcttggtctcccttgtttttccggntggaaccctaggcggaggccagcgctagggtttggatcgaaccctagccggagatcgccatggatccagatgtaccagatggtattcaagatgcgcaagacgaatatatacaacaggtggatgcaaatggtcttcatgatgaccaaggcgcacaagaacgaggccaagttgaacaaccagaaggggacgaaccatttcaacatattccaagaggtcttcgcaatgactcaggtgcccgagtgttccctaggaagttgtgcaagcctacatacattaccagactgtctttnaagcggtggaacaaaactgttaagaagtttagtgacattcagctaggncatgtgacaaagtcaaaatggaagctctgttttatatgcccaaacaaacttaaaattccnaatgaatctgcttgaatgggatagatcancatatgtttnggaagtaaagagccatgtttnaagccnaaagaaaaaaagntatcnagaatacctaatgatatgggncaaacaaaaattttcgnttttccctgggggggcacccgagcccttttattatttnangntagnnggaaganacccccanagtggaaaggcaanaagggtttnacaagtttaagggaaacaaaggcnttgtttggaatcatttnggaaccaaaaanggncnnttcnancaaaaattannaggggaggggggatgncntttattgnacccannaccacaaaananggggtttttntcaaggaagcnttancaattttaatttccctatcaaaccnancttgggggcccctgggaacaaanacggntttnggnaaaan

SEQ ID NO: 103402 - DNA, 932 bp, Triticum aestivum
  unsure (1)..(932): unsure at all n locations
  Clone ID: PAT_TA_103402
ggcacgagtttacattgtgaccacctgctctgagagaacacatgtgaaaggtctattttgccttttggttcaaagacatgctccagtttattgctcctttgctccatacatggtgctgctagacctttgtttttttttccattttgcactgtgcaccaattttagccatgttgaataaatccacattatgtgatgtttgaacttgttaggttgtggcgtccttaatttgtaaggttgaactctgatagccttacataatggaggagtatttgaataaaaaatgatgaaccagatgcgttaaaacaatggctaatcttggcgcacaattgtaaaatgaatgaaagaatgaaggacccggtcagaccatgaacagagcaaaggaaaataagttggaccatatcctgaaccaaaaggcaacatagacttttcacgtgtgttccctctcctattagctcaagaaataatgtttgagtgattcctgtgtgctctggtaattaacccggattttgcagtggtactgagcagttgccacaaaataagtgtcccatagccaattttcccttaatgtgtaggctgnggctagtgtttgtagcctcagctttggagattgggtgncatagcacataggattagtatctaaatttttataaacgtaaaatttnggtcccaggaattttnaattttattggattttganccggtggaactccctttttcatttcttatacaaaatttatttttttttaatttncacaataactttttncctttaatttacccagcttttcccaactatttggcataaacctnggttggtttggccnccagnttaaaaccaaaaaanggggattatttgggggggggcctttaanaaattaaaaattttttntttngggggtttattggnanaaaaaancccannttcctgggng

SEQ ID NO: 103403 - DNA, 776 bp, Triticum aestivum
  unsure (1)..(776): unsure at all n locations
  Clone ID: PAT_TA_103403
ggcacgagtgctccacagtcccagaccagatccgacgtcgcggccatggatcccccgccgctgccgcgcgtcctccccgtcgccctccccctcctcctcctcctgctcgcctcccccgccgcgctcgcctggaagagggacgagttccgcaactgcaaccagacccccttctgcaagcgcgcccgaacccgcgccccgcactccctcgacgcgccgctctccctcgtcgccggctccctcgccgtctcccccgagggctccctcaccgccgagctctcccacccctcccgaccccgcccgctcctcctccgcctctccgcgctgcccccggacgccctccgcctccagancaacgaggactactcggncaacaccccgcccagccgncgcttncacgtncncaacgtnctnctccccgacgtngaantnccgcgcgctccacctctccaagcccaagaccgtncggnggngactcncacccgnggcgctctcctccgacatngaagnttgacngnaagcangantcctttnnagcnganccgtnccgnccgagnttggcttgggncagacnccnntngcttntnctttaaacttccnaagncttttttnaaaattntaannccgntggaagngaantcaaaagtccngnaggcngatnncttggggganggaagnanntttangggannctnctaacnngannanagccgnccncccngagngnnccagtanntgngnattaannnntttggaacggntatncctttatatngggg

SEQ ID NO: 103404 - DNA, 776 bp, Triticum aestivum
  unsure (1)..(776): unsure at all n locations
  Clone ID: PAT_TA_103404
ggcacgagctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcaagtgcgtcagcttcatcgccttcaagccaccgggctgcganggagtccngcaaggcctaaacagcttactcacgacaggccatatataaaagtgccattgcagnttttgtcaacttttgacattncttttgggttttcctttctccantttaacttttcttaanntgggtcccctaannaaaaatngtngnatntntnccntgttcatngatcccnancaatggccttnntnaaaangcatngcctctnnattanaaaatg

SEQ ID NO: 103405 - DNA, 347 bp, Triticum aestivum
  unsure (1)..(347): unsure at all n locations
  Clone ID: PAT_TA_103405
ggcacgagatggcccccaccgtgatggcctcgtcggccacctccgtcgctcctttccaggggctcaagtncancgtcggcctccccgtcagccgccgctccaacggcgctagcctcggcagcgtcagcaacggtggaaggatcaggtgcatgcaggtgtggcccatngagggcatcatgaagttcgagaccctgtcctacntgccaccgctnaggncggagacccttcttaagcagnttnantacctgatcacgctccaaatgngtgccttncctcnagtttatcaannttngngtttatcttacgcnatctcnacgaanccttngngtactnngaatngtcgtcca

SEQ ID NO: 103406 - DNA, 912 bp, Triticum aestivum
  unsure (1)..(912): unsure at all n locations
  Clone ID: PAT_TA_103406
ggcacgagcagcagcagcagcgtcggcaccctgcatcgacgagctgccgatcacggccaaggcgttcctggacgtgtccatcggcggcgagccggcgggccgcatcacggtgggcctgttcggcgacgcggcgccggccggcgcggcccggttcctgtcgctcgccacgggcgtcgggtaccggcgcaaggagttcgtgaaggtggtgcccgggtacgtgcagcacgccggcgtggtctcgtacccggtcatccccgcggtgaccgaccggctggccgccgagatggacgccatgcgcgcgcggtgcggcgcgggcggcgcgatgaacgcggcgggggcggtgtcgatcgtggtgcgggacccgagcctgccgccgccgaagccgaagctggtggcgcggggcgggcggctgaagatcgaggaggagcaggtgggcgtggtgcccaacggcaccgagttcgtgatcgccaccagggactcccccgagctggacgcgtcggcgctggtggtgggccgcgtcgtcgccggcatggacgtcgtcggcaggatcgccgcccgtggccacccgtcaagggacaacacccgggttcggccttacttcaaaggtgggcgaaaancttgattcggggggaacaaaaaaaaanccngggngggttnccccaaaaaaccgaanggggtttttaaaacccggccccctttaacaccccaaaggaattccttaaattncancccaaacctgntnggggaggttccctttggagcccancccaagntaangttaanntnagnngggggaaattaaggccaaggaattttttttttnccnttgggggggtttnaattggcccttgggcccnccccttttnnnntttttnaattctttttccttgggggnccccaatttggaancct

SEQ ID NO: 103407 - DNA, 931 bp, Triticum aestivum
  unsure (1)..(931): unsure at all n locations
  Clone ID: PAT_TA_103407
ggcacgaggagagagagagagagagagagagagagagagagagagagagagagagagagagagagagagcggaaccaacaaatccccagccaatctcgcctccgatcgaccccaggctcgtcgaatcctcctcccccaccgcctcaagatgcagatcttcgtgaagaccctcacaggcaagaccattacccttgaggttgagagctccgacaccattgacaatgtcaaggccaagatccaggacaaggagggcattcctccggaccagcagcgtctcatcttcnctggcaagcagctggaggatggtcgcaccctcgctgactacaacatccagaaggagtccacccttcaccttgtcctccgccttcggggaggcatgcagatcttcgtcaagaccctcaccggcaagaccatcacgcttgaggtggagtcatctgacaccatcgacaatgtcaaggccaagatccaggacaaggagggcatccccccggaccagcaacgccttatnttttgctggcaagcacttggaggatggtcgcacccttgcttgactacaacatncagaaggaggtccncccttcactttgtncttccgtctttcgggggagggcatgccanattnttttttncaaggaacccctcacccgggnaagnaaccattcaaccnctttggagggnggggagggtncgttnttggaccncccctttttgaacaaaacgnttnaanggggncccaanaaattccccgggaaccaanggggngggggccntttttccccccgggganccaaacaaangnggccctttttttnttttnnncnanggccaaaacccnncntttgnaagggaattgggcccccnaccccctttttggggggaccttaccaaacaatttccaaaaaaaggggnggnncccncccccntttttccc

SEQ ID NO: 103408 - DNA, 922 bp, Triticum aestivum
  unsure (1)..(922): unsure at all n locations
  Clone ID: PAT_TA_103408
ggcacgagatccaccagttcatntcactgagctcgnaggnagccccagccaccagcgaaatggccgcgttngcgctncaccanacnancagctttctcngnaccgtcccgcggngcgatgacctcgttcgnancgncngngactttggcggncgtatnaccatgcgccggaccgtcaagagcgcnccccagancatctggnacggtcctgaccgtcccaagnacctgggcccgttctccgagcagaccncgttgnacctnaccggcgagatccccggcgactacnggngggacaccgccggattgtntgttgaccccaagacgttcgccaagaacanggagctggaggtgatccactcgcggtgggcgatgctnggtgccctangntgcgtgtttcggagattctgtgcaagaacnaggattnagtttcggcgaggccgtgtggttcaaggacnggngcccaaatttttttcganggcnggcctngaagtacctgggnaacnccaatcttgntgttacgcncagaagcatactnnncatctgggacnggcacntgggcgcncatgggctttaatacaagggntactcgtntttgaaggcgggccccttcnnaagatggcccnttgnaaatttttttacccggggnnngttgccttttggaacccaanttttggncctttggtccgaccnaacccccgnnnnanccgggccggncgaggcctnnaaaggttgaaagggnggctttaaaanaancgnggggcgggccttnggncanttttttttccattnttntggggatttntttcggggcanggggccatntgttaacccgggaaaangggggncncgttttgaagaaaccttttttnnngccccttttggcnggacccgggggnaaanaaaaaacnccttggggctttnct

SEQ ID NO: 103409 - DNA, 865 bp, Triticum aestivum
  unsure (1)..(865): unsure at all n locations
  Clone ID: PAT_TA_103409
ggcacgagccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtcggccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgcttctaccccggggggaagctttgaccccctgggncttcgcccgaggaacccccgaaggcctttcgcgggaagcttcaanggggaaaggagaatcaaaaaacgggccgncttgnccatggtttcttccatggtttcngggtttntttngtgcaagggccaattngtnacccgggcaaggggncccctttgagnaaaccttggccgaacaactttggccgaaccccgttaaanaaanaaaggcn

SEQ ID NO: 103410 - DNA, 832 bp, Triticum aestivum
  unsure (1)..(832): unsure at all n locations
  Clone ID: PAT_TA_103410
ggcacgaggttcagtccaagcatacattaatattatagtacatatgaagtgacttttttgttacaagcaggtaaatgaaaatttctgaaacaatcctaaaagcccagatcagggatgcagttgtcttgtctactcgactttgcctcgagtagaatgagtcatgccggagtccacgctgccgccgccgtggctgacaacggaagagccgaaagattcatcagcctctggccgcatcatgtatgtcgccaccggcatcttccccgggaggctcggcggcggcacctccaaccgcagcacactgacggcctgcctgatggacggcctcaaggcagggtcagggtgtccgcaccagagcccgaccaccatgacacactccatctctttctcgtcgaacttgccgtccagccgcgcgtcggctgcctcgaggatggctcctctgccatgcgactcccatacccactgcaacaggtggatgacgactccgtcatcgtcgtctacggccaccgctggcacccgaccacacgccatctcgagcaggacgacaccaaagctgtagatgtcagattccacactggctttgccgcaaacacgcacttcgggtcatgtagcccgagcgtccccggctgcaccccgtcgtcaatgagccccggccatcgcaaataaacctcgcaagcccgaagtacccaagcctggcatttgaaggacccgtccagcatgatgttgctcggcttggtggtccctntgcaanaacgcgctccctccgtgttctggnggcaggtacataacncttgagcccccaccgagcgcgaactgaaacctgattgccatggcg

SEQ ID NO: 103411 - DNA, 885 bp, Triticum aestivum
  unsure (1)..(885): unsure at all n locations
  Clone ID: PAT_TA_103411
ggcacgagctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcaagtgcgtcagcttcatcgcttcaagccaccgggctgcgaggagtccggcaaggcctaaacagctcaattacgacaggccatatataaaaagggccattgcagttttgtcaactcttgacaattgcttttggggttttccttctccaatttatctttcttaattnggnccttaaaaaanatggggnaatggncccattgtttcattntaaccaaacattggggnttngaagaaaaagcaatgccttcgnaattngngnaaatgggcttnttcggggggggcttatggtattaattgcccccgggnccnccctttaaatnatttanttnccaantnttgtncnaaccttatttttaaccngntttttnaaangggggg

SEQ ID NO: 103412 - DNA, 865 bp, Triticum aestivum
  unsure (1)..(865): unsure at all n locations
  Clone ID: PAT_TA_103412
ggcacgagtagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagcttactcacgacaggccatatataaagtgccattgcagttttgtcaactctgacattgctttggggtttccttctccatttatctttcttaatttggtcctaaanaatatgggnattgtccattgtttattgtaccaacattggntttgagnaaancatggcttctattgaaaaatgcttttcggggggcttntttatatttaaacggaccccataaataattataccaaatattgtcgaactatattaccgtttttaaanggggaacccaangggnaaaatattnttccncccccggggcttttttaatttncn

SEQ ID NO: 103413 - DNA, 902 bp, Triticum aestivum
  unsure (1)..(902): unsure at all n locations
  Clone ID: PAT_TA_103413
ggcacgagctcctnctagcaagctatatacctacatagcacagncatggcccccaccgtgatggcctnnncggncacctccgtcgntcctttccaggggctcaagnccaccgccggnctccccgtcagccgccgctccaacggcgctagcctnggnagcnncagcaacggnggaaggatcaggtgcatgcaggtgtggnccatngagggcatcaagaagttcgagaccctgtcctacctgncaccgntcaacacggaggccctcctcaagcaggtngactacctgatccgntncaaatgggtgccttgcctcgagnncagcaaggttgggttcatcttccgtgagcacaacgcatcccctgggtactactatggccggtactggacaatgtggaagctgcctatgttcnggtgcaccgacgccacacaggtgatcaacgaggtggaanaggtnaagaaggagnaccctgacgcgtacgtccggattatcggatttgacaacatgcgccaggtgcanngngtcagcttaatcgnctttcaagccaccnggctgcgaggaggtncggnaagggctaaaacagntcaattcaccanngggccaacatataaaagtgncatttgcgggttttgnggnaacntttgacanttgnttttgggggtgtttcctttccncccatttaangngttttcttngggttggnntnccctnaaaaaaaaacattgggngtaaanggggcccatttggttaaaatggtaaaccccaaacnattggttttccnnanaaaaaaaaggcaatgccnntcnnttntggggagaaaattggaaatttcgggggggggtttntttttaatattggcacccattgccccctttaaaaaaaatttttatttcccanttttgggg

SEQ ID NO: 103414 - DNA, 864 bp, Triticum aestivum
  unsure (1)..(864): unsure at all n locations
  Clone ID: PAT_TA_103414
ggcacgagctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagngcgtcagctttatcgccttcaagccaccgggctgcgaagaagtccggcaagggcctaaacaagctcactcacgaacaggccatatattaaaagtgccattgcagnttttgtcaactctgacaattgcttttggggttttcctttctccatttatctttcttaatttgggcctaanaaanatgggggangnnccattgtttcatgnaccaaacattggctncgaanaaangnttgcttcgtattttnaaatgctantcggggggncttttgtatattccccggaccncataattattntacaaanatnnncnacntattntaccnttttaantgggaaaaaaaaaaaaaaaaat

SEQ ID NO: 103415 - DNA, 925 bp, Triticum aestivum
  unsure (1)..(925): unsure at all n locations
  Clone ID: PAT_TA_103415
ggcacgagggannaccaannnagccgcgcnttcnccnttgctngcaagggagancaagcnanncagagatgnntgctgccttcncctccaccgncggtgccccggnttntacaccnaccaacttcctnnggaanaagctnaanaancaggtgacctcggccgnnaactaccatggtnagagctncanggccnacaggntnacggncntgnnnncgganaacatnnacgagaagangaacaccnacnagtggaanggtnttgcgtacnanatntncnacgaccancnggacntnaccananggaagggcatcntggactccctnttnnaggcgcccactggcnacgggcccacgaggccgtttctcagctcatacgagtacatctctgcagggactcnataagnacgacttctacaacnccatgngangctcntacatngntnctgctttcanggacaagcttgatggccatctctccaagaacttcatgaccctgcccnacatcaagatcccactcatcttgggtatctggggaggcaagggtcaaagaaaatccntccanngtgagctngtcntccccaagatggncatnaacccaatcatgatnagtgcccggacagctgnaaaagtggcaacgcccgnagagccancccagcttnatcaanncaaccggtnccccttgaggctttcannccnttgatttaanaaagggnnaanaaaggttgcctgggcctttttntattnaaaaccaaaannttttaacccccccggnnncccggntttannggaaagggggccgggntacccccccncccngnnaanaagccgggnnnaaataaaaacccaaaaattgnggggnaaaagggcccnccccctttttttgnaaaaaatttnnncccnntttggcccccccccaccccaaattt

SEQ ID NO: 103416 - DNA, 854 bp, Triticum aestivum
  unsure (1)..(854): unsure at all n locations
  Clone ID: PAT_TA_103416
ggcacgagccactgccagcctnagntnacccgaancaaagncagntagnacgcagcgcgcgatggcggccgcgaccatggngctctcctccccggcgatggccggcaccccggngaaggcctncagggcggngcccttcggcgagggccgcatcaccatgcgcaagacggcgggcaagcccaaggtggnggngtacagcagcccgtggtacggctccgaccgcgtgctctacctcggcccgctctccggcgaccccccgagctacctcaccggcgagttccccggcgactacggctgggacaccgcggggctgtcggtcgaccccganaccttcgncaagaaccgggagctggaggtcattcactgccgctgggccatgctcggngcgctcggntgcgtcttccccgagctgctcgcccgcaacggngataagttcggcgaggccgtctggttcaaggncggctcccagatcttcacgagggcgggctcgactacctcggcaaccccagcctggtgcacgcgcagagcatnctcgccatntgggcctgccaggtggngctcatgggcgccgtggaaggggctaccagcgtcgccggnngnccgntgggcgaaaaacgtggnacccgcttttacccccggnggtaggtttttaacccccntggggccttgccngagggaaccccgaaggccttttcgcgggagcttnaaggtggaaaggganaantnaaaaaaaggggncgggcttnggccatngttnttcccatntttngggntttnttttntnccaaggacaaattngttcaccccgcnanggggccccccttnaaaaaaactttgncnganaaaatttgccn

SEQ ID NO: 103417 - DNA, 504 bp, Triticum aestivum
  unsure (1)..(504): unsure at all n locations
  Clone ID: PAT_TA_103417
ggcacgagggctttctcccccctccgatccgatgtcccccgcttcgtccgccgcgccgatccgacctccagccgccgcgttctctccgccggggacgctccctccggcgccgccggctccgcgccatgaggaagaagctcgacacccgcttccccgcgcctcggattaagaagatcatgcaagcagatgaagatgtcggcaagattgctctagctgtacctgttctagtttccaaagcgttggagctatttttgcaagacttatgcgataggacatataacatcactgttgaaaaaggggtcaaaacagtgagttcatcacatctgaaacagtgcattcatagttacgatgtgtatgattttttgaagaacgtttctagcaaagttccagatttgggtgcacctgatttctagtgttgatgataaagcttggcanaagaaaggaaacatggtgaanaangaaagcnaggaaggaatttaaagcnggacnaanaaatggatgnag

SEQ ID NO: 103418 - DNA, 854 bp, Triticum aestivum
  unsure (1)..(854): unsure at all n locations
  Clone ID: PAT_TA_103418
ggcacgagatcgacctcgtcatcgagggcaccggcgtcttcgtcgaccgcgccggcgcgggcaagcatctcgaggccggcgccaagaaggtgctcatcaccgcacccggcaagggcgacatccccacctacgtctgcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccaccacccactcatacaccggcgaccagaggctactggacgcgagccaccgcgacctgcgccgtgcccgcgccgccgcgctcaacatcgtgcccacctccaccggcgcggccaaggccgtggcgctggtgctccccaacctcaagggcaagctcaacgggatcgcgctccgggtgcccacccccaacgtgtccgtcgtcgacctcgtggtgcaggtctccaagaagaccctcnccgaggaggtgaaccaggcgtttcgcgacgccgccgccaacgagctcaagggcattctcgacgtctgcgacgagccgctcgtgtccgtcgactttcggtgctncgacgtgtncttcancatcgacgcgtngcttanaatgggtcatgggcgaanaacatgggtcaangtcatncgcgtgggtacgaacaaccaagtgggggttacttcccaaaaagggncggttcgaaccttcgccgncaattntttgncccaaccaaatnggaaattgaaacgccccgaccnggggggggggaatttggccctttgtgaaaagngaacttcctnnntcaaaaaatttttcccccagcccatnccg

SEQ ID NO: 103419 - DNA, 773 bp, Triticum aestivum
  unsure (1)..(773): unsure at all n locations
  Clone ID: PAT_TA_103419
ggcacgaggcgccgcggctcctgctgccgccacggccccccttgcccgctccggcgcgggcctccgcgcgccacaacggcggcggggggcgcacggcgccggagctgtcgggcccgacgccgcgggtggtggtggtgacctcgggcaagggcggcgtggggaagaccaccaccacggccaacctggccgcctccctggcgcggctggggctccccgtggtggccgtggacgccgacgcgggcctccggaacctcgacctgctgctggggctggagaaccgggtgaacctgaccgccgccgacgtgctcgccggcgactgccgcctcgaccaggccctcgtccgccaccgctccctccggggcctccacctgctctgcctctccaagccccgctccaagctgcccctcgccttcggctccaagaccctcacctgggtcgccgacgccctccgccgcggcgccgacccgcccgccttcatnctcatcgactgccctgcaggtgttgatgctgggtttgtcacagccatcgcccctgcagaagagcagtgcttgtcaccactcctgacatcacggactccgtgatgcagaccgcgtcgcggggcttgttggatgtgacggcatcaaggacatcaagatatcgtgaacaagtgcggccgacttgtgaagggggaagacatatncacgctcactgcaanaangtcggtactntgtagngngggcaaanataaagatcganaaaagggggcgtgngtncgacncnctgagctgctgaag

SEQ ID NO: 103420 - DNA, 882 bp, Triticum aestivum
  unsure (1)..(882): unsure at all n locations
  Clone ID: PAT_TA_103420
ggcacgaggcggcgatcaccataggtagacctgcgctgatgcctggtgtgcgcgattccactatgcatcactcagtggtggaggaagaagggaagccgtcataaggagctgcctgtggaaacactgaatactgtgaagaggaaaaggcaatcaacttatgtccaaaatgccgagtctcgcactacttcggggaaggagaaggtggtggcgatcaccacngtgtgagcctgcgctgaaatctcgtgtgcgcgattncactacgcatccgnaaaaggttcagaagganaagaatggacgcaaaaatggttctaagaanatnaagttgntggaggaagaagggaagcccgncnaatggagctgcctgtggaaacactgaatattgtgaagaggaaaaggaaatcaactaatgnacaaaatgccgagtctcgtactgnttccgaattacntggtgttgnatggccaacccatattatgganaggccagattctnnattcaaggaaaagttgatgcgncttctccgnaaaccatttancccanggagaangtgatactctgngttgacaanggnnacgactcgaccctccggcnacaatgaaaaaggctnaacnccgccggngggcgtgaaagnactaccaacttttgaacaatggaaaggcaanccattnttttttttgatnggncnccccaagntctttgncgaaaacaaantaccntngtaanaaagggggccnagcaaaacccgaccccagnttangctttntttgngtggggatttttttttnctnggatggggggnaaaatttgggggccttnccgaaccnaattttangccccttgggaggagaattattttttaaaccagtttccaaagnttttcttnt

SEQ ID NO: 103421 - DNA, 776 bp, Triticum aestivum
  unsure (1)..(776): unsure at all n locations
  Clone ID: PAT_TA_103421
ggcacgagcatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttggggtttccntctncatttgctttcttacttggtcctaanaanatgggnatgtccatgttcatgtaacaacattgggtcgagaaaccggctcntatgtgaagcaatcggggtnttntatgccatgccataaatatatcaantggcatatgattcggnaaaaa

SEQ ID NO: 103422 - DNA, 808 bp, Triticum aestivum
  unsure (1)..(808): unsure at all n locations
  Clone ID: PAT_TA_103422
ggcacgagggaaggcattgcgagattgttcacatgatgatgatgatgatgaggcacggtcatatctcatggatatggggactaaagctttgaggcgttacttctttctgataacatttaggtcctacgtccattgtacatccttgcacgaagtaacatttgcgtcatggatggaggctaggcctgaactcggccacctctgcgataacttaaagctggatagataaaatataccttggtcattattttggagcccggggtgtcatgggactggtggaccgtggactcaccatttctggacctgagaaggtggtactaaaagcgatgagtaaggagtaaagataatttggagggagtatgtattggccgaaagaggggcattgtattgaacttgcttctgctaattaacagaggcaagcatgtatgtgtatatatatttatatattggcaagcttaagttggactaggacagtatgagctttccgatctacccctctgtgccgtaatgtaagacgctattcaattcaacactaaactagtgtcgaaaaacgtcctactgacgctattcaattcaaaaaaaaaaaaaaaaaaactcgagagtcttntagagcggccgcggcccatcgattttcacccgggtggggnaccaggtaaagtgtcccaattcccctatagtgagtcgtattacaattcactgggccggcgtttacaacgncgngactgggaaaaacccctgcgttaccccacttaatcgcnttggagcacatcccccttttgncanctggnggaanaacnaaaaggncccccct

SEQ ID NO: 103423 - DNA, 568 bp, Triticum aestivum
  unsure (1)..(568): unsure at all n locations
  Clone ID: PAT_TA_103423
ggcacgagccaccacagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcggccgaccccgagaccttcgccaagaaccgggagctggaggtgatccactgccggtgggccatgctgggcgcgctcggntgcgtcttcccggagctgctcgcccgcaacggcgtcaagttcggcgaggcccgngtggtttcaaggccggntcccagatnttttagngagggcggcctngannacnttggnaaccccagncttcnnccatgcgcaagagnattcttngncnatttt

SEQ ID NO: 103424 - DNA, 525 bp, Triticum aestivum
  Clone ID: PAT_TA_103424
gcacgagcagaagtctctttctactcactacttcgtgcaagcaccgtatctcattatcccctatacttaaatacgtacatgtaactatatatgccacctagttctgtttgttaagccaaagcaaaccacacatactgcacactacaggtagttgctaggaatacacacatcctctgatcaacatgaccatcccaccaaagcctttgctctttgccctcctcggttgcctctgcttctgcagttcagtcctagcagctcgtgagctcggtgatgacttatcaatcacggcgagacacgagagctggatgttacaatacggccgtgtgtacaaggatgccacagagaaggctcaacggcttaaggtgttcaaggccaatgtcgggttcattgagtccttcaatgccaagaaccacaagttctatttgggagtcaatcagttcgctgacctcaccaacgaggagtttaagacgacaaaggctaacaagggatacaaatctagattcgagagggctcccacgggattca

SEQ ID NO: 103425 - DNA, 374 bp, Triticum aestivum
  Clone ID: PAT_TA_103425
gcacgagtggcagcaaaggtgaagtggatgatggactctgacggcgggagggtgatccgtgagcggacgcaggcggccatgcgtcaggcgaatgaggcgatgcgtgagggcggggagtctgaggcgacgctggcgtcgctggttgacgcgtgggtacttgcttgacgttggctagatcagtcaagaagggatccggtgatgcacgtgtagcgtggttgtgtgggggagtattaagttgttgcgaaaataaacaagtagtagtactaccgttgaggttggttgtgtttttttttcctttttaccaatttcagtttcatttgtaatctacttgtatcttacatttggaagcaaataaaatagaataaccgttttac

SEQ ID NO: 103426 - DNA, 619 bp, Triticum aestivum
  Clone ID: PAT_TA_103426
gcacgagcttgtgttgtagtatttcccccttatatagtatgtgtctcacaagcttattctatggcaaacaatgtgtgaggtttcagattctgtaatttttagacataaagggttgcatgaatattttacaggtgggaacacaagacatataatttggagcatttgatccatagattctgtaatttgttacttcaatttctttcataaattatgcttgtctagaggaagatagtagcatggcttgtactttaggtctgtaggaacacaagacatatgatttggagcatatgaatactctccgccgtcactgatcttaattttgaaacgtttctcactgatcttcggattgaaaagttgcagcacttattacattttatcattttacctgaagatgtaacatgaaaaattgcagtatttgtctggaaaattaatttgctctcacatctgaagtcgtgtctatcctgtagcttggcactagttagtttggttcattaaacccaagtacaatatgaaacttcgttgccaactttgaaatcccatactggattccgatcacattggtctaattttatcattttggccctgtgcagttttaacatttcagttttgctgtgtttga

SEQ ID NO: 103427 - DNA, 485 bp, Triticum aestivum
  Clone ID: PAT_TA_103427
ggccaccagcgtggctaatgcgccagttccggctactgctcctgtacatgctaacgtcccgaacgagcgatttgcagtgcatccactaccctacgcttctcctttaccgtcttcttcgccgtcgttgtcctcgcctcttgcacgaataacctcccctacggtcaccgccttcttccttacgttcctcaccctgctactgctcctcataatgctaacgctaattttgctaatgcggaactgctagctatgtcgcgcagccgcgcacacgagatcgcaagaatcactcgtttgtgcagtgcagccacgtcactaacccgctcgcgctcgcgctcgcgccgggatggctgtctgtgttcttgagctgtgctttggccgcgttggcgcgcgagcgcgcgctatcgcgtttgcgaaggctggtagtgagtgttagagccagccacgcagcaagagcgaacaagcaagcagggattgaaggaatgatgttg

SEQ ID NO: 103428 - DNA, 653 bp, Triticum aestivum
  Clone ID: PAT_TA_103428
tcctatcgacgtggcttcaatgttggttgggtgtagggtacgttgtcttgggggtagtggttcgaccccttgggacgtggggcaggacacgccaccgtctcacgacactacactcgattctttgcttagacgtctcacccagtggaagacgtccgtctcatgcggcgtagacgtaatcatccggcaaatggttacccaaaaaatggtcaaggcccaccctcagttgtttccgcaatgcattcgattttaaattcatataccgcaataacgacacgagatgaccctctcgtcacacaattagcgtcaaccaatgtcctaaaagcattttcgaatggtcccacaaccccgctgtgttgagtggggcaggaccaaactcctatagattacccccgactcatgcgggaggaaaaatatacccatgtgctgaacgccgaatatcagcgagacacgtgcatattgctttccgctgccaaccgtccaaccacaacgcgcagaactgggcaagccaacttttccgaaatcctcctacgaatgtgaatgcgttgaaccgactcaaagttggcgtctagaacgactcattgctatcaagccgcgaatcatgcttttctgcgtgttcatagccatttcgcaaaggcaaggtgttcgcaacagct

SEQ ID NO: 103429 - DNA, 224 bp, Triticum aestivum
  Clone ID: PAT_TA_103429
gcacgagcacttctatacatattttcttcttttgttgtgttttagcataatcatagtatgatttgagtttttgcaagcctgctgaagtcctattgattgtgctcctgcaacttagcatgatcgacgtctcccgaaaattaagagaataactaattgtatatgctatttatgagtgaattatgtgtccttggctattgaggcctaatgaaaactttgtattgggt

SEQ ID NO: 103430 - DNA, 317 bp, Triticum aestivum
  Clone ID: PAT_TA_103430
ggcacgagtcaaagggcgcatcggaatcgcaatgtctacggcctccgatgaagagcacatcactgttgatccactcgctgcctccttcactgttgtgtgcttcggggacctatactgtacgcaaggaacaacacagccgaacaacacgttgccttattgacaaagggaacggaactttgcactgtgcttcaccacaattgcgttgtagtacgagattctgactctgtcgctttaactacccagcagagaaaattccttctgcttttgtttttaaaaaaaaaaaaaaaaaaaaaaaaaaaaaaaaaaaaaaaaaaaaa

SEQ ID NO: 103431 - DNA, 568 bp, Triticum aestivum
  Clone ID: PAT_TA_103431
ggcacgagcgctgttgtcaaaccctggcacgatgtgatcatcataggttactttcaacagttagatcatgcgtcagctcagagtgaataacgagactcgctgatccttagtgtctgtctgatctagctgctgagtgtagcttcctgtgtgttttacttatatcattcatttgtatccaacctccgactgtgatctcctccttgtatatatcagctgtacaactgaactgaaacttggccgtgttcggtccaactgtaaatacatcgatttgtttgaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttt

SEQ ID NO: 103432 - DNA, 515 bp, Triticum aestivum
  unsure (1)..(515): unsure at all n locations
  Clone ID: PAT_TA_103432
tttttgaaaatgcgaacaaaaaattgaaactccaagaagttgtgtacatgattttctttggaaattgcgaatattttttaacaacacgaacaatttttgaaattgtgaacaaaaatataaatttcgaacatttttcagaacatgaataaaactccaaaaacattttttgaagcgacgaacaaatttctaaattccaaacactttgtaaatttagaacaactttttgaaaatgtgaacacaatttggaattttgaacatctgtttgaattgtaaccaaaattgtgaaaacaggaatattttttgaaattgttaccaaaattttggcaatgtgaacattatttcaaaaacatgaacaaattttgacaacaagattttttttttgaaaattttgaacaatatttgaacttaaaaagaacagaaaaaataaagaaaacagaagcacagaaaaagatagtgaagaaaaccggaagaaaccagtanaaggaacagaagtttattggaaattccttgacctg

SEQ ID NO: 103433 - DNA, 603 bp, Triticum aestivum
  unsure (1)..(603): unsure at all n locations
  Clone ID: PAT_TA_103433
ggcangagctcccctctctctccgccccacccctctctctctctctctcccactcgtctctccctctccctcccgcgagcagctacgacggccaaatccggcgagctctggcggaattcgacgacgcctgccccacagccgagcgcctcccgaccccgcctccctcgaccccgcgccgatgcgccgcctcgcctccgcccaccggtgcgtgccgccacctcaccagaccccaggagccccgccgcctcgcgctgccgcctgcaccgcgtcgcgtgccgccacctccccacaagctcgccgccccatcgcggaagcctcaccgccccgccgccatgggaaccgagctcctctgcgccccgcccgccatcggagatctgaggccggccgggaggcggggatggggtaccggtgggccccggggatctgcgcggtggtgctgctctggctcgctgcgaccgcagccggagatcccgatcccgacgagctcgagcgcgcattgccaatgccaatttacaacaatttcaggtctgcgaaagttggattttggataggctttcaagagcgtgaccgaagcagagacacacacatgtttgtacacttgaa

SEQ ID NO: 103434 - DNA, 549 bp, Triticum aestivum
  Clone ID: PAT_TA_103434
ggcacgaggctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacgggggcggttcgccgcccccgacgtcgcgagaagtccattgaaccttatcatttagaggaaggagaagtcgcggcacgagctcgtgccgaattcggcacgaggcggcgtacgtcgacgacaaggtcgggtcggcgtggacggggatgctcttctcgtgcaagacggaggaggagcgggcggaggcggtgtcccg

SEQ ID NO: 103435 - DNA, 578 bp, Triticum aestivum
  Clone ID: PAT_TA_103435
ggcacgaggtaacaagcaacaagggaagatgccacaagttcaatctcatgctcaacctcaagttgaagaaaggccacttcccaagaagactcaagttaatgcctctcttgttgagaaaccaagtgagaagaaaatgaagagtagacgttgctacttatgtcgtgagaaaggtcacgtcgcttcttcatgcactagtggtaaattatccaacccaattattattgatgatatctattctcttgggaaggataaggttggccatgtgtttgccaagtttgttggtactcaaagtggtgtcaagaaaagaaccatttgggttgccaagcctattgtgactaacctcttaggacccaacttggttggggaccaacaagctcaaacttgatcaataggtgttgttggagggcattggagacttggctacattatgaagaattaaggggacttcatcattcttattgtctcaagccaagtcaattggattatcaagtttctatcttatatccaatgtgcctccttgcggtaacttgtacttaaattgattacattgaaagttacttgccccccttgcttgtttt

SEQ ID NO: 103436 - DNA, 566 bp, Triticum aestivum
  Clone ID: PAT_TA_103436
ggcacgagccaaaagattacgacttcgggactctaatttccatggagaatctctattcctaatggagcagttggatcttcatccgtcatcctgagcaattggggcggcgatgcgggcgagcttcacgatagtggggaggaccaggccgcggtgaaggcaggtcatgcgctcctcacgctccacgaacggaacctgcgcacggaggcggtagcgcggggtggcagccggcaatgaggcggccgcgctacgtgacgagctacgggtccccctttgtgatgttttggcatcgctccttcatcgcacatcctcaggcgatggcggtggtgtcgctgatggcggcgaggacagcatgtggcagctcccgaagcatgaacacgaccgcacctcgggcctgccgtctgccaagatatggctctggccgattgacaatggaggtttgggatccttcctctcagcacccactcctggaagaatcagcggtgcgccacgccgattgaaccccgtcgagatcactcgccaagattgctattctgaagtttattgtaaagaaagtgaagagtgagaca

SEQ ID NO: 103437 - DNA, 384 bp, Triticum aestivum
  unsure (1)..(384): unsure at all n locations
  Clone ID: PAT_TA_103437
gaattcggcacgagagcggctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccaggtgccagctttgcaggatggtgacttgtacgtcttcgaatcacgtgctatttgcaaagtatgcctgcccgcaagaacaagccagagcttgttgaangaaggccaacatcaaggagtcagcaatggtggatgtgttggctcaagg

SEQ ID NO: 103438 - DNA, 326 bp, Triticum aestivum
  unsure (1)..(326): unsure at all n locations
  Clone ID: PAT_TA_103438
gaattcggcacgagcgccgtcgatcgaatcgagcgacccagagccaagccaatccgagccgagagtttcttctccgttgccagcgccgccgagcagacgacggcgacgacgatgggcaagatcaagatgccggccctcttccgccgccgctcctcctccaagtcgcgctccgcgtcgccgccgcctactccccaggaggaagagggcacccggccggcgtcgggcgcggggtccccggcgcggtcggcggaggaggagatggagcgggtgttccgcaagttcgacgccaacggcnacggcccggatctcgcgggtcngaacctggc

SEQ ID NO: 103439 - DNA, 288 bp, Triticum aestivum
  Clone ID: PAT_TA_103439
gaattcggcaccgagatcaatctagatgatctagttgccttctccaaccaactcaagcctagatttagccaaaaatctaaagatgcaaccaccattgcccctaagcacaagatctaaaagcaagaccaaaagagagaaggaacgggggcaataccggcatccatggcaagaggacaaggtggggattgactccaccgaaggaaatggagaggaacgccccggaggaggagatccaccggagcccttccgcggcggaacggtgctggagagagggagaggcacgagggt

SEQ ID NO: 103440 - DNA, 364 bp, Triticum aestivum
  unsure (1)..(364): unsure at all n locations
  Clone ID: PAT_TA_103440
gaattcggcacgagctcgtgccggttctgcatctgatcaaatactaaagagaaacaatgttttgacaaattattaagccaagtgggcttttttgttcatctgctatttacttttctggcgtacaggttcacataaatctgagatgataaggatttatcaggcaggagccatgccatgccagcaaagagttgcaacaatgcatcagcgggaacagtattacagtacttggacttgcttcaaaaattacctttttttttgcagtacttgagcggnctcagtttgataatacaagaacccggtggtagcatttctacaacatgaagaccaagtaccggancaacttaaatctgnaaggttnaagaat

SEQ ID NO: 103441 - DNA, 314 bp, Triticum aestivum
  unsure (1)..(314): unsure at all n locations
  Clone ID: PAT_TA_103441
gaattcggcacgagagagaactaagtttttttttttttttttttgaaagtctccatcaatttgcacgccgtcttgcgctgtgcttattttatatacaatctgtagttaaaaatcagccacaaaagtaggcaaaaaccgggtccaacaaacactaaaataggcaggggtcaatgggctcatgacaatccactccacccaaaacaaatcagtgattaagcacaacaatacatttacggcaagatattcagctttctgatacaatttcgctgagcctctctccatctattcacagcgggcagaacatgcatggnaaa

SEQ ID NO: 103442 - DNA, 337 bp, Triticum aestivum
  unsure (1)..(337): unsure at all n locations
  Clone ID: PAT_TA_103442
gaattcggcacgagcgacagtcatgccgaaaccgagtggttatgccctcgtcctcaaccccaccatcgtcgcgcggcgcacgtgcaagttctcccaagtcctcatccacggcggcagcaacatcaacatcctctaccgcgacacaatgaccaacctcggcctcaagcccgagaacctggaaccgacccgaacgatcttccacggcatcgtacccggcctctcctgctctcgcattggccgggtccggctcgatgtcctgttcggcgagagcaaccactttcngtgggaaccaatctgggtctaagtggtggacctgtcctacgcgtaccaagcgctt

SEQ ID NO: 103443 - DNA, 328 bp, Triticum aestivum
  unsure (1)..(328): unsure at all n locations
  Clone ID: PAT_TA_103443
gaattcggcacgagggaggccgctgccgccgcctcggcgccggcgaagcagcagcagcggcggcggaagaggccgttctggaggctgcctccgtcgttctggcccgcccggtcgccgcgcgccgctgcagcgcagtgaggcgaacggcgtacgagctggtgcctggcaatgtggacagaaggcatatatcatggcaccctgccgctgtcatgctgctgcctgccattgcgccccgagttcatggcaatgatccctgcgaccagaccagcccgaccatgcatgtgtatacaagattattgnatagtttttggacagaacaattgagttc

SEQ ID NO: 103444 - DNA, 364 bp, Triticum aestivum
  Clone ID: PAT_TA_103444
gaattcggcacgagctctagatgttagatgtaacaatttcgtggtcaatcaaccgtaatatggtaaactagaaagtgatatgagtttttttgatgcactagaaatatatgaaaactgttggcccaaaatcagagtgctgcactaaattattggccattttatctcaggtttttgatgttacttgtcatgtatcaattttgtggtcaatcaactggtaaaacactaaatctagaaagttatatgagttcttttgatgcactagaaatatatgaacactgtcgacccaaaatcagaggactgcacttaattattggccattttgaatcatggctttgatgctaattggtctaccatgaacattctc

SEQ ID NO: 103445 - DNA, 234 bp, Triticum aestivum
  Clone ID: PAT_TA_103445
ggcacgaggatcattcggaaatgtttataagggacagcatacagatggggaatggattgctgtgaagctgcttcataattacattccaggacttgaagatgagcaatttgagaaggagtatcacaatctcgcaaatctgcaacacaacaatattgtgcggttagttggctatagtcatgaaactcggcgagaattcctaccttataatggtgacctggtcttggctgacattac

SEQ ID NO: 103446 - DNA, 229 bp, Triticum aestivum
  Clone ID: PAT_TA_103446
ggcacgagcgtaggaatcgccagtgaggagcgaccatgtttggttcttgaattctgagtttattgttctgttttattccggttacgcaggctacccaccgccgggcactgcagcagcttaccctccgccgggccagcagcagcaggcctacgtcgcgccgccgccgtccacctacccgcaggaccagcagtaccctcccgccggcgctggcgccgacaccaccagccgc

SEQ ID NO: 103447 - DNA, 234 bp, Triticum aestivum
  Clone ID: PAT_TA_103447
ggcacgagcccgttcaaaatcaagcgtcgtcgcgacgagacgcgccatcgaattcatgcttggatggtttttggacccgctcgccagaggagactaccccgagagtatgaaagaattagtaggaaaccgtctgccgcagttcaccaaaaaacagtctgaattggtgaaggattcattcgacttcattggaatcaactactatactacaaactacgcgggtagccttcctctatc

SEQ ID NO: 103448 - DNA, 487 bp, Triticum aestivum
  Clone ID: PAT_TA_103448
ggcacgagaaaaaaatgacttccaagctgattttcacaaagtcgtgaaccacatgttaaccgaagatgagttcgagacgacatggggtatgttgctggataagtacaatttgcgaaagcacgcatatatgacacagatttatgagattcgaacaaagtgggcaaaaccatactttagaggtgttttctgtgccaagatgaccaacaaacaacggagcgagagtgccaatcacatgttgaagacatacatgcccccagcgagccccatgcatgtgtttgtcaggcagtatatgagactgcaatttgacagggagcgtgaagagagctacgaggagaaaagaactatgattggaggtgcagtgagaagaacaaatttggctatagagaggcacgccagtaaaatatacacccgatctatgtttgacgagtttgggacatttctgatggaagccacaacatataacataacggagatagagaagatgaag

SEQ ID NO: 103449 - DNA, 332 bp, Triticum aestivum
  Clone ID: PAT_TA_103449
ggcacgagcgagaaatattgcgtgtacagccggtatatgatttgagcggctcatttattatttatccggtgaagtgctgatgaccggtcgattggcaattgggatcgatgcacatctgcatcaacaggcggatataaacggtggttccataaggtgtggatttctgaagttgtatcatgtacttgtagggcattccctgtgtaactttaatctagggtaccagcacattgttcccgcttccctttggattattatatgtaatttgtaccttggttagccggtttaaaaaaaaaaaaaaaaaaaaaaaaaaaaaaaaaaaaaaaaaaaaaaaa

SEQ ID NO: 103450 - DNA, 473 bp, Triticum aestivum
  unsure (1)..(473): unsure at all n locations
  Clone ID: PAT_TA_103450
ggcacgtngcccatccatacgccgcagcgcaaagccctcctccaaatctctcgtcctccctccccatctcggcgtctacatctccatccatcggcaagcgaccccatcccacccatggccctccgcgcgctcgacaacacgctgccggccgccgtggcggaccagcgccccaagaaggccgccaagctgttcgccgtcacccgctcccccaccggcagcggcggcaacggcaagaagcgcaacgacgagaactctgcgccgacgcccaagcccgcgtcgccggttgcggctgcagcggagcccgccgtggagtacgtccggtccgaggacctgctgcccgtgcccgcgcccaaggcccgcgccgccggcctcctggcggggctcgactccaaggactgggtcaaggtctgcgaggccctcaacgacgcccgccgnctcgccatccaccaccccgccctcctcgcccccatcct

SEQ ID NO: 103451 - DNA, 504 bp, Triticum aestivum
  Clone ID: PAT_TA_103451
gcacgagcgtggagcaaagtcgttcagccaacctgcggtgggggactaggaatcgaaacctaaagctccaggggcttgcgcttcgtgtgagcttgggagtggctgcgttgtactgaccctggaaaaccatggcagggattgcaaatatttggagatatttctgcaaggctcgtatttcagtcaggtttgcattacagttgcggggtggcaggcacatcttattttggagagattgctcgatcaatggttattctgttgctgagttttcgccgctagttatggagttcattcggctgccctggtctgttgctggagttcattcggctagctctgtgtaccgtttgcttactatcttcaccggtgctgactgcacatggagatgctgggcacccttaacctgcaagataattgcctggctagcttgtaccatatcggctttggacctgattgggacaacttgtgattagccgaaccatacctaccaatgtaggaacagtggccaat

SEQ ID NO: 103452 - DNA, 348 bp, Triticum aestivum
  unsure (1)..(348): unsure at all n locations
  Clone ID: PAT_TA_103452
gcacgaggcgggatntcaggcangatgaccgctaccctgggtctcaatactatcattgctatgctagttgcttcgttctatcgctatgctgcgctacctattacttgtttatcaagccatcccaaattgccatgtcagcctctaacctttgacacctttcctacgcaaaccattgtttggctatgttaccgcttttgctcagcccctcttatagcattgctagttgcaggtgaagttgaagatttctccatgatggacaggattttggttgggatatcacaatatctcttatattattaatgcatctatatgcttggtaaagggtggaagactcggccttttgcctag

SEQ ID NO: 103453 - DNA, 308 bp, Triticum aestivum
  Clone ID: PAT_TA_103453
gcacgagcttccgccagcacctgataatccagcgccttcaacatgctgataatgctgcgggcgatgatgcgcgagccgctgtcgttgagcaggccgctgattaactggcggtcgagcttgatgatatccagtggcatctggcgtaaatagctaatgttactgtaaccggaaccaaaatcatcgagcgagaggcagaagccgcgcagcttgagcatgtccaaaaaaaaaacaaagaatagaaataaaaaaaagaaaaagaaaataaataaggaaaaaaacaaataaaaaaaaaaaaaataaaagaaaag

SEQ ID NO: 103454 - DNA, 345 bp, Triticum aestivum
  Clone ID: PAT_TA_103454
gcacgagttacaggcatttcaacaactaaaccatatgcaattgttgttgagcaatgtggcgattactgatcagagacacctggacttacagttggaactcaaaagattttactgctattaacatgtacaagtttttatagcaggacaatgctgcttccctgccttcttgaaaatctggagatgtgtggcaatgccaagatatagaatatttttttggctgctcttgcatgacagaatcaacaccagatgcctcctccatagaaaagttttttacatgtcttctcagaattgtgccatttgtactctaaatgctgatgagactattttcggattgtctgtttgctt

SEQ ID NO: 103455 - DNA, 271 bp, Triticum aestivum
  unsure (1)..(271): unsure at all n locations
  Clone ID: PAT_TA_103455
ccacattgctgtcaagttcgccgagctggtgaccaagatcgacaggcgatctggtaagganctngaggcgctgnccangttcctgaagaacggtgacgctggtatcnngaanatgattcccaccnagcccatggttgtggagaccttngncacctaccctcctcttggncgnttcgntgngcgtgacatgagacaaacggntgctgttggtgtcatcaagggcgtggagaagaaggaccccaccggtgccaaggttaccaaggccgccatc

SEQ ID NO: 103456 - DNA, 100 bp, Triticum aestivum
  Clone ID: PAT_TA_103456
gcacgagggtcggtgaaccttgtgattgtgttcttatcagtaatctgcatacaatctattggtatctgatatagatctgtttggaggcggttctgttttg

SEQ ID NO: 103457 - DNA, 251 bp, Triticum aestivum
  unsure (1)..(251): unsure at all n locations
  Clone ID: PAT_TA_103457
gcacgagccaccccgcctccctcctcgtgccctccgccgccgccgccgccgcagccgcagcctcggcctcgaggcctccacccgccccccangcgcggncgaggctncagaagcgccccccgnttggccggaacaanncggttccggcngaatngnaaacgncgggggcatcgggctcctccggccatgcgccgcgcggcccatcctcaagagccctagccccggggccgcccgccggggaggaaagcgga

SEQ ID NO: 103458 - DNA, 130 bp, Triticum aestivum
  unsure (1)..(130): unsure at all n locations
  Clone ID: PAT_TA_103458
ctggctcagtcacttggagancctgaataggaangatntgnttgantacttcattgagcaatatatgctggtttcacgttacactgccaatggntgngcgcnattttacggatcnaggngcgtaaagcca

SEQ ID NO: 103459 - DNA, 341 bp, Triticum aestivum
  Clone ID: PAT_TA_103459
gcacgagcttagctctacattgaatcaatgccaattttctaagagtgttggatcgaggcactagtttagcctaaattcaaggagtaggtcatcttgggtgccttttgcatgtgggagtttttcgccttgttttcatattataggaagtgtatggtgttggagaggttctctacatgaggtgtgggctctagacgagcgtccgcattttcatcgtctgcgttgtagagtgtggaaaggcaggcaattaggctattcccattgcagctccttttcagtgtgtttgatatgcttacatacaagtacttggattcatttttatcttacactatttcttatgatat

SEQ ID NO: 103460 - DNA, 628 bp, Triticum aestivum
  Clone ID: PAT_TA_103460
ataacaacgatggaccgcctcttgctgtcccgccccccgatgcccacccccgtccacggcgctgccacggccgcagatggcgacctcctcgagctcgacgtcctctggcccgcctcttcagctccgggactcctcgccgcgcttcccgatgatgaggctaagaagaagcagaagcgcgcgggcggccctgccgtccgatccgccgcgcgcgccgtcccggagaaggccgcgttgaccccgtcttcggcggcgaggtcggctccggtgcgcataccttcggatgctgcggcgcggagagggaggtggtcccacgtcgtcgtcggcggcgacgacggggacgccatggtcccgccgcacgagatcgtcgcgcggcgcgcggcagcgcacagctccgtgctggagggagccgggaggacgctcaagggccgcgacctccgccgcgtacgcaacaccgtcctgcgccgcaccggcttcctcgactgagaggcggaggcgagtcgcctcgtcgctttcgcgataaagttttgacttctgttaattccccccgttagttccatccattgcgtttccggcagtttttgatttcattccccgatgggaaggggatgaaaagtaaagaggtgaggtg

SEQ ID NO: 103461 - DNA, 220 bp, Triticum aestivum
  Clone ID: PAT_TA_103461
ggcacgagctcggcgatcgcggccaagaagccgcagcagaggtgcgggcgccgcagcggcgggaggaagaaggtgcgcgtcatgccggtgcgcgaggaggtggaatacggcgaagacgttctgctgaacgagaagcttaacgagcggacgctcggggagtttgcggtgtcgccgaagagccaagagaagatggccgccgtggcggcgcggtcgcggctga

SEQ ID NO: 103462 - DNA, 261 bp, Triticum aestivum
  Clone ID: PAT_TA_103462
ggcacgagaggtggtgaacgaccaagtgttagagagaaagagagttgattttgtgagtggagaggggggaggagacagggatggagcagagcaagggatgaggcaagcaacaaaatttaccacctgattatgagaagagggagagagttgccagagcttctgttgctgttgttgctccctccctgcactgcctcttccctggctcccctcccaaatctctccctccccctctcttgccattttctgcccctgttatagctc

SEQ ID NO: 103463 - DNA, 349 bp, Triticum aestivum
  Clone ID: PAT_TA_103463
ggcacgagaaaagttgccccttctgaaggacaagaaaatgcaataaaaaacttgaaagcaagacatgagctacaagatgaaaaggactgttgtgggaattttgcaattgatggaagtgatgcatgtcataaaaactgtctggattcaaaccacacatcctctcctaactgcagcatggacgatgatggaggtgctttatgggatattttcaggagggaggatgttccaaaactggaaacataccttcgtaaacattccaaggaatttcgccatatatattgttctccagttgaaaagacatttaaccctctacatgatgaaacattctatctaaccgaggaacataaaa

SEQ ID NO: 103464 - DNA, 180 bp, Triticum aestivum
  unsure (1)..(180): unsure at all n locations
  Clone ID: PAT_TA_103464
ggcacgagcctgcaactcagcttgtcaccgccatttccaatcctagattggcaaatagtcggggttgaggaaagggccgtcaccacagcgaggcgtttcacaaatccaaaggcagcacacggngagaagatgacctggtatnatcaaaggtgtgaggacgttggcggggtttggacttgc

SEQ ID NO: 103465 - DNA, 307 bp, Triticum aestivum
  Clone ID: PAT_TA_103465
ggcacgagctcccttgatttgtttgttcatggaggcaataacttctaagttttcgttgcaactggatgctggggctctgccagatctgatataatacagcatagagtactaccaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcc

SEQ ID NO: 103466 - DNA, 607 bp, Triticum aestivum
  Clone ID: PAT_TA_103466
gggcacgagcttggttcccaggttcggctgatggtttatcagattacagggataacatccctgcttctggtagtcagatccagaatggcggtcctgctgtgacatctgatgtggttgctaaacaaaatgaatggtgggcagagataatgaatgatgattggagagatattctagatgcaacggctgctgatccccagtcaaagcctgctgtcaaccagccagcttcatctcatggtggagagatttgcaatgtagctagtcctcccaatagcaactctgcagccaaacaacggatgaggtggactccagaactccatgaatgcttcgtagactctgtaaataagcttggtggtagtgaaaaagctactcccaagggtgtgctgaagcttatgaaagttgacggtttgacaatatatcatgtgaaaagccatctgcagaagtaccgaacagctcgctataagccagacctaacggaaggtacagcagaaaaaaggactaccaccgaagagttgactctagacctgaaatcgagcatggatcttactgaagcgctgcgtcttcagatggaagttcagaaacgtcttcatgaacaacttgagacccagag

SEQ ID NO: 103467 - DNA, 572 bp, Triticum aestivum
  unsure (1)..(572): unsure at all n locations
  Clone ID: PAT_TA_103467
ggcacgaggatttgggctaaaggttataaatgaaatcaacaatgaggggtgttctcgtggtgtgccttatctgcaagatgttagtgcaagtgtttctgtatcagccaaggaatttaattgttcagggagtgaggcaaatagtccggataatgctgcctgtggtgctgcagaatgcatggatgatgatacaagtgagttaacttgtgtagatccatctatggcagaatcagaatcttctgactctgcatcttctgatgaagaagaccatgggcagatatccgtctgtgctgatatagaagagaactgcgctccagagcctaaatttgacaggagtacctcgtccaagtcagacttctttagatctaacaaactccagaggattttgcaacatggcagcgcattatacgtntggatgctatccgggcaaacacagactgggctttattctcctgtaaccaggctgaaatctccgaggaaaaggcattgcagtgtgcattgtctgttggtttgaaagattatgaccatttacagccttatatggtatatcatgctgcccggttagttgcattgct

SEQ ID NO: 103468 - DNA, 495 bp, Triticum aestivum
  Clone ID: PAT_TA_103468
ggcacgaggcaagaaaccctagcgccgccgctcgccggcgatggaggcgccggacgaggaggccggcctggggctcccggagggcgagcggcttctggaggtcaccatcatctccgcgcaggggctgaagccgccttctggacttcggcggcggttgcaggcgtacgccgtggcgtgggttgacaccgcgcacaggctccagacgcaacccgaccgctctggcggccccgatccggcttggcacgagcggttcctcttccgcgtgcacgaagccgcgctcgccgaggattcccgcgctgccgtcaccgtggagatctacgcctcaccgaacggggcctggcacatcggcggggactccctgatcggatccgcgcggttcctcctcggcgacaactgcctcctgtcccgccccgttgggtccccagccatgttcgccgtcggcgtccgacgcccctccggccgcgtccacggcctcctcaatgtggccgctagcct

SEQ ID NO: 103469 - DNA, 428 bp, Triticum aestivum
  Clone ID: PAT_TA_103469
ggcacgagggatatccaacgcatcaaacatggttttttatttgtaaaaatactagcccgtgcaggtgcacgggttgacgacatctacagccacgacccctccgtcgtcctcgtcacctggcaccttgggtatgattgtgatctatgcaatgggtgcagagtggaaggggctgccgttccagttcagcagggtctggaccctctaccgcagtgagctcggcccgcatcggcaacagcggattcagattttatggtggcctgtgaggaggatttcaggggagatcgtctgtgaatataacaagaggctgagatttgacctgcactgcatgcgaaaagcaggttcaggagctccaagctaacaattgccagagctttgaaaagatatttttacaattaaagtgaagatgctgtgatggtgtcatttttttg

SEQ ID NO: 103470 - DNA, 297 bp, Triticum aestivum
  unsure (1)..(297): unsure at all n locations
  Clone ID: PAT_TA_103470
acgagaaccttctaaagcagagaggcgtgctattcaggaggctcancttgctgcgaaagctgctgcgaaggaggcaggtttatcaggaaagtcaacaggcgctgcttctggggctaatcctgcaacatccaagcnagccaagccagctaaaatttctcagaagaaagatgtgccccatgctccaagtacagttgcttctgagaagaaggttactgaacgccaaccagagagagatagaaaaaaagatgttcctcatccgagaatgcagtttgatgatgtgcatcgggtggagaaagc

SEQ ID NO: 103471 - DNA, 308 bp, Triticum aestivum
  Clone ID: PAT_TA_103471
gcacgagccacgctcccgctccttctcctcctccccgccgccttcgcggccggagccggagccgccgccgtcccgcatctgccgaccctcaacgcgccggcccaagtcgttggcggtgagaacccaccgtgggcggtcgcgcggttctcggatcggttatgtagaggagggcggttggtgcggaggcggcgacgatggcgttggcgtgggcgtggcgtgtagcggcggggcgaggagaaaaaatcaaaccgcaattttctactgcctcacgcggcctgcagttctgtcctgctatttatttcctactg

SEQ ID NO: 103472 - DNA, 167 bp, Triticum aestivum
  unsure (1)..(167): unsure at all n locations
  Clone ID: PAT_TA_103472
gcacgagcggntccgagcgcgccgtgccgctgccggccgtggaggggagcctgttncacgaccgccccaccgtgaggggcggccggctgtacttcgtctccgcgcacgagaagccggatgggtggttcaggagctgggcggcggtgtacacgacggaccttggcagc

SEQ ID NO: 103473 - DNA, 399 bp, Triticum aestivum
  Clone ID: PAT_TA_103473
aggtctgagaccgtgatctttgcaaaatgggaacagcacaccaggggcgtcgcctccaaaatgatggcaaaaatgggttaccgggagggcatggggctaggcgtgtccggccaaggcatgctcgatccaatcccagtcaaggtactaccggccaagcaatcactcgaccacgcggtcgctgcaaccacaggcgaggacggccgaagcatccaccgcaacaaagacaagaagcgtagccggggcgggcaaaggaagcgcgacaggaagtttgcagagctggccagggccgccaaggccgaggaggcggagaggtccgtcttcagcttcatgaacagccagctggtgagccaggacgcgacggaaggctcctcggccgccaaagccaggaaagagtcgccg

SEQ ID NO: 103474 - DNA, 240 bp, Triticum aestivum
  Clone ID: PAT_TA_103474
gcacgagcccgctcgtccaccgcctccgcctgctgaggagcgccgtcgtctgctcttcctccgcgctgctgccgtgcagccgcccgcgcctcgccatccccttcgcgcagccgccgctccgcggccccgccttcgccgccgcctcgtcgccgttgctccgctcggtcggcgccagattctcgctgttcagcagcatggccgccgccgcctcctctgcctcctccatccacgacttcaccg

SEQ ID NO: 103475 - DNA, 126 bp, Triticum aestivum
  unsure (1)..(126): unsure at all n locations
  Clone ID: PAT_TA_103475
gagtaccctctcctcctccattgctggaggacatgcttccgaagaanncggcgannattggcgctaaangccaaaancatctcaatcttgtggtgganaacaatgncccactcttcttcaacatcc

SEQ ID NO: 103476 - DNA, 100 bp, Triticum aestivum
  unsure (1)..(100): unsure at all n locations
  Clone ID: PAT_TA_103476
gcacgagtagtgacagtcttggagagaaatttactactgtcgatgcacacactcattcggggtagaatctgatctcaagtgctgaanggtttctcgattt

SEQ ID NO: 103477 - DNA, 318 bp, Triticum aestivum
  Clone ID: PAT_TA_103477
ggcacgaggttgacgtcatcaaggaaagtctacttgaagggtataccaatagtttctggacatgtagtgtgtcaaagcttggctattcagggactgccataatttcacgggtgaaaccactttctatcaagtatgggcttggtgtaccagaccatgatacagaagggaggattgtgacggtggaatttgatgatttttacttgctaaccgcttatgtgccaaattccggtgatggtctcaaaagattgacttacagagtcacagagtgggatccatgccttggtaactacatgaaagaattggaaaaatcgaaacctg

SEQ ID NO: 103478 - DNA, 311 bp, Triticum aestivum
  Clone ID: PAT_TA_103478
ggcacgagcattatagctggacctctcatagctgaaactcctgtccaggcaattcttggaagctttcacaacagtgcattcttgccaaacaacgcacctagggcagacattgcgtgttatcctaacacgcaaggtgccatcgcaaatggcagcactctacccagtgagcgttccaatccagtatatgcttctcgtacttccatggaacaaaatgaatcaagtgaggttgatgtcaagccctttgttggactggttaatctaaatccagaatatgcatctcgtactcccgtggtacagcgtgaatcatatca

SEQ ID NO: 103479 - DNA, 188 bp, Triticum aestivum
  unsure (1)..(188): unsure at all n locations
  Clone ID: PAT_TA_103479
ggcacgagcaattccccacccatctccgtgctccgtcgctgccctccgccctccagaaccacggcttcgatctggccgtggccaagctcggcgtcggnggtacacagccaagggcaagccatagctcgtcgtccagggcacttccgcggcacaaggacgacgccgacgccgacgcacaagaccaagac

SEQ ID NO: 103480 - DNA, 257 bp, Triticum aestivum
  Clone ID: PAT_TA_103480
ggcacgaggttcgccgcgcggccccctctgctgtcatcggaggttgctgcggtgaagccagagccggctcgcgtctctacaccggagcctagggcgactcctccgcgagctcgtgcactgacaccggagccagagcttggggtgcgggctgttagaattaatgggctagtcccatagcaatttctgaaatctcaaagcccatgtgtaaaaatggcaagtggtggtgctaagtttagtcctaccttggaagttgaaga

SEQ ID NO: 103481 - DNA, 228 bp, Triticum aestivum
  unsure (1)..(228): unsure at all n locations
  Clone ID: PAT_TA_103481
acgagtgacaacgtcggcttcaacgtcaagaacgtggccgtcaaggatctcaagcgtgggtatgtcgcttccaactccaaggacgaccctgccaaggaggctgccaacttcaccgcccaggtcatcatcatgaaccaccctggccagatcagcaatggctacgccccggngctggactgccacacgtcccacatcgccgtcaagttcgctgagatccagaccaagatt

SEQ ID NO: 103482 - DNA, 250 bp, Triticum aestivum
  Clone ID: PAT_TA_103482
ggcacgagggaagttcccccaaatggcagacccggcgctggagggccggtacccggcaaggggactgtaccaggccctggccgtcgccgcaatgtgcgtgcaagaacagccaaccctgaggccgttgatcggcgacgtcgtcacagccctgagctaccttgcctcccagccctacgatccggaggtgcacggcgtccaccgcccgtcgcgcctgacggcttccggcacgccgccccgagcccggaaccac

SEQ ID NO: 103483 - DNA, 380 bp, Triticum aestivum
  Clone ID: PAT_TA_103483
gaattcggcacgagaatccgtatgctttattgtgcaatcttgaggaaatccccaaaaatcatgtgtgcactcaaggtagttaagtgcctttgtaaaattttgacagtccatctcagactaagcaaacagtacatgttagtcttggtttgtggttagacatgcaaacagtacatgggtgtactgtcgctcttgcttattaaggcctgcatcgatagttaatcttgaactggatgtgttattctatgttaggtgaatgaagcctcggggccagcagccacctgcgctacagaatacaagtgtttgcagtttgctcaccagaatgttgaatgagactacatcattattactcaaaaaattcatttggatttggtcaaaaatgg

SEQ ID NO: 103484 - DNA, 296 bp, Triticum aestivum
  unsure (1)..(296): unsure at all n locations
  Clone ID: PAT_TA_103484
gaattcggcacgagaacaacgggagcaccgcaacggatctctgcaaacagccgcacgatgcccataagcaaggcatctacaacatttaccgtggagccaagcagggatgggacgaggacgacgaggaaccattatcgaggaggaagatttctgtgcgtgagaaggtcgatgacattctctttgagttagagcttcatagcttgcttaaacgtttggaggcggctagccctggatctggcaaggcgattgtggaggaagctcttaggagcnaaggaaagaanagtgacgccacagaa

SEQ ID NO: 103485 - DNA, 256 bp, Triticum aestivum
  unsure (1)..(256): unsure at all n locations
  Clone ID: PAT_TA_103485
gaattcggcacgagcggttacggcgaacggcgagctcccctccgaccaccgcggcgtgactgacttcgcatggcgcgggcgctctcctcccgggcggcggcgaccctgtcccggcggctgggggcccggcccgcggcgctcatgggccgncgcgccaaccacacgcggcgcccccgcgcgatggtgctggagctggacgcggcgggggcgtcnncggcggccgcggagggctccgcgggcgcgctcaagcggcgcc

SEQ ID NO: 103486 - DNA, 354 bp, Triticum aestivum
  unsure (1)..(354): unsure at all n locations
  Clone ID: PAT_TA_103486
gaattcggcacgagagagaactagtttcgagtttttttttttttttttttttaacacacgaagcatgtatcactacatgtagatttcacaacatgtttttacagatacgtgaactgtacatgatgtacatacacgtgaacacacgcacgtacacacacgactaggactagtatagactcgactattccttggtcttgagcttggcgcctgctcggacgcacgacttgaccaaactcttgagccccttcttccctttcttcccgctcccgggactccccggttcaagcncagccccgccgctgccgttcaatcatcatcctcattcgtccctncttngncgacttccggccgtct

SEQ ID NO: 103487 - DNA, 321 bp, Triticum aestivum
  unsure (1)..(321): unsure at all n locations
  Clone ID: PAT_TA_103487
gaattcggcacgaggaagaaactacatgaccttcatatgtttgatctgaagtccttaacatggcttcctttgaactataaatggtatggtcaagaatgagaacacatggtcatcatccatcacctcgggcaggttgctgtggagctctctgtgggacgaaatggtatatagcagggggtggaagcaagaaaaggcgtcatcctgaaacttgggtctttgatgtcctagaatccaagtggtctgtttgtgtagtacctcctaattcctccatcactaccaagaaagggttcagcatggntcctttggactacanggataaga

SEQ ID NO: 103488 - DNA, 386 bp, Triticum aestivum
  unsure (1)..(386): unsure at all n locations
  Clone ID: PAT_TA_103488
gaattcggcacgagggacgatggaagaataactgattcccagggcagaacagtgagcttcactaactgtgtgatcatcatgacctcgaacattggttcaccattgatcctagacaccctcagaaacacaacagacagcaaggacgcggtgtatgaggtaatgaaaaagcaggtgactgagattgctcggcagacattccgaccagagttcctgaacaggatagatgaatacattgtgttccaaccactggactcaacagagataaatcgcattgtggagatacagctgaacccgggtcaaaaacaggctgctgcaacagaaagattcaccttcagtacacaccggaaggcttgtggaacatnttggcgctnttggctttgacccca

SEQ ID NO: 103489 - DNA, 721 bp, Triticum aestivum
  unsure (1)..(721): unsure at all n locations
  Clone ID: PAT_TA_103489
tgccnntgttattctccgcctccttgngtganaangacgccagtttttccctgctaccaaggtcctatcacctacgcgccgataacccaaaacttggtggggcatgccttttaagccgattcccaacactgtgcgggggacccgctgtacacagggagccttgcttggggtgcccacacggattaactttgtgcaaccccagcggttagcggttgtacacgttagatattactggccccaatttggtccccagtacagtagagatttgtgcgtaaccccacccaactacacagccaacaggtgggtaggagagaaactgactaataccgtgacgctgttgcacggctgacagcattattgcaacatccggtggcgcaagcggtccggccgtgagtggtgacacacacaaccggcccatgtgattttaaatgcccaacatcggggcgtctgcccacaatactacacctggcccagcctgtctggcggtggttattagttaaaaggtcctagttgtcatcacgtataaatcttatcagcggcagcggcaacactagtgcgatacctgactaataaatagccctagaatgcgcagtatggtcgtataaacttgctgtggagatttggttatgtgcgccacggaaactgtagtcatcctcacccaaatgcccactgcgctcacattataggcaggcatctttttatgacacggggagtacatgta

SEQ ID NO: 103490 - DNA, 410 bp, Triticum aestivum
  unsure (1)..(410): unsure at all n locations
  Clone ID: PAT_TA_103490
tgccnatgttattctccgcctccttgngtgaaaagacgccnatttttccctgctaccnaaggtcctatcaccnaacaatggtcacnaagcattgtaactactgtgttagcctgggtagcgggctgcgtagcccgggccgcatcaatgagggtcccttgtctttacctcctataaaatctgaagtgctatattagctcttagagcaacgggttgcggaaagggggccgcttgtcaactgatgcctagccgcctctttatttatatggttcaagtaggcacgtccctatctcgtaaagcgattattgtagggcgacccattaaccatagcgagtagccagctgtacgaagtgagggctatccgatggcggtggttacggggaggagaaaccagacggcaacccgtgggcttg

SEQ ID NO: 103491 - DNA, 702 bp, Triticum aestivum
  unsure (1)..(702): unsure at all n locations
  Clone ID: PAT_TA_103491
tttgttattctccgcctccttctgtgacaaangacgccatttttccctgctaccaaggtcctatcactcctccgcctccagtcccaccacctccagtacctccctctctctccgcttttagtcatatctgcaactgcccccgcgctcttaatcgctgtaatccctgcagtaattgctactgccccatcttcttcaatacttcgctgctgtctgaagttacccctgtcttcattgccacctcctccgcgcttgtgctatcctctgtaaccttaatagttgccctagtaattgtaatcgctttagtcattgtacttgttgtcgtaatgatgctcctaacaatcgttttgttcctggttacgctttttctgacaacacaacatttcacacagttagtcgttatgctagctacctagttatgagatcgatcgatcgctagctatctatctagcagtgataagttagttaggcatgacgctgtgagactgacgtcgagatcggagggctggtagaagggagtagtctgtggctgacggctgaaaggctagagggtgtgtgcgcgcgcgccgacgatttcgggcgattatcgatgctggcgtagtcaagccggatccgatgtgagccattagccagttacggtgtattatagagcatgtagctcgcgattctgcctgctgaggagagggttggtaaaaacaccggctg

SEQ ID NO: 103492 - DNA, 360 bp, Triticum aestivum
  unsure (1)..(360): unsure at all n locations
  Clone ID: PAT_TA_103492
ggccctccaccgcggtggcggccgctctanaatttntggaatttnngggctgctttttgngggtattttggtttataacagaaacatttttctntggggaagaactgactcctagtacatgttatgcaaatgtacttagaattttaataactaggagagagagctcttatgaaccccatccatgatggtacaacttatgtcaaagtcactactgctagcatggaaagcttcacactgaagttgaagcatgactgagagatcacagcaacttcctattacacctgttgagaaaacacatggtcctcctaatgtgtcagtttgtcaacaccaccaccacctttcaatcctggaacaattctt

SEQ ID NO: 103493 - DNA, 228 bp, Triticum aestivum
  Clone ID: PAT_TA_103493
gcacgagatttcggcagccataagctatacttgtttccagccatgacaccatactgtgatatatatatatatatatcttcaccctgtagtttgatttcgataattcagtatgtagcttttatccagtttggtaataagccttgctaggtagcaagtgaaactattatctgtgagtcatgccgatttcgcaaaagacattaccaggtaacgtgccacttattagatttg

SEQ ID NO: 103494 - DNA, 138 bp, Triticum aestivum
  Clone ID: PAT_TA_103494
gcacgagggtgattgtgcatgattaggcgtcagtttgatgatgattttagtagttttttgttaccgttttagagtgcttgtgatgtgatttgtgaatcctttgtaaggagaaatgtacagcaaagattttattttttc

SEQ ID NO: 103495 - DNA, 273 bp, Triticum aestivum
  unsure (1)..(273): unsure at all n locations
  Clone ID: PAT_TA_103495
ggcacgaggcacaataatacaatgctggttagggtttaatatcttactgcagaaaactatgccacttcttatggacttacgatacatgtttttttctatactcctatgcaatcttgttgtgctagtagcttagtaacagtaatttacctgagcctttaaagttgggaatcatgcatcttgntgtaagtttgaatattttatataggaataaagtccactttccaacctaaactcaagcagaggttcatttttcaaccctgaactctaaaaccg

SEQ ID NO: 103496 - DNA, 506 bp, Triticum aestivum
  Clone ID: PAT_TA_103496
ctgcaggcgcaagtaacacacgccctttgcgtaccgatacaggacgcgtgcagccatggagcagcaggcgaaggcaagcgaggtcgacggcacggctgcccaccgtggcgcgccacgcgagttcctgggtgcagacacggcggagaagcaacgaggcggaggcgacgacgtcgttagcgtgggggcggcgcagcgaagctggagaaggaggaagaagagaaggagaagacggcggcggaggggtgaagccgctgccgcacaagcaggttccgcagcccagcgatgtgtacaacccggagctcgagcgcctctaagctgaagctaatttatataccgagtattgtgtagtagcttgcatctcgcctcttggttaatcgtaagctaatatacttcgagaattttgtctctgttttgctaattgtttaccgtttgagatgtgaggcctgagtgtgaacgataatttacaaatttcaccaaataaatgatgtagtactccttgtcagagc

SEQ ID NO: 103497 - DNA, 442 bp, Triticum aestivum
  unsure (1)..(442): unsure at all n locations
  Clone ID: PAT_TA_103497
ggcacgaggttatgcacggnctgccgcctggccctgtggcggcaggtggcatcgcggcgatgacgtggcgccggtggatctcttgtgccgggaagcggaggagggagccgcggtgcgaggcgccgccgccgtgacagcttccccacctcctcgcaccgccgcctcgccccgtagttccctgccgcgtggcgcccggttcttcgccgccgcgtaccgtagtgcgccgtcaccgggatccttctccccttcaacgccgccgccggggtcttagctcctcttcccggccgccggctccccgccatagcacgattagacctgcttattcctttgaaagatgtgagaaatatatttggattggggaagcgcgaagcagaagcaattatttagtcatatagaaaggggcttgcaaaatcctttaatattgatttcgctgcagctccta

SEQ ID NO: 103498 - DNA, 388 bp, Triticum aestivum
  unsure (1)..(388): unsure at all n locations
  Clone ID: PAT_TA_103498
gccnatgttattctccgccnccttctgtgnaaangagccngtttttccctgctaccaagncctatcaccgtaatttacctctattctattctagtctatctttcatctctacttcaaatttgatgttcttttcttttgtttgtttttctctatgttcttcgctgcctcctccacctgagcataccgaaactctgcggcgtgtgggctcgtactacacctggcagcgtaccggccagaaatagctgctgtcgtttcccttgtttttcagctgaacaggagcgcgaaatgcgctgcgtggccaataagagcgggctccaagggctaagcggcgagggcgaatggaagcattggtacatagggggcggtgagggccaagtagtgggcaatg

SEQ ID NO: 103499 - DNA, 419 bp, Triticum aestivum
  Clone ID: PAT_TA_103499
tcagtcccaagcctcgttattaacctgtgtggtcgctgtcttcggtgttgtctcgtccttcgttgttgtcttcttctccttgttcactaaatgtagcataaccgaccccaaccgccttattaatccgcttcctcgttaccatcctgccccgcctcctccttctcctccacccgatttcccttctccccctcctcctgatccctttgctccttccgcccctgctgcttcttcgcccgattatcctcatgctagttcagctgctacccttcttaatcatcgtttccaccttagccattctatgcaccgctataatgactgactgcctaatgcctgagcctggcctgactaactacccatttagcagtaagtgccaactgactggtggttaaccgatgcacgaaaagaaagtgttccgggac

SEQ ID NO: 103500 - DNA, 503 bp, Triticum aestivum
  unsure (1)..(503): unsure at all n locations
  Clone ID: PAT_TA_103500
aaaactgccgatgttattctccgccnccttctgtgacnaangacgccngtttttccctgctaccnaaggtcctatcacctggaaccgacccgcggtaaacgggttacccgcggtgccngcccaaagatcagcattgggtacatacctaggtgatagccggccaccaagacaccaccgtaggcttaacctacacaacagcttaaccacaatctggcagaacaaatggttgtgggataactaattgctaaggggaattggggtcgccgtaattgcggcgctgggggatgcgtgcggacttacccagagcgagggacacctacccagctttcctttgctgcagccagcggtttttttgttatgggggtttcaagaaccagggctacgcattgagggagtgcctggatgctttggtaacccaacacacgcggtgtgggggcgcatatagcactccttatattcgcgctggcggtgtccgcaaaaaacaaatgcaaagagggcgtgtg

SEQ ID NO: 103501 - DNA, 444 bp, Triticum aestivum
  unsure (1)..(444): unsure at all n locations
  Clone ID: PAT_TA_103501
gcacgagtttccctctcttattcaaacctgcaccgcttctcacgcctcacgcctccttcctcttccactgcacttcacacacacgcctcagtcttcttgagtagttgcccacctgagttgccttctctggggggccggggctgcgggttccggtgatgggcaaggcggcgaggtggctgcgcggcctgctgggcggcggcgggaagaaggagcaggggaaggagcatangcggccggccacgtncacggcgccgcacggggacaggaagcgctggagcttctgcaagtccaccagggactcagccgaggcggaggcggcggccgcggccgccgcgctcagcggcaacgcggcgatcgcgcgggcggccgaggcggcgtggctcaagtccttgtacaacgagaccgagcgggagcagagcaagcacgccatcgccgtcgccgcgg

SEQ ID NO: 103502 - DNA, 284 bp, Triticum aestivum
  unsure (1)..(284): unsure at all n locations
  Clone ID: PAT_TA_103502
aacctcagtcattcctactctcgctgttgtctctattgttgttttgttctattacttacctttactgagttctcgtcctcgctctccttccccatactcttcttgattactccactgttgctggtccccatcatcgtcgtagtcgtctgcttgattccatcttcagagctaaccttaactcaccccctggtaaccnatattgatttccacccattggtggattttacggtgtaacctgcggtgccataaaatgccaagtaatttactgtaaagtcctcagcggc

SEQ ID NO: 103503 - DNA, 138 bp, Triticum aestivum
  unsure (1)..(138): unsure at all n locations
  Clone ID: PAT_TA_103503
tatcgactccgcggacatcagctacaataggctnacatgacctgnnctcacgttcgggcatcattccacaagatccaacactttgtcaggnggcaggaaacatacacactagaanccnctagggcaattctcagacca

SEQ ID NO: 103504 - DNA, 345 bp, Triticum aestivum
  Clone ID: PAT_TA_103504
ggcacgaggaaactttccgacgctttagttgaagacaagttgtttcaggacgaggttgcttgtctcataagggccaagcacagaaatatagttcggttacttggctattgtgcagacacacaaggaaaaattacagaatacaaaggggagctcataatggcgaaagtacgagcaaggctgctatgctttgagtatgtatctggaggtagcctggacatgcaccttgaagatgaattttgcgggcttgaatggcatcaacgctacataataattaagggaatttgtcatggcttgcgccatcttcacgaggaacagaaaattatccatatggatctcaagcctcag

SEQ ID NO: 103505 - DNA, 336 bp, Triticum aestivum
  Clone ID: PAT_TA_103505
ggcacgagcgcacacgcaaccattctccaccccgactcacacacacgaaccctaaccctattgcgtgggcgacggcggctggagacgcgggggacggaggcgggcgacgcggcggggcccaaggcgggcgccgcggctgctggctcgcgacgctgcgactggaggaggcgcgcgacgcagctgggcccaaggcgggcaccgtgtctgctggctcgcctgctgcggccggaggaggagcgcgacgcggctggaagtgcgcagctgggcggtgggccgctgcgactgctgagattaagggcccatatgtgcacagaaatagttcatatttgaacagta

SEQ ID NO: 103506 - DNA, 546 bp, Triticum aestivum
  Clone ID: PAT_TA_103506
ggcacgaggagttctggtggcttcttctcattccacgaacggggttgctcactggaacacacaagccgtggtgggctgcagttcggcgggcacgtgcaagtagttcgtctttttgcccggggcgtcaccctttgcatcggcgaccaccagagctggcctgaggcgtggtcctgctcgtggtcccttgctacatcttggctgaagagagatggagctctgcacaacgtgtgaagttcgaccggtgagcctatgcagtccgacaacacgtattcggcagatggtgagcctcctccgcctgcttcagccacgagagcagccactgctacccttgcaccgacggatcagtctggaaacaactcacggacggggtctcctgtatgcaggcatgcagctgccgcggtgaagcccctacctatggagttcagttttgcctaccgctgcattctgtgttttttaattgaacatctgtgatagacgtacatgtgtgcttgctgctgatgtgtgtgtcgtgcaatagcattttacctagcacccaaaaaaaaaaaa

SEQ ID NO: 103507 - DNA, 557 bp, Triticum aestivum
  Clone ID: PAT_TA_103507
ggcacgagaaaaaaggaagacttgacttgatgcctcgatatgctaccctgttaagcccaacattgaccagatgccatcgaccgtggcttctccacatatccggattgtgctcatccgccccgccgttccccatcccttgtatcgctggcgttagtgtggcccgattgccggcgttcggctaggcaagtgccattgttcatgcggttggtgtcattattcactacaggaatcgataccctggcatattattttgcttagttgcacattgtgtttgcgtatttgtcttatccctctcacgttgatgtttcataccatggtagttgtttattgttgtaatattacgacattgataggataagaaaaagtgtctgcttgttaagaaagttcagagacaaattacgcattgttgggcccaaattatgtcatggtttatatgcatgccatcaattcttcatgtagctcactacctgattcagtcttgagaataacaattgtagatagtctcattgaaaatgacttctgtatgtcttgcatatagagtcgtacattgaaaatgt

SEQ ID NO: 103508 - DNA, 362 bp, Triticum aestivum
  unsure (1)..(362): unsure at all n locations
  Clone ID: PAT_TA_103508
tgcagggaattcggcacgagccacgatctcctttgccgccgccaccacccctccagctcccagcaactaagtttcacttccaacccctcaaccaaccatcctctcgatccgtaagctctcccgccgggccggccgatgggccggtgggatcttgaccccgagggcaagcccgggccaagggccgtaccgggcgngccgaagggggccgggtgcctaacctaccgaagtgggaagccccgggcccgaagccttgccccatgcttccgggccgtccgccttccaatccgggcgcccgcccaaaagcttccggccgcctccgcccgccgggccgggcaattggtccgcttccccaagctaacctt

SEQ ID NO: 103509 - DNA, 374 bp, Triticum aestivum
  Clone ID: PAT_TA_103509
gaattcggcacgaggcaccatgtaaatattactgtccattctaagtaaaagaaaagaagaagagatgtatactatgtattaaaatcttgcctgatgtttcagaggatggcgaaagaggtgcagggagccgacggcctgtccgcagtgaggaagtgatggaggaacagccacccacttgagggtgggtacacggtagcaagggcgccaactgggaaggcgacgctgctgccgggcggcgaggtcgtcgtccaccaaggcgatgatgcttccgtgcggcgaggggatcctcctcagtgaggaggtgatgaggaacaaccacgcacttgatgggtgggtacagggcggcgagggcgccgaccaggaaagggacttgg

SEQ ID NO: 103510 - DNA, 361 bp, Triticum aestivum
  Clone ID: PAT_TA_103510
gaattcggcacgagcacacgccccccgcgctccccctggatcaggtccttccctcgcctccggtgcagtccaaccgcgatctccgtgcggttcaacttcggccccggcgcctcacgctctctgctggtaaagctgagcgagagtgctcgatttcctctgcctccctgctggcaaccaacagtagccatgcgaccctccctctccagtaccattactcctccgtcaaggtcatgtccctgcctccagcagatgggccgagcaccaggccacccatgtcaaccatcttcttcctcacatcttgccaataaaggtttaaattaggtcagattttgaaatgctattggggaaagtctggtggtta

SEQ ID NO: 103511 - DNA, 278 bp, Triticum aestivum
  Clone ID: PAT_TA_103511
gaattcggcacgagggcaagagaagctcgccctctcagtgctgccgagcctgaccaaatggaatgtatattactgaggatcccctctctagggttgtgcttcaagtgcggcgagcggtgggggcgtgaacacacgtcctctgccaccgtccatctccatgtcatggaggagttgatgcagctcttcggcatcgacgcggcgatgtccatctcccgtcaagctctcaccggcggtgtctcttcgccgcgtgcatttcacctgcaggcctggttgcaagg

SEQ ID NO: 103512 - DNA, 382 bp, Triticum aestivum
  Clone ID: PAT_TA_103512
gaattcggcacgagcctcctccttgacccgccgccgcttctcccaccccgaaagaaaaacacacacacagtagagagcttcagcttcccctgagagcgagagatggcggcgaagggcgacgggccggcgatcggcatcgacctcggcacgacctactcgtgcgtcggcgtgtggcagcacgaccgggtcgagatcatcgccaatgaccagggcaaccgcaccacgccgtcgtacgtcgccttcaccgactcggagcgcctcatcggtgacgccgccaagaaccaggtggcgatgaaccccatcaacaccgtcttcgatgccaagcgtcttcattggccgtaagattcaccgattctactgtccagaagtgatatttaagctg

SEQ ID NO: 103513 - DNA, 321 bp, Triticum aestivum
  Clone ID: PAT_TA_103513
gaattcggcacgagccaaaaccactttccctttcccttgtccctgcccaccccacgccgcgttgccgtctccgccgcaccgccgccgtcccgctccttctcctccgccggaacccaccggagcacgcctcgaagaggagcaaatctttgtgcgcctctctgccggatctgtatcggctcccgcgactcctccctctgtcggtaaggaaaccccctagctttggtacaacctttcgcgatgaagaaccgaaccgaatccaatccaatccaggcggatctctttcgtcgagaccgtctgctctcacttcccgtccgcagtgta

SEQ ID NO: 103514 - DNA, 362 bp, Triticum aestivum
  unsure (1)..(362): unsure at all n locations
  Clone ID: PAT_TA_103514
gaattcggcacgagcgccgccccctcccatcgatgctctcctctgccaccgcatccgcatccgcttgcgcgctcgtgcccctctccatcccccaagctccccactcccatccgcgcgcctccaccttcggaccagctgccgcggcagatcggcatcaagagagcaactgagccgctcttctcgcggcccagatccggcacagcattaccaagatcatcatagcacaggaggcgaggagagcgggcatggaggagaaagcgccggagacggtggcggccccggcggcggtacttgcggtggatcaagaagtggcgtactgcagcgaagcatccctacccgncgggcgccgcggcgggccgcaa

SEQ ID NO: 103515 - DNA, 380 bp, Triticum aestivum
  unsure (1)..(380): unsure at all n locations
  Clone ID: PAT_TA_103515
gaattcggcacgagacttgctaagattggtcctcaaggaaggcacggttgttcccagggcatgcaaggagctgttctggaagatgtgcaagatacttcacctgttctacttccggaccgacggtttcagctcgccaaaggaaatggccagcgcggtgaatgctgttatcaacgagccactcaagctcccaagttaacaatccatggttgattgtctcatcataaaaataaagatattcatgtgttcatatggagcagaggaagcagcaagtgaacctttgatcctgtaacttangggaagtgaattgcaaaaagtatcgacattgaagactagggttgcaggaaccacagttctacaattttgtgcccgaaaaacacatt

SEQ ID NO: 103516 - DNA, 328 bp, Triticum aestivum
  Clone ID: PAT_TA_103516
gcacgagactgtaggtgttcatatccatcgccatgatcctcggggacggcctgtacaacttcgtcaaggtgctcgtccgcacgagcgtcgccttcgcggccatggtgaagaagaacagcaccatcccggtctcggacgtgggcggcgccaaggccaccggcgagcccgtatcgttcgacgagcagcgccgcaccgaacaattcatgaaggaccagatccccaagtcggtcgcctacgcggggtacgccgccgtcgccgcggtgtcgatcgccaccctgccccagatcttcccggacctcaagtggtactacatcctggtggcgtacgt

SEQ ID NO: 103517 - DNA, 340 bp, Triticum aestivum
  Clone ID: PAT_TA_103517
gcacgaggcctctactaaaccgagtagtcggcaaggaggggcagcaggggagggagatctgactgacgaggccagggagggatgatggagagccagccgctgcaggccccgacggccgagccccacggcgccggagccgcggacgaccagcccggagccggagctccccccgccgtcgtaagctctcttctttcccctcttgctttgcctgatcggcgtgtgggatgggatagaagaattgagcttgctcgctcgccggccgtgtccggacggctggatcctggcggttggcggtggccggatctcgccgtgccggcgggagatctggcggtccgccccg

SEQ ID NO: 103518 - DNA, 325 bp, Triticum aestivum
  Clone ID: PAT_TA_103518
gcacgaggagatggcggcgatccactcggccggggagcggcatgacatcgagtggagcgacaccgtgaacctggccacgtcggcgtggtggagcaggctactcgagagtgtggaaggcggtgaagacgatgatggggccgcggcggcgcagcagactaacacggtggacgccatggggatgcatctgagtgatgagtgctacggccaagacgtgtcctttccatgtatggacatcggagagatcgaaggatgggacgccgagtggttctcatgacatgccgtccatcatattttaggggagaattaacagttcatcatttcactg

SEQ ID NO: 103519 - DNA, 184 bp, Triticum aestivum
  Clone ID: PAT_TA_103519
gcacgagggagagggaagacatggatgtgcgcgaggggacgcggaggatgaggggtgcttccatccctgctccgctcgagggggatggcgagagcctgctgctgatgtatctgcctcagccggcgccggcgtcggcgtcggcggcgatgatgcccacgcccggccggcctcgttggaaggactt

SEQ ID NO: 103520 - DNA, 363 bp, Triticum aestivum
  Clone ID: PAT_TA_103520
gcacgagccccgtcgtgccgcttcctgtcgccctccacggccgcccgccgccggttcctccaccacctcctcgccgcgcccccgaggccgccgcagcttcgtcgctgctccccgtaccactggatggcggtacgtagcagcacacgtgacgccctacccttctccttccccttttttgtttgttgtactgccatcctgcataactgtttgacgattgccgcggcaaattggatgattaattaacctgcaccctcgagtttaagccgattcaggatatcttagttgcgcgtttggactcgagagagatttggaaatcgggagggctagccctaggctctagctgatcggtggattttagtcttg

SEQ ID NO: 103521 - DNA, 467 bp, Triticum aestivum
  Clone ID: PAT_TA_103521
gcacgagccagggcatccatccccacgctcgaagaaaacagaggcgaggcagagctctttcctggcggcggccgacggcaagacgactcgccccaaatccccaaatcaaatcgtccctggcggcggccgacggccacggcgggtccttgcggagggggtggcagaaggcggagggcccgttccttccggcggagggggcggcggaaggcggagggcgcgttccttgcggcagcggcggccgtgtcccttgcggcgatggtggcagcgcggctgcgtgggggaggggacgcaggagcggccgcgatagcagacaggcgcccgccgcgtggtcaacgtacctaggctgctgcaacaggcgcctagggttccttcttccccaaccagctttgaaggagacgcccaagctcgcgagatctcgctctcataggcttcaacccgtaagaatgatctcccctttgtccttgcct

SEQ ID NO: 103522 - DNA, 701 bp, Triticum aestivum
  Clone ID: PAT_TA_103522
gcacgagcggtggcgtcctcacctccgacggcgcccgcgtcgccgccgtcgacggcgccaccggcgagatcctcgtcaccgacctcctctccggcgcgcaggcccgcctccccaggcccccgctggagtacagccgcgtcatcctcagcggcggctacgtcttcgccccggcgaggggccgcaccgagatccagtactgcagcctctggtacgcccactgggccgtagcgtcctacggcggcgactttgagatccaggactggcgcatcgtcaacggcgccctctacgggctcctcccctcctgcgggctcgtcatggcttcgctccccaaggacaacacactggagctgtggatgcttgggggcgaattcgacgaggaccttgaagagactctgaaggagaccgtgggcggatcattgctgggggagtgcggtggcgagcccctgcttatctgcaaggtggggcgcatcgatccggaatacaagattttccggtgggacttcaatgtggggaagtgggtgatgacgacgagcctcggcgggcggacgctgtttattggctacgacgatttcgtcgcgtgccttggtccagatgttccagggatccgtgccgactgtgtgtatggatcattgccatggagtgggggatggagccaatattctctggtcgatgggcctgtaaaatgcttccctgcacagtat

SEQ ID NO: 103523 - DNA, 314 bp, Triticum aestivum
  Clone ID: PAT_TA_103523
gcacgagccgacctcgcgtcttctcctgtgcatctcggaggtgcttcttggtttccacgatgaagctgatcgctgcctacctcctcgcctatcttggtgggaactcttccccaagtgccgctgatgtcaagaacatcctggactcagttggtgctgaggctgatgaagaaaagcttgagttccttcttgctgaactgaaaggcaaggacatcacagaagtgattgcatctggaagggagaagtttgccgctgtgccttcaggtgggggtgccattgctgtgggagctccagctgctgcatctggtggtggcgca

SEQ ID NO: 103524 - DNA, 553 bp, Triticum aestivum
  Clone ID: PAT_TA_103524
gcacgagcggaggagcacagccggagttgctgcctgcctgctgtttgtcgagcgaccgacaggtttcgtttgcaatttaataggccaagatgatgaatgttgaagcaatgggcattattggaaacaagttgcctcctgatgtcaagatttgccagagtgtatcttccattgaaaccactgttgcaaaaccgggacttgccagagcatgtctttcgctgaaactagtagcttcaaagtccccttctaccactaaattaggagaaatggggcgcgcccggattcgaactatactctccctgattcacaggaggtgcaactagtcaatgtgctaggcacgtgcttgtgacaaatgagaagggaggtgtttcttaactcaaagcaagtcgggtttttcactagttattctttttttttcaattttttttgctttttctccgtttttctcccttttctccattttttgtgtttcttatgtttgtttttgttttcattcttcatttttcgtatatgcccaaaacatttttgtaataagtgattaactttttttgcatac

SEQ ID NO: 103525 - DNA, 324 bp, Triticum aestivum
  Clone ID: PAT_TA_103525
gcacgagctcagctgatgctaccttatgcaagccatctatttcaggtcacggaagctgtctacaaagacccaagcagggatgagagtgtgacaaaggctgcggttgcggccctgggtgatctcgcagacatgcttggtctgatactctgatctcgaaagatttgttcaagatccaccccttccatattgagctcttgagcgagtgccttaattccgacaacgaagtcagggaaatcgcattgtcccaggggttgataactgctaaccggagcagagctttcttaacacgagagatattttcctttctctgctgtaacgaaggtt

SEQ ID NO: 103526 - DNA, 283 bp, Triticum aestivum
  unsure (1)..(283): unsure at all n locations
  Clone ID: PAT_TA_103526
gcacgagtttctcctggctttgctagcctagcctacacaaagaattgaacctagtaaattctcagttggtatagtgattgtcattggtagatacacagccgattttcttttggtcatgtggaaacaattgagccatgaattggaccatgtactggttcttggaatttttggttctaaatggcctgggcttattaactggtgggttggacataaacccgtttaataggntnaattggggccctaatttcctggtnaaccttgggancagggaataaattccaat

SEQ ID NO: 103527 - DNA, 466 bp, Triticum aestivum
  Clone ID: PAT_TA_103527
gcacgaggatatgcaagagataagacgattcagcataccggtgagtttggtatgacaagatttggtatccccggtatgcaagaactaccattgctaagatgattagttatgtggatgttgtataatgacatgcaaaattagctagctatttatcagccttgcatgtcgcgaaagagcagcagctagcactataggcatgcatccagactcttcaggtagcactatagtagttttttttagcactatagtagctgtcaacagtaagaagcaaagtctgatctgactgagttgtacatagacagcagtatgtcctagactgcagtaaaagcttgcactgagctgtcctaggttatctattaagtattggtagtataggtcggtttgcatagtcctacaaaagggcatgtacccctgtttgtaatagtaagcttgttgctgctgatataaacctacagagcttcatact

SEQ ID NO: 103528 - DNA, 590 bp, Triticum aestivum
  Clone ID: PAT_TA_103528
gcacgagggcgtccgtaaggcgacgcctaggcgtcgaggcgcccccccagcgctttgcaaatatgcccgctttaggcgcctaggcgtcgaggcgcccccccagcgccttaaagcgaagcatcgccttaaaaacacagaacacagtgtgttctgctgggcgcttgatcatgttgccagattcctaaggcgtaactttgcttactcatctttctataggatacttggaagaaccttgtttttgggtggagacaaacaataccacactcagcctcctctaatcaaatgccgaagttgcgtgggggttccttctgataatatcgttgttctcgttggcaccgcaacatcattctgacattcagacattatggcttcatcccacacgtcaagcacttcctctgccaaagtaaccatgcgtgcatcccttgcttcctggagtattactgctgtctacgggcctcaatccgttgcggataagtttgccttcatccaagagatcaaacaactaaaggcctccatgctaccttcttggctgttgctggggcacttcaatctcatatgttaagctaaggacaaaagcagtgctaacagga

SEQ ID NO: 103529 - DNA, 112 bp, Triticum aestivum
  unsure (1)..(112): unsure at all n locations
  Clone ID: PAT_TA_103529
caataagaactgaccgcaagtttgccatnaagaaggctggggcggccagcaactgcgacgggcccttccgccggtgcaagtgcatcatgcangtgctgatcatatgtgctac

SEQ ID NO: 103530 - DNA, 152 bp, Triticum aestivum
  unsure (1)..(152): unsure at all n locations
  Clone ID: PAT_TA_103530
tctcgagatcggagaaccctgtgggacacactaggcgacactagagcgggtcggcgagangacgcctttgcgcacagcacaatgccctatacaggcactgcggcgacagcgctggctctccgtgngtcactgcgaacggctcagcatctaaa

SEQ ID NO: 103531 - DNA, 557 bp, Triticum aestivum
  Clone ID: PAT_TA_103531
gcacgagccttcctgcatcctgcggtcctgccacgccccacctcaccgagcgtctccggccaccccctgccgccgagcgtcgcccccgcgcctctgcctcacctagcgcccgatccagccgtcgttcatcgccagcacacgtggatccggccgcccctcgccttccccatcggctgcacctcctagcgccaccgcccctgccatactccgccgctggaggatctccgccctgcctggatccacatccccgcggcgacaccggcagtcggcgacgatggacgaccacggtgtagtgcccttggtcctcgccgtccccttgcctatatgcaagtaaaagcgaccatggttcaggcatctgttggttattgaaaaatctgacaaccgcaagagaataagagctgcagactcagagtgtatgtgatatccctgccagattgctacagcatattcatgcaggtgttgaggcagggaaaaggcagcagtagaggcatgggcacttcagaaaagggtgttgactgttctgattgaggccagttgaaggcttccacgtgccacct

SEQ ID NO: 103532 - DNA, 309 bp, Triticum aestivum
  Clone ID: PAT_TA_103532
gcacgagcggaccactctctcgcgcctttagaaaccacgagtacgtagatcaatcttgattgatttctctctccgtcccggccggccatgaggagctcagtgcacgtgccagccgcggtagaggcgctgctgggccacccggtggcggcactgtcggagaggccggcgccgcggctaacgcggctgctggtgaacgtgacggtggagcggagcctgtggccggtgcacgtgctgctgggcgccgatgccacggtggccgacctggcgcgcgccgccgtcgacgcctatgccgccgaggggcgcaggccg

SEQ ID NO: 103533 - DNA, 653 bp, Triticum aestivum
  Clone ID: PAT_TA_103533
gcacgaggtttgatttggaaacattgaaatggtcagtcattggtcgtatgcctttccggatcaagacagccctagctggttactgggatgggtggctctatttcacttctgggcagagggataggggacctgataatccaactcctaagaaagttgttggttctgtgtggagaacgaaactgcacgtctaatgtccaatgtttgaacagaggtttctgtatattcttaaccgttctcacgtttggaattggaagctggattttggagatgtgtttcattcaaacaaccgaaagcagcctttggcaacaatcttgccgttcgatagagctggcggatgacgctctggctggatgacagtgaccgaggcattctggcctaaactttgacagcattcgcagggcactggcaagcgcttaacaatgactcatcacatggtgagaccgactgggcttatcgccttcattagtaaaatctggcctcctttgtgccctagacgcccggccggtctggcggtggcgcgcgtctggccgacgacgagccgtcgttgtcgtctctgggcaacttgcatggccaccaaaccacagagatatgtcgacttcattttgcaagtacaggtcaagtatgatcgtggttccatttgaatgggcgaaatt

SEQ ID NO: 103534 - DNA, 620 bp, Triticum aestivum
  unsure (1)..(620): unsure at all n locations
  Clone ID: PAT_TA_103534
ggacgaggcgcnggctacccgctcaccgactggtgcctcgtcccctacacccaccagaacctcacctggacgcagcacgccttcaacgagaaggtcgccgatctccggggggtggccgtcgacgccttctcgcgcctcaagagccgctgggcctgcctgcagaagcgcaccgaggtgaagctccaggacctgcccgtcgtgctcggcgcctgctgcgtgctccacaacatctgcgaggccagaggggaggccatgccgccggagctccgggtggaggtggaggacgacctggccgtgctcgacaaccccgtgcgctccgacgccgccgccaaggccagggacaagatcgcgcacaacctcctccaccgcggcctcgccggcaccgccttcttctaattacctactgcatcctccctcttgatcggttcaacgatcttcagcttaatctgctcattccattcgatgattcgatccaaaccctgtcaaagaatcaaattttcagttgctcagtcataggaggaccctagttaactcgtatcccaggaaagaagaaagaaagttttacaccgtgtacgtgtgaaacaacacatagcagaaaagaagaggattcaattggttgg

SEQ ID NO: 103535 - DNA, 355 bp, Triticum aestivum
  Clone ID: PAT_TA_103535
gaattcggcacgagtagccccgacccgccgccgctgccgccgccggctccctcctcccgccccgcgccgctctccacctcctcccggctcccatccaccgaaagccgccgccgccgcttctccttcacatcgccgccttgcccctgtacgacgccggccgcctccctaatcgcgaacggcggggaggagacgaggcgcggcggaattccgcaccggagtagagcggaccgtctcctcgcagctcccccgcccacgctgccgcttgtgaggtgatagcacccccgccccgtctaccgtgtcaccgcaacctgccgcccatggccggggaagacggcaaggtggatcatccacgccg

SEQ ID NO: 103536 - DNA, 209 bp, Triticum aestivum
  unsure (1)..(209): unsure at all n locations
  Clone ID: PAT_TA_103536
ggcacgagaaaacctgcaatgggtcatgnggataaatcaaggctnngtncacagccttcatcangagtnaagnnanantngncnaggccaaagacccannatggcttggaaagcaacnnnnggtnggangtacccaagcgtaagntttaggaacgntaccagnaagctgaanatgcaaagaagcatcgcacgatacaagtnatggagct

SEQ ID NO: 103537 - DNA, 367 bp, Triticum aestivum
  Clone ID: PAT_TA_103537
cggcccgcccacccatgcaggcttttcggtggacaagatgaagtttggttcaatatatgaggaatacctcagggcagagcaggacaaatatcttgctaaatgctcccatgtagagtacaaacgtctgaagaaggtattgaagcgatgccgacttgatcgctcattgcaagcagatggcaccaacggtgaccagcaggaggacaggagtgacgattcttcagatgcttgcgactgcaattcttgcacatgtatgctcagcctctagtggctacccattatcccatctttcccttttgtacgaagtcctgtccaggatgtaaatctgatgcaggactcagacatttgtagggcagtcttatcttctgat

SEQ ID NO: 103538 - DNA, 520 bp, Triticum aestivum
  Clone ID: PAT_TA_103538
ggcacgagctatatctgtatatatgagtgaggttgtatgtatatactagtatttaaaaatggatagtttaaagttcagcatatcaatgacttcttaggacaaaactaaaatggcatactccctccgatccatactaaatcagcgacaattaatatggatcagaagggtagtatattttacaagggagggatggcaccaataaattatagaacaggccatccgcctctgtcctacagcatgaaggtgctcatcggattagcaaagtagcgccgccttgcagacctcgagcgttcttcataggaccttgctggggaagctgacaattgacaaacacctatatgttcatgttggggtgtttgatgaagatgtgcctagtgctcccatcatgctgcagggtcttttgaagcaaggtcactatgaagaacgctcgagggggggcccggtacccaattcgccctatagtgagtcgtattacaattcactggccgtcgttttacaacgtcgtgactgggaaaaccct

SEQ ID NO: 103539 - DNA, 287 bp, Triticum aestivum
  Clone ID: PAT_TA_103539
ggcacgagcaagtttcaacccaatgaagaacagcatatccaaacgcgtggagaagtctaccatgaaactggtggttgatgctgataccgataaggtactcggtgcagccatgtgtggaccagatgcagctgaaattatgcagggcattgctgttgcgctcaaggctggagctaccaaagcgaccttcgacagcaccgtcgggatccacccttctgcagcagaagagttcgtgacgatgcggaccttgaccaggcgcgtgagcccgccatccaagccaaagacgaact

SEQ ID NO: 103540 - DNA, 306 bp, Triticum aestivum
  Clone ID: PAT_TA_103540
ggcacgaggcaaccacgacctcgccggagtggttttggcccggatctatagccggcgcgtctcgttcggggttagattcggccgcggtctcgtgcggtcccgatccgtgctcgtgcttgtgcagtcacgctcgtgcgtggtcgtcggttgatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttcatgtgcacgctc

SEQ ID NO: 103541 - DNA, 327 bp, Triticum aestivum
  Clone ID: PAT_TA_103541
ggcacgaggttgcctatgtgtaagatcacaagatgcgtacaacccagcaccgaaagcgagagttgaataattaagcatggcgtcgaaaaaaacatgcaactaatagtacaacgatttttgaaaaaaaagcaaaattgcacagagctatcatgcctgaaaatataagagcacctacactcagactaggcaaatctggccccttcaacatccgcggtgtgtccccggtcagcgtcagacggctcctcatttgtcctcccggacaaccacatcctcatatttaaacgctcaaattcatgcaaatccatacacgtccatcatataacacaa

SEQ ID NO: 103542 - DNA, 289 bp, Triticum aestivum
  Clone ID: PAT_TA_103542
ggcacgagatgcagtttgcgactaaccacgtcgggcattttcttttgacacatcttgtgctggacaccatgaagaagacctctcgcgaatcaaacgtggaaggaagaatcgtcattgttgcctcggaggggcacagggttaccgtacaaggaaggcatccgtttcgccaagataaatgatgagcaagggtatggcacccttgcagcatatgggcagtccaagcttgccaacattttacacgccggtgaacttgccaggagatttaaggaagagggtgttaacatcactg

SEQ ID NO: 103543 - DNA, 454 bp, Triticum aestivum
  unsure (1)..(454): unsure at all n locations
  Clone ID: PAT_TA_103543
ggcacgaggttgcagcatgccgactgcgacgctccggcgaccggagcataggttgaagcggnctcctccggcaaggtcttcatgacccgcggctgggttgaggtcgcgagggtttgccgcgctgagggcaccctcgcgatcaactttgattatgacggcgcctccacgctgtccttcaaggtctttgatggggagggccgccgcctggagtgctgccctggtggggagcgccaggacgatgcgcgccccgcccgcggctcctccagaagcagtgactcttgggagtccagtggttctcctgagctctacgagactccggagacgatcgacgacagctacgtgcccccgagctctcgccgtgcccggagcaaggctgcagcatccagccgtcgctgatctggatggggttggcgccggcctcccgtggcccactgttgatgatgacgtcggccgc

SEQ ID NO: 103544 - DNA, 549 bp, Triticum aestivum
  Clone ID: PAT_TA_103544
ggcacgagcattcccagatcccccaagagctcgcactcccccaccccaccccagcctctcgtcccgatggcccgcacgaagcagacggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctccgcttccagagctccgccgtctccgcgctgcaggaggcggccgaggcctacctcgtcgggctctttgaggacaccaacctctgcgccatccacgccaagcgcgtcaccatcatgcccaaggacatccagctcgcccgccgcatccgtggcgagagggcctagagcgcttcgagcttggttggaggtgtagaggtgttagcttctgaatctgtgttgcgtggtggaaatctggcg

SEQ ID NO: 103545 - DNA, 522 bp, Triticum aestivum
  Clone ID: PAT_TA_103545
ggcacgaggccaaaacaatgatatgggaaccatcaagggttcgtcaaaacatgattctgttgtaaaatcagtggccaagcaggatgatggttcttcatcagcacaacaccgtgaaatgcagaatttgatacaaaaggctaaaggagcaaggaagttttctgaaacaccaaggttcagtaattcaaacaaagagggttccttgcttaaacatgacgcagttttggaattagcaaataggaacagtggtattggtccaccaacaatccctgatatgaagaaaaataaggtcaagggggcaagaaagtttactgaacaaccaagatctgggaactcgaatcaggtggatccatcagtttcatcacattttgatggaacaagtagccatatacgggacctcacgacaagccaagctgctaagcaaactgtaactagtcaaaaggaccaaattgcagcgagaaagcgtcaaagggaggacgttgaatctttactttcctcagctcttatatcatcaaagaagcctaa

SEQ ID NO: 103546 - DNA, 410 bp, Triticum aestivum
  unsure (1)..(410): unsure at all n locations
  Clone ID: PAT_TA_103546
gaattcggcacgagcgacgccatcgnggtccatgtcgccgaagccaggcagctgttgctcgtcgacaaccaataagatttgatgcgaaccatagcaaaccggttctcaccgttgacagacagggtggtctgtctccgccgtcatctgtacaaattctttgtaacggaacgttagttttgtatggtgctgttatctgtgattcgattctgtagtttggatggatgggtggatgtaaggtcctgaagtggactgtaacaactgttctgcgcggcctcttgttctgctctctggtggtctggcatcgaagcttcttctagaaggccgttgttaagctatgtaactttagctctgtactttggccgtgcaagacaacaacaatctctgtacttaaaaaaaaaaaaaaaaaaaac

SEQ ID NO: 103547 - DNA, 503 bp, Triticum aestivum
  Clone ID: PAT_TA_103547
gaattcggcacgagatcaaaagagggttgtggcagtgcgcctttaccacatgaacatgtgatcactaaggtgtgccaactaaccggcactcagttatcaattatttcctgccgaatgcccatgctgaaaataatcttctcgtgcagcaaggcggtcctgaaccaagtttacgacttcaagtcgctaaccagaatgatcatgctcaaaatagcaatgcaaccaagccatgtggtcatcaccaagtcactaagcaggtaaaaatagttaagccaactcctccagcacaaccacaaagcattgggcagtgaggagttgaaaagtgagtgcattaaaggagctaggagtggctagttagttgaggatttgaaaagggggtgcactggacgagtcaggagcagttgatgaatctatctttgaatgaacaaatattctggattatgtatagattttagcttcatagagaaaaatagttccagtctatatgatcttttcttatttatttt

SEQ ID NO: 103548 - DNA, 502 bp, Triticum aestivum
  Clone ID: PAT_TA_103548
gaattcggcacgaggctgatttctccaagtgggcagtggcaaactggcaatggcgtgctacgccgctctcctgcaccagccgcccgcctcgccgtccccgtgcacctcaggccgcgccggctcctgccgcgtccggccgcctccgctcctccagcgccgagcccctcccctgtccgcgcgcgctcggatctccccgcgctgctcctacgccgcagccggagggagcgccggagcgggcgccggggagcagcccgcggcggcgctccggagagtgctggagacgccgggcgcccaccaggcgcccgcttgctacgatgcgctcagcgcccgcctagtcgagcgcgccgggttcagggcctgcttcacgagcggcttctcaatatctgctgcaaggcttggattgccagatgttggtctgatctcctatggcgaaatgatagatcaagggcgtttaatcactgaaagcagtgtcgatacctgtaattggtgatgctgataatgg

SEQ ID NO: 103549 - DNA, 345 bp, Triticum aestivum
  Clone ID: PAT_TA_103549
cggcggcggctgctgcggtgaccccaactctaagctgccgcgtccatgtcagccacaccgtcagcaccggcgactcagccaggcctctgcgtgtcaagcacagcatcaacagcccatggacaagctgccattgccaatgcgaaatcaaacagacccatgcatggaaatattgcatttgcccggatgaaaacaacaataattcacttaagtgcatctattgtaataatctgtacaccaatggtattactcggatcaagttccaccttggaaacattgccaattccaatgctctaccttgcacaaaagtgcctgctgatgtaatggatgaaattgttgagtatttga

SEQ ID NO: 103550 - DNA, 506 bp, Triticum aestivum
  Clone ID: PAT_TA_103550
tttacgctacttcacagccagcagcaagagtggatggtataactctagccagcaggcgggagggaacgaagctctttcctgatcttgagctagaatccctgacgttggttgatttagctgtggtgtagcttaggatcttaaagctatgcagctgggttgatccctatcgatggaatggagcttatcaactcatgaatagcatggatcgccttctactataccgggctaaggtgcaacaatggaagcataccatggataatccagagatacatcctacctatgccgagagcacaaagatcaagctaagtaaacaggtctagttaaagcccactggagtaaggaaaatacaataggttgctttttttcccaccatacctggcaatgattggtatcccttgatatgttaacacaaactaaccagttgtcccttcccctagaggggtttcctatatggattcgttcccctgagcatcttccatgaattgacgtatatgagcgtagttatc

SEQ ID NO: 103551 - DNA, 390 bp, Triticum aestivum
  Clone ID: PAT_TA_103551
cagcgacgaactgctgtgggcggcggcgtggctgttccaggcgaccgacgaccggcgctacctggactaccttgctaacaacgccgacgcgatgggcggcacgggctggtccaccgccatgttcagctgggacatcaagtacgccggcgtgcaggtcctcgccgccaagatcctgctgcaaggcagagccggcgcgcacgccgccgtgctgcagcggtaccggcagaaggccgacttcttcgtgtgcgcgtccctcggcaagcagggctacggcaacgtcaagcggacgcccggcggcctcttgtatcacatgcagtggaacaacctccagtacgtgaccagcgggtcgttcctcctggccgcctactccgacagcctcgccgccgcccg

SEQ ID NO: 103552 - DNA, 550 bp, Triticum aestivum
  unsure (1)..(550): unsure at all n locations
  Clone ID: PAT_TA_103552
aaacattatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacagcaaaaacaattggtacaaggtacttcaacccaacctcagcagcagcaacaacaaggtcaacaagaacatggtcagggttctagccagccacaacaccaacaacaacaacancaactggatcagggttggatcgtggcgatagggacatgggtgattcacaccgttccg

SEQ ID NO: 103553 - DNA, 307 bp, Triticum aestivum
  Clone ID: PAT_TA_103553
tctcagcaactacagatatgcccctcctgttaatgtggtcgtcggcagtccatgtgtgatgcgccccggttggatcgcatgctgcgctggctgttaagacacactttcaccgacagccaacaaggttgggaagaagcttggcaccgggccggattaaacattcaccgacagggaagaggggctggctgttgagccacagctatgcagagagaaatctagtactccctggaagggacaaacccgaggtcgccaaaagtactgtaacaaaatccggcgtttcccaggaaacagtggagagtaataatgc

SEQ ID NO: 103554 - DNA, 267 bp, Triticum aestivum
  Clone ID: PAT_TA_103554
catgctcactcattgctaggatcaacaccaacaaaatcatgtacgacgacgatgacaataacaagaagcacaactacctcgtgaattctctccatgcattgtttccttcaaataccatgaaacaggggatattatctttatgttgatctcaccatggacatgcatatgatccatccgagggaggggacccatgttactggtggcagaccacaaaacatttgcaccttttgtgaccctgtcaacgggtactatgagctaccgaaggag

SEQ ID NO: 103555 - DNA, 428 bp, Triticum aestivum
  Clone ID: PAT_TA_103555
aatacagccctcagtggcccgttcatcaaaccaatgaaaaagtcactacagactaggcaattatatagatgatccaatcaaccaaacctcatcttcctctccctgctatggatctaagcaatgtcatgatagtagtctatggtggcggctactccttggcggcgaccttcttcttgggggacttggtggaggtcttcttcttgggcgacttggcctccttctcggcagcggcgggagacttcttggggagcagcacggagttgatgttggggatcacgccgccgtgggcgatggtcacgccggcgagcagcctgccgagctcctggtcgttgcggacggcgagcagcaggtggcgcgggatgatgcgggtcttcttgttgtccttggccgcgttgccggcgagctccaggacctcggcggcgaggtac

SEQ ID NO: 103556 - DNA, 228 bp, Triticum aestivum
  Clone ID: PAT_TA_103556
agttttacatgatgattattgctgcaatatgctgggggatttggaccctccgcaataaagtcacatttgataatcatattgttcgttctcctcttgaggctgttttcactgcatgctcgtttttgctgtactgggcaggtttgctaaaggaagaggggggggcgaagctccaggctggagtgaagaggttggctcacgcgggtgctgcgctggcggacaggtccctcc

SEQ ID NO: 103557 - DNA, 617 bp, Triticum aestivum
  Clone ID: PAT_TA_103557
acaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcat

SEQ ID NO: 103558 - DNA, 608 bp, Triticum aestivum
  Clone ID: PAT_TA_103558
tgtgtttgtcttttattcccaagtttgaactagtatagttcgggttcttacatgatagtgcatgtcacattattttttcaccgctacaacgaccaaaccatggactgagaaaacggtgtttcatatatctagtactagagttattttcttctcagttagtaccgaagatgccaaatggcgcgatggtgcaatatggagggatgtagacattgcacattgcaggtagcgtctgtagggctaggttccttatttcctcgaactggggcagttgttgaggctggacagagccctgggcctgtgggttttgttgagatggccggaaggagccctggcctaatggatattgttgcagaggctgttggaaggagacctggctcgatggttgttgttgttgtttttgttgttgatgcagaataatagcatgaacaacattgtggatggcctggcactgcgactgctcagggatctgccataggtgctgacaacacaattcttgcagcagctggtaagtactttgttgcaaaacttgtgatcttccatgcactatgttgtgttgctgcaatacaacatccatgcatggaatcagttgttgttgcaaaatttgttga

SEQ ID NO: 103559 - DNA, 491 bp, Triticum aestivum
  Clone ID: PAT_TA_103559
ttatctctgcctgcaaccctcctcccaccgagggtaacgccgtcgtcggcgtggcaaacctgccgcctcctggattcctcgcggccctcccacacgccggcctgaacaccagggccgtcggcctggtcgatcccgccaggcaggagcccaggggccgcgcgctcggccggggagacaagcgccgctccgtccagggtctcgtcaacgagatcgaccacaatttgccggccggagaagccccggaggagggcgagggcagcgcggtggaagccccgcaggagacgcccacgcagaggaagcgcacgcatcgatctgccatcaggaggaggaagcagagtgggtcctcgaccatggccaacctgtacgacgatggccagaacaaggatgaaagcaccgggttggggctctccgcgaagcggaagaggaagaggagcaagtacctcttgctgccatacaccaacgatcttgacgggctggatctcgacgagaag

SEQ ID NO: 103560 - DNA, 481 bp, Triticum aestivum
  Clone ID: PAT_TA_103560
tcgtgccgcccagtgtaacttcttcgcagcaggggtcatactatccaggccaagcttctccccaacagtcaggacaaggacagcagccaggacaagaacagcaaccaggacaagggcaacaagatcagcagccaggacaaagacaacaaggatactacccaacttctccgcaacagccaggacaagggcaacaactgggacaagggcaaccagggtactacccaacttcacagcagccagaacaaaagcagcatgaaggacaagggcaacaatcaggacaaggacaacaagggtactacccaacttccccgcaacagtcaggacaagggcaacaaccaggacaacggcgaccacggtgctacccaacttctccgcggcagccacgacaatggcagcaaccaggacaagggcgacaaccatgacaacggcagcaatcatgacaacggcaacaatgtcagcaaccatgacaagggcgacgacc

SEQ ID NO: 103561 - DNA, 619 bp, Triticum aestivum
  Clone ID: PAT_TA_103561
atctatcatatcaaatgcttccttatcagatgatacgcctagcgcaaaaaacattagccaaatcggcagattggcatacaagaaggaaatggaaatgattttgctgccactgaaatcattattctttgtagaatcaatcagcttcacatatatgcgtcttcgtttgatttcagacaaataagaaacagtccagacaggccggtcagcaatccaaatcctagtcaagcatctttgctcttgggcaataaatatcttctccattcccctgatcaaaaagtatccaccagaatcataaaggcagtcactttccctgagttcacgcaaccagcataaatttgaattaaccataactggaaggcggccaatattcaccacatgagtttcatccataagaactctcttgtgaccaaaaggatctttctctgttttagacttgtcacttttctccatagaataaatctgaatatgcacttctacttccattttggaggaatatgtcatattttggaggcgagcatgtctaggcttgagcttaagtgactcctcatcaacatcatctctgccagaccaaaatacaggcttttccagtttcactctaccaaacctgataacagcatgc

SEQ ID NO: 103562 - DNA, 584 bp, Triticum aestivum
  Clone ID: PAT_TA_103562
ctcacattgtggttaaatatttgctcacatacgagtaataagatacacatcaaactacatagcagcaaactttatcagattacaagttgaacactcgctcacatacctattaataagacaatttatcatacaaggctgggataacacaacgactttgccagacttgcagaaacctctcttgtcaatcttccgacagcgccatggcccaagtaaagatcccgagcatccctgagcaccatgagtgtacactagcgagcccacctaatagacagggacagcctagtatagcaatcttcatcttcatgcttgaaccactggctcgaaatatcctctgcattgagaagaactgtttccttgatactcagtgttttggatttccctatcgttagggaccccttaaactctaagcgagtcgcttgaataggcacggcaaggaaaggccgcaccaatgggaggcacacatggcggtgcgattcatcgcagagaaagggcggtactggatgggcaacacgctgtagaggattaacacctgaattggcacctctggtgaatatggtgatatcacgatgaaatatgtctgtgtg

SEQ ID NO: 103563 - DNA, 184 bp, Triticum aestivum
  Clone ID: PAT_TA_103563
tggcgggactggcaaaaccacttttgcgaacaggcatcttactggagagtgagataagaaatatgagcccactattggtgtggaagttcacccattggatctcaccactaactgcggaaagatccggatctactgctgggacactgctgggcaagagaagctcggtggccttagggatggatac

SEQ ID NO: 103564 - DNA, 522 bp, Triticum aestivum
  Clone ID: PAT_TA_103564
gtgaaaaaaacaagcaatattttcttagttggaaaaaacaagaatttatgacaactagacagacaccaaacatgaagagcaaaacatacgacgaatgtctcctcttatttgaagttcagaaagcacaaacaactatgtgcctagaatggaaataaaaagcacgcacaaacacgataggcgaatgcacgaaatgtctgagaaataacagttcatgaatggaaagttgaggccagactttatcatatcctgccaccagcttcagtcatctagggtcaggtcgatcacctccgatttgtccatggcgacggcaggagcctctgcgttggtgacgcaaatctcctccctgggcaccggcttcaccggcgcagcgcctccactggcgcctccctggctgccgctgccctccatagaccccattttcttcacgccagaagatttcgcagccttgccctcgcgttcagcgcagttgaggccgtcagagtttgcaggatcaacccagcaccgcttggcatcagctgagct

SEQ ID NO: 103565 - DNA, 546 bp, Triticum aestivum
  Clone ID: PAT_TA_103565
ttttttttttttttttttctgtaaaattccaacgaaaaacttagttcatttgtgcttgttggtcaatcctaagcccttctctattgcatcggatcataaaccttgggtgtagtacatctcgatttattttgctactactagttcctagctgtccggccacaagtgccctcaactagggttgattggatagccaaccatcatcgatgaacctgatgtccacgaacctctgcacctctgcatagctcatgtgcttctcccatggcactctcccggcagtgccggaacccgggccactgcatccgacctccgcaaaagtcacctgtggcacatcttggccgggcgtccacttgtcccacccctgcgggacgacgatgccggccatgttcacctggaagaacaccacggtggcctgctcgttccacgcgcggccgaggtactggcgaccggagcccatgatcgcgccgcccttgaacacgagcgccacgttcctgccgccggccctgccgtgcgccgtcacccacccgggctgctgggaccacgccggca

SEQ ID NO: 103566 - DNA, 695 bp, Triticum aestivum
  Clone ID: PAT_TA_103566
tcgtgccgttttttttttttttttttagtttcacctgcttgttttttccccttattttgtacaaatactctttgtattattattctaaaaatcaacaacaaatatgcagcagagccccgctgtttccctcaaaaaacaaaaacaataaatcaaaaaagataaaaagaaaaactatgtaggtctacaaaaccacaaactatgcacaagcacatacatatatatgtatggttcacttgcgggaatgataaaagttgcgacacatcaacaacacacgttcaaactagttcaggactcgaggccgattacatatggttgatagttgatacctacttagaggctaagtaccccaattactgctatgactccgcttattgacctcaactggtacttagatggtgtcaagggcaaccatcatgtttagttcattgagcacattggtcttcatggtgattagcacagttgtgccaaccccaagaccagtcccaatgaggaactccttccagccctggttgaagtagatgcggccatccgttgatgtctcatacgaacactgaccaaataactgaagagaactcaagtgaaacacttagggtaccgatccttaggatttgttataatatactactgaaaaattcaatccaagagtggaaaagaatgcgacccgtcggggcgaatgatacacaacattactcatg

SEQ ID NO: 103567 - DNA, 497 bp, Triticum aestivum
  Clone ID: PAT_TA_103567
gccaccgcagcaactccaacaacgtatattttggggaatacctgcactactaaaaaggtattacccaagtgtaacttgtccgcagcaggtttcatactatccaggccaagcttctccgcaacggccaggacaaggtcagcagccaggacaaggacaacaagggtactacccaacttctccgcaacagccaggacaatggcaacaaccggaacaagggcaaccaaggtactacccaacttctccgcagcagtcaggacaattgcaacaaccagcacaagggcagcaaccaggacaagggcaacaaggtcagcagccaggacaagggcaaccagggtactacccaacttcttcgcagctgcagccaggacaattgcaacaaccagcacaagggcaacaagggcagcaaccaggacaagcgcaacaaggtcaacagccaggacaagggcaacaaccaggacaaggacaacaaggtcaacagccaggacaagggcaacaac

SEQ ID NO: 103568 - DNA, 627 bp, Triticum aestivum
  Clone ID: PAT_TA_103568
atctaacacacaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcagaccatcccggcaatgtgcgacgtgcatgttccaccatactgctacaccaccatatcaccatccagtgacgtcactaccgacatgggcggctactgaga

SEQ ID NO: 103569 - DNA, 391 bp, Triticum aestivum
  Clone ID: PAT_TA_103569
ggtaaactttatttattttctttttcgcaggcaatgccctcaacacgaagagcaataacaaaatcattagggctagggccacgacaacggccaccattaaagtgtaacccggtgcaatagagttcacagacgattactggatgaacgtcacgacatggcgggccatatgcctttgtttccttgcaatcatgtctgagtggtagcactggagccaaattatcatcgcctctatctgttcctgtagatggagccaaagccttcccacctcgtccgggagataaaggtgaagcaccaccaccaataaacttttggcggcctagttgctctccactactgggttcttcaatggttaataggaccagaaacatgatcactagaattgtcattttcc

SEQ ID NO: 103570 - DNA, 629 bp, Triticum aestivum
  unsure (1)..(629): unsure at all n locations
  Clone ID: PAT_TA_103570
taatactagctcacttccttcggatctcgctcgttccaccaagctactagtccctcgaagatgtcgacggtgacccgtgcctacctcgaccagaggcttgccgccgccaagcgctgctccagagaggctgccgtggcgggagccaaggccgcggccgtcgccaccgtcgctgccgcagtccccaccctggcgagcgtgaggatgctgccgtgggcgaaggcacacatcaacccaactggccaggccctcatcatctccactgtcgccgggatggcctacttcatcgtcgccgacaagaccatcctctccatggcaaggaagcactccttcgatgaggcgccggaccacctcaagaacacctccttccactgattttagactataatagacccattagtagtgcgcaataagctgtgtgcgccagcccgtacgtgtctgcagaaagatagtgtataacgttcagcacttacccgagatcaggcgaggcttgcagacagttagtggtgtgnggtgcaattagcacttatctgatcaagtaatcatcatgtatccagccagtaatcttgaattagtaataacttgcatttgtacagatcagattcacctgccatcacccatcttacattttc

SEQ ID NO: 103571 - DNA, 493 bp, Triticum aestivum
  Clone ID: PAT_TA_103571
ccccccgcatctcgccccgcctgcgcattccgccgagcgcatggagtgcggcggcgacggcggcgggatggacgcgctgccggacggcgtggtgcaggccatcctctcccggctcagcagcgcccgcgacgtggccgcctgcgcgggcgtctcccgctgctggcgccactgcgtgcccttcctcccggcgctctacttcccgcggagcgccttcgacgtcgcgaggcgcggcggcgtcgcgtgcgccgacgacgccatcggccgcatggtccaggccgcggcgcgcctccaggagctcgtcatctactgccccttctccgccgcgcagctcccgcgctggctcgccgcgcggagcgcctcgctgcgcgtgctcgagctccgggtcgactccgccgccgccgccgggtccggatccggtcacctcgactgcgtcgccgtcgcccgcaacctcgaggagctgcggctctgggggctcaccatgacgcgcgagccg

SEQ ID NO: 103572 - DNA, 401 bp, Triticum aestivum
  Clone ID: PAT_TA_103572
tctcccctcgcctcctcgtcctccccctcctagggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagcctgctgatatcgccggtcccagcgaggcggcgatggagaacccc

SEQ ID NO: 103573 - DNA, 552 bp, Triticum aestivum
  Clone ID: PAT_TA_103573
tttcaggtttctgatataaaattacttatgcaggacgaatctatacagcctactagtcactctacaatctgcggagtacatgattttccgctctgtctctagagtctagacctcgacctgctgctgcagctgcagggtctcgagatgcatcttcctcctcatgctggcgatgaactcttcgaatttcttgttcatctccttcacgtcgtcagcgcacccggcctctgtttcctgccgcaccgtgtgctcctctcctctgcttctctcgtcatgcaaactagagatcctatccgccaccacggcaatctcatagccagcaccatggtgaaagtggttgaagctgtaggccgatctctgtttctccgcggaatcgatctcttggagcgcggcatattccctctgcgtcgctctcgtcagcggcttcccgcgccgcactcgcgccgtggccgtctcagcgcctcgatgttcacgctcgagccgaccttcgtcggcgccggtcgcgccagccgccgtactggtcgcccgagtcttgggctgaggccgtgcctcgga

SEQ ID NO: 103574 - DNA, 412 bp, Triticum aestivum
  Clone ID: PAT_TA_103574
tcatgaaaatcttcatagataccggctgctctcaagaaatctgcagaaggccattcacatgcccgaatctccacggtgcacggcaaattatacttaggcttcggtgccttttccttcgagctttggctcgacgagcccctcaaaaatctcctcattattttctgaaacaatctgaaatttttagtaacttcaaacaaaggggggccaacttcaataatattgatagcaactactcctacaagtgcctggagcctaaatcaagcattagaactacttggaaccatataaatttgacatgcaagctcaagaacatggtcacctatgcagcacaaatttgcaaagaatagagcactagaacaaaaactaattggaccaatggaggagtcacataccaaggaacaatctgccaaac

SEQ ID NO: 103575 - DNA, 553 bp, Triticum aestivum
  Clone ID: PAT_TA_103575
agcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctgg

SEQ ID NO: 103576 - DNA, 452 bp, Triticum aestivum
  Clone ID: PAT_TA_103576
gcagtttcaagaaaactcacagccgacatcacattgcacaaagcttccatgatttaccttcttgaacgggaaacgacatgggccaagaagacgagaaccctgcccagcgaaaaaaaataccccctgacgtacaaaactggcagttgtgttgccgtagatccctacttattacctagcccagcaagagcccatgtaaagagtccatccatgcgcacataataacttgcttatggaaaatgtaacagcagacagcatctatttagcgttttcttgctttggaggaacctcagctgttgttgcactcgcttgggtgtcgacaggctccacggcactggcctcggctttcctcgtctcgatttctctttgcatttgtatttgtcctcgcattacttggagcatctccttcatttgcttctcttctttcctccattgcatgtctgttaagatctgag

SEQ ID NO: 103577 - DNA, 535 bp, Triticum aestivum
  Clone ID: PAT_TA_103577
gaactagtatagttcgggttcttactgatactgcatgtcactttattttttcaccgctacaacgaccaaaccatggactaagaaaacggtgtatcatatgtctactactagagttcttctcttctcagttagtaccgaagaagccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgaggctgttggaaggagacctggctcaacggttgttgttgttgttgttgttgttgttgctgttgttgatgcagaataatagcatgaacaacattgtggatggcttggcaccgcgactgctcggggatctgccacagctgctgacaacacaattgttgcaccagctggtaagtactttgttgcaaaacttgtgagcttccatgcgctatgct

SEQ ID NO: 103578 - DNA, 402 bp, Triticum aestivum
  Clone ID: PAT_TA_103578
tagtttctttgtttgtacctgctcctgttggcgctgttccaaacgagcggaatctttctgtacctcctgctctcgttgacgctgctccaaacagatgcagtctttctggacctctgccatctccaacaggagcacagcttgttcgtggcgcagtgtcgaccgagtctggttcaacggatggtgaacagtttgctggttcagcatattcacttgatagaaatgctgaccatgccagcgcaagtagaacatcaaagagcaactttgatgaagagtcttctgagtgggatgatttgggtgatggtgtgactgagaaaggaacaaagtctgtgaatgatggccatccacatatcaatccagtgcatggtcaacagcatgacccaatggatgttttgcagaagttgc

SEQ ID NO: 103579 - DNA, 304 bp, Triticum aestivum
  Clone ID: PAT_TA_103579
tcaggcggaggtgaacttggtgacggccttggtgccctcatgagacggcgtgcttggcgagctcaccggggaggacgaggcggacggaggtctggatctctcgggacgtgatggtgggcttcttggtgtaacgcgccaacttggcggactcggcggacaacttctctaatatggcgctgatgaaggatttcatgatggacatggtcttggacgagatgccgatgttcaggtgcacctgcttcatcgcctagaagatgtatatcttgttcgtcttcacgctgttgttggccttctttttgccctt

SEQ ID NO: 103580 - DNA, 296 bp, Triticum aestivum
  Clone ID: PAT_TA_103580
acacaaagcggttgggcattcgctgtaacaaccggcacttctataaacaacttactcgagttagttcaaaaattgctaccatatcaacaggggcgctcctctgcccgcgcatctctcggctacaaggatgctgctaacgctgctaaaggctctataccggcttctaagtggacgactcaagtcaacaacagcacaaaagcgaagcaaacgatggcctacaacacatcgcaccgactaggcttcgtcgtcggagaggcacaccacctccgcgctcggcccagctgcattgctggtgc

SEQ ID NO: 103581 - DNA, 430 bp, Triticum aestivum
  Clone ID: PAT_TA_103581
cttttttcccatgtttgaactagtatagttcgggttcttacatgatagtgcatgtcactttattttttcaccgctacaacgaccaaaccatggactaagaaaacggtgtatcatatatctactactagagttcttctattctcagttagtaccgaagatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgagactgttggaagcagacctggctcaacggttgttgttgttgttgttgttgttgttgatgcagaataatagcatgaacaacattgtgg

SEQ ID NO: 103582 - DNA, 382 bp, Triticum aestivum
  Clone ID: PAT_TA_103582
ttgaattggggtacgagtgctcagacacagatcacactagtttagtgaagaatggagacgagacgtccagcggtttccgccgtgtccgtgggggcggtggtgctgatcctggtctggtcgccggcggcggccgtagcaagcggtggctggatggacgcgcacgctacattctacggtgatgagaccggagctgagaccatgcagggtgcgtgtgggtacggtaacctattcgagcaggggtacgggctggacacgacagcgctgagcgtggccctcttcagcgacggctggtcctgcggcggctgctacgagatccagtgccacggcgacccccactgcaagcccggcggggcgcaagtgacggtgacggcaaccaacctct

SEQ ID NO: 103583 - DNA, 421 bp, Triticum aestivum
  Clone ID: PAT_TA_103583
ttccgcttgccgcttggccgaccgtactcgccgacgacccgaagcaaccattacgcgatctcaacgccatccgtttcgctagttggtgtgccatcctgtaaattgacgggtttccctcatcctgtcgtcttcgtgatgccaaaggaagtcgcggttaggagcatatacatgatctgatgtctgatgagttcgtttctgttggtcagtcgcactaaggatggatacatgatattcttgacttgccctggcttatctcacgagttagcacctgtctcagcttctcacggcatctgataggtccttaggattatagatcctgaagataagttcagatcctagattggggatgtccacatgtgtactacctgatgagctggtggtagacatcctgtctcgactgccgctaaagtccttgtgccgc

SEQ ID NO: 103584 - DNA, 395 bp, Triticum aestivum
  Clone ID: PAT_TA_103584
ttttattcccatgtttgaactagtatagttcgggttcttacatgatagtgcatgtcactttattttttcaccgctacaacgaccaaaccatggactaagaaaacggtgtatcatatatctactactagagttcttctattctcagttagtaccgaagatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgagactgttggaagcagacctggctcaacggttgttgttgttgttgttgttgtt

SEQ ID NO: 103585 - DNA, 321 bp, Triticum aestivum
  Clone ID: PAT_TA_103585
caacaacactatttaagtaccagtccatagattaaccacacatgcagcaaggtttctacattggttgcactagatgtcctctcagctaacaggcatacattaaattaaaactccaccatgaagtactactgcatagtctgactaagcctgtaaaccagccagggttatgcaactcaatacctactgcagatcaggccaagcaacattggactgcagatcaggcctagcaacattggactgcagattaatcacatcggaaaggtgtttgctgaaagcccatatctatggtgatggagctcagcatttagaagtctggatctc

SEQ ID NO: 103586 - DNA, 542 bp, Triticum aestivum
  Clone ID: PAT_TA_103586
gtttcaagagtgagtctagcaccgactcttctccaataccctcaagcagaaactctactacagaggatgctgataaatacttaggaggctcaacaaaacagttgctgaactctagtttagttcctatcagccaccaacacccgtataggagcctgacagatcaaatgcctccagcttttcatgaacaatatgatattcacagaagtggcaactcctttgctcgggggaatttatcaagaagttgcttcggtgcaaatgtcaatggtggttctgatttacttaaccttagtagccatcgcgctcctggtcatatattgccaccccagggaatccaaggaaaactaaataactttcagcaatctttgtctgcaaatccttttgttcctcgatttggcgggatggcatataagtcgcatgatgaaagggcgactctacgactcgcattgcaggatatatcccagccaaagtctgaggctaatccacctgatgggcttttatcagttcctttattgaggcatcagaaaattgctctgtcatggatg

SEQ ID NO: 103587 - DNA, 566 bp, Triticum aestivum
  Clone ID: PAT_TA_103587
gccgccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttac

SEQ ID NO: 103588 - DNA, 387 bp, Triticum aestivum
  Clone ID: PAT_TA_103588
ttgaactagtatagttcgggttcttacatgatagtgcatgtcactttattttttcaccgctacaacgaccaaaccatggactaagaaaacggtgtatcatatatctactactagagttcttctattctcagttagtaccgaagatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgagactgttggaagcagacctggctcaacggttgttgttgttgttgttgttgttgttgtt

SEQ ID NO: 103589 - DNA, 239 bp, Triticum aestivum
  Clone ID: PAT_TA_103589
gctacctgcaatgtgcaatgtctacatccctccatattgcaccatcgcgccatttggcatcttcgtactaactgagaagaaaataactctagtactagatatatgaaacaccgttttctcagtccatggtttggtcgttgtagcggtgaaaaaataatgtgacatgcactatcatgtaagaacccgaactatactagttcaaacttgggaataaaagacaaacacaggtcttgtctaca

SEQ ID NO: 103590 - DNA, 133 bp, Triticum aestivum
  Clone ID: PAT_TA_103590
cggccatggtctccaacaccctcctgaacatgctcacctcacctgttggtttcgcggatacccgctaaggccaggtgaggttccctgatatcagcaccgcgatcctacacaacatctgccacttcttctactg

SEQ ID NO: 103591 - DNA, 555 bp, Triticum aestivum
  Clone ID: PAT_TA_103591
tccttgcttaccgagatgccgaaaagacggtgaccagatcatccgcggaggatcctcatgccgctgccggcgagcagcagcaagcggcggacaaggcgcctcgcaccaccgagcaggagccggcgcccaaggtgcatgagcctaagctgccgcagcagcagccgaggcggcagccgtaccatcaggcggcggacaaggcggctcacgccagcaatggcgagcaggagccggcgcccaaggagaagcctaggcagccgacaccgcagaggtagcagccaccacgccaggcgtcgatgaaggagaaaggcaaggcgccgatggtgcaggagcccccagcggtggcgccacacgtcgcgcagagggcggcggccgccgcggtggcggcggtggcccggtcgcccgtgccgttcgtcgtgacccagctcagccgcagagagaaggaggaggactggttcgcgatgacttgcggcaggctgccctaccgcccccagcagcgccgccccaacgccgtagaggacaagctccagaaactgttcccagggcagacgctgcctg

SEQ ID NO: 103592 - DNA, 630 bp, Triticum aestivum
  Clone ID: PAT_TA_103592
gtgtttgtcttttattcccaagtttgaactagtatagttcgggttcttacatgatagtgcatgtcacattattttttcaccgctacaacgaccaaaccatggactgagaaaacggtgtttcatatatctagtactagagttattttcttctcagttagtaccgaagatgccaaatggcgcgatggtgcaatatggagggatgtagacattgcacattgcaggtagcgtctgtagggctaggttccttatttcctcgaactggggcagttgttgaggctggacagagccctgggcctgtgggttttgctgagatggccggaaggagccctggcctaatggatattgttgcagaggctgttggaaggagacctggctcgatggttgttgttgttgtttttgttgttgatgcagaataatagcatgaacaacattgtggatggcctggcactgcgactgctcagggatctgccataggtgctgacaacacaattctcgcagcagctggtaagtactttgttgcaaaacttgtgatcttccatgcactatgttgtgttgctgcaatacaacatccatgcatggaatcagttgttgttgcaaaatttgttgaaggatttgttgttgttgttgttg

SEQ ID NO: 103593 - DNA, 508 bp, Triticum aestivum
  Clone ID: PAT_TA_103593
gtcgaccaggccgggaataaggtcacaacactcctcacctccaccaccaccaacaccatcgcgttagctggggatctcgcaccggccactacgatctcaagccggtgacgcacgcaaggtgttcgacaaaaggaatcgtctgtcacttcatctccttttccattctctgcgaacaaaggaatcgttggtttaaacataggacaagccaacaaaaacgataggaggaagagagatattattacaatgcagtaaagtaaaaaaaatgacatccatcacgcattaggtatttctcagaacaagcaggtactccggtatttataagccaaggcattgggtctctaatctgcagtctgcccccctcttggagacaagcaagaacatctgcaaactgaaagaaagaagggatgatgaagaaggggaagtggtccagggaagaggatgacttgatgaaaaaacacattgagaagtatggcattggccgtagttggcaggcattggctgaaacttt

SEQ ID NO: 103594 - DNA, 242 bp, Triticum aestivum
  Clone ID: PAT_TA_103594
cccgaagggccgggacgactcagggttacaggatgcaccaaccaacgatatccatggatcatcacaacgggcacggaaagaaaacaacctatccgcgcgccggccggcgatctcacctcacgccctcccggcgatcgcctcgggcgctggcgccggcggaatcgcgcgacttgcagtggcgcatcgccttgatcgggccggggaggaaccgcccccaccctcccgttttgggcgccaacttc

SEQ ID NO: 103595 - DNA, 561 bp, Triticum aestivum
  Clone ID: PAT_TA_103595
ttttttttttaccaaaagggttttcccccgctttgtattccaaagcaaaccaccaaagtacacatcgcaatgctagggcgagcagcacaacaagcccaaagaaaaagaagaagaaaaaatgccaacaacggcagctcgacaaagcgcggatgacccgcgaccgctgcgccctccggaaacaaaccaccacagcccgaggctccgaactaccgcgaactaagcagcacctccaagaagggatgcgacgccgacgatgctgctgcccggacaagtcctagggtttcccccagtacgcggagggaggtggggggatagctactcccgacgccctccaagaagggatagtggcacccgccggtgtcaccgcatcggagccggacgaaccggcaaggatttctcccgcacgccaaaccccaccagccaatcggagccgaccagtcaaaccaccgcccaactatgcgccacgacggttgtgccgccaccaacaccgtctcgctgcgaacaccaccacgaggccaagaagagcggagagaagatctgagcgacgggagcagcagcatc

SEQ ID NO: 103596 - DNA, 424 bp, Triticum aestivum
  Clone ID: PAT_TA_103596
acacacacacagcgcaacgcctcccagctcgactccacgtgctgccgccgccgccggcgtagacctcccgttggccgccatggacccgcgcttccagctgcccactccggtgccgtcctccggcggcgctggtgtgcgagggcaccaccggcgggcccattcggagacgtttctgcgcttccccgacaccgacctcttcctcgaccccgatggagacttctccttctccgacctcgacttcccatccctctccgacgactccccggcggtctccgacccgaccccgcctcctcccccgccgatggcggccagctcgtcccagacaccggctccccgtccaccgggcgggacccacaacaggagcctctcccttgacgccgccttcttcgagggcctcgccttgcaggggggaggaggcgggggt

SEQ ID NO: 103597 - DNA, 440 bp, Triticum aestivum
  Clone ID: PAT_TA_103597
aggcctcacactggcagtgagccaccactggtgatgcatctgctgctctgttgcacgtttctcctggccttcgctgctccggcgaccaccgcagcctccgcccccgccccggctccgaccccggcgaagcagaccatgacgtgggacgtggagtacatcatgtgggcgccggactgccagcagcgggtgatgatcgggatcaacggcaagttccccgggcccaacatcaccgcccgcgccggcgagaccctcagcatcaccgtcaacaacaagctgcacacggagggcctcgtcatccactggcacgggatgcggcaggtgggcacgccgtgggcggacgggacggcgtccatctcgcagtgcgccgtcagcccgggggactcgttcacctacgagttcgtcgccgacaagccggggacctacttctaccacgggcactt

SEQ ID NO: 103598 - DNA, 121 bp, Triticum aestivum
  Clone ID: PAT_TA_103598
acaaacaattataacatcaaagagatagagaaggctctagtgtagcagatacaaaagacatagccatggcgaaactgatgtgcttatgtttcatcatcctcactattgtggtagccgtgtc

SEQ ID NO: 103599 - DNA, 526 bp, Triticum aestivum
  Clone ID: PAT_TA_103599
aggcccgccccgcgcctgacctgcgccgccgcaccacatccgcggccgacccgtgattgccaaagagcgagaggaggagcacgacgttggatctcggtgcctccagcccccttcccacacaaccccgatgatctccgcgacgttggatctcggggacgaagccgcttcttccgcggcatccgcgcagatcgaaatcagttcctccccgtggctctccttcacttcccgctgtcctcgggcccaagccgccgacgaaggctgttgtacggctagcacgaggcggctggacgatggctaccacaatgatgcacgaggaggctagcccaaggctgtcggacgaccgcaaccacggagatgcaagaggaggcaagcccgaggcggccgaacgacagcgatatgtcatcctcgactaaggctggttccttctgatggtgggcggcgccagatccagtcattctcctcgagctccccgtcgtcgtgctaccgtggggcgtcttcgccaacatctcacgccggtgaacgtgtc

SEQ ID NO: 103600 - DNA, 292 bp, Triticum aestivum
  Clone ID: PAT_TA_103600
acccaattatatatgactagacatctttacttatcaataggcaccagctactgtgccaacgccgaatggcacactagtggtggttctgtacaacggcacattaacactgcacatcgctggcaggatactgagcgcaatggaagtcatcacctcaagctgagctatctggtgtggctgcaaaaaggtaccctgtgccaattgttgttgttgaggttgttgcccgagttgctgctgcgactgctgttggggttgggaaacacattggcccaactgttggggctgctgctgctga

SEQ ID NO: 103601 - DNA, 484 bp, Triticum aestivum
  Clone ID: PAT_TA_103601
gcaagtcctcgctccgcagtcgccaaatccagacgagtccgtcgccctttgcgccgccaccccggtagcccctctcatcgacgactaccacgggtgcgcatccctctccctcgagacttcatctcgacctccaggctccagcgcgaggccacctcctgccgaccgcgactccctccatcgctgccgacgccgccctttgcgccgccaccccgacagcccctcttgccgacgatcaccacgggcacgcctccctctccctagactccatctccccagcggccttccctcctttgccctgagtccaggaccaccagtttggtcaaattccccgtagccgccggtcattatcggctgcgccgccgcccctggtcgacgcgaacgccgcggcggacagcgggttgctgtgctgatgcaccggggtgtagcacagctcggaggcctggctgctgtggtggtgttggtcgtggtggacggggaaccggcg

SEQ ID NO: 103602 - DNA, 427 bp, Triticum aestivum
  Clone ID: PAT_TA_103602
cggcacgagttttttttttatataatgaagtttattattattccattcgatgattttgagccatacatcgatcgttgattcatgcgaacgtccttcatgcatgtgagggtgcagcagggtgagccaccccaactgacgcactcgtcggattgtagcagcaacaagatggggcccctatgccgcccaccgcgcaatgaccatgatagttcggcgcgcaaaatttagtgcagtgcgccgggtcgcagctgccagtcggcggcatgcaattgattgtaccaggcggtccattagctgatgacagaacggtgcaggtagccatgatcactagggccaccaagcacagggcgttcctgctccttctgaggattgccatcaggagatccaaactcgaggctagctactggtttttctttctttgctctccgtt

SEQ ID NO: 103603 - DNA, 512 bp, Triticum aestivum
  Clone ID: PAT_TA_103603
cggcacgagctctcgcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgc

SEQ ID NO: 103604 - DNA, 268 bp, Triticum aestivum
  Clone ID: PAT_TA_103604
ctttctcctctccaatcaattgcatttttctctctgccatgcatgtagacattaattactatagctaatgcctacagccagctttgttatacgagagttttttcttggtggctacaagtgacctggcattcatatagagcccgttgccggctcttctattaaccatgctctaagacctatcataagatgcaccctcacgcatgaactccatgatggcatcctcaattcccgccaccgccatctcaaaatccgataatccagcgggact

SEQ ID NO: 103605 - DNA, 215 bp, Triticum aestivum
  Clone ID: PAT_TA_103605
cagggacatgactaattcttcacacccacgagcagcacaatttttaccgagattgtaacatcgcactgctaactacacacagaacaccgtcatgcggctcatgatacagggatgaagcctaagaacaggcgaacttggggacggccttggagccctcggagacggcgtgcttggcgagctctccggggaggacaacgcggacggaggtgtggatc

SEQ ID NO: 103606 - DNA, 407 bp, Triticum aestivum
  Clone ID: PAT_TA_103606
ggctgcagctttttttttttttttggcaaagcaacaaaagttcttgcaaaagagaacttgagatgcatggtggcacttggtagcagagatgcaatattcccaaaccattattgggtagcacaacatcaacctcataagttattttccgggttttttatttgactcaaactcatggaatgcccatccatgatcactatcttcaacctctctttctcttgctaccccttttcctgacgcttctcctcatcggtaacgccaaaatatcctttctcccgttgttgcgccattgttgtagtcgctcccgagctcctcttcgaactcagtcggagtcggagtcctcgtcatccgtcgacatgcccttcaggccacccacgcgcttttcggacttcttcttcttgactttgtac

SEQ ID NO: 103607 - DNA, 499 bp, Triticum aestivum
  Clone ID: PAT_TA_103607
agtcgcggtgccaagccatccacaatgttgttcatgctattattctgcatcaacaacagcgacaacaacaaccatcgagccaggtctccttgcaacagcctcagcaacaatatccatcaggtcagggcttcttccagccatctcagcaaaacccacaggcccagggctctgtccaacctcaacaattgccccagttcgaggaaataaggaacctagcgctacagacactacctagaatgtgcaatgtctatatccctccatattgctcgaccaccattgcgccatttggcatcttcggtactaactgagaagagaaacaacattttcttagtcccatggtttggtcgttgtagctgtgaaaaaataaagtgacatgcactatcatgtaagaacccgaacaatactagttcaaacttgggaataaaagacaaacacaagtattgtctacaaaaaaaaaaaaaaaaaacgatatcaagcttatcgataccgccgacctcga

SEQ ID NO: 103608 - DNA, 543 bp, Triticum aestivum
  Clone ID: PAT_TA_103608
ctgctttattattgagtaggtagcagatatcgtggcttgacttgcaattattgctgcagcagttgctataacaaaggctggccagtatatggcatctggaatggagcgatagaaggcgtcattcacatgttgcttgttggaaattatataagcagcctgccctgtgtatgccagaagaaggcatgggaatacaatgaaggtgaatgcaatctgaatggccaaaacaggaaaatgacatagatccgcaaataacgcttcagttcctgtgatgctaagcatgattcctccaagaacagtccaggtgttagaagaattcccattccttcggaaataacggtatatatagactggattgtatgcttttaatacagagctaccatgcttgtgtatgttcagtgcaccgacacttccaattaaaatgaaccacatgagcactataggtgcaaatagccatccaactttgtctgtaccaaagtgttgcatgctgaatactccaatcaagatgatcacggcgacaagtacaacaatatcagtactcatgtg

SEQ ID NO: 103609 - DNA, 438 bp, Triticum aestivum
  unsure (1)..(438): unsure at all n locations
  Clone ID: PAT_TA_103609
acgcccagcccatcgtccacctccctcccaatcggatccacccacccacccttcctcacctccctccctataatttctcttcccccgctcccaactgcctcccagtctcacgccctccccttcctcgcttgttccaccggctcactccactccccgccgctcccctctgtccgcccgccggcggagggttcagcgcttgtttcccggcgagcttcctctggggcgtgtggggggactgtgactctgcgagcatggcggggaaggggaaggaggaggaggtgtacgtggcgtcnatcgaccangggacgaccancaccaggttcatcatctacgaccgccacgccagccccgtcgcctcccaccagctcgagttcaagcagcactacccggaggccggatgggttgagcatgatcctatggagatcatggagagcgtga

SEQ ID NO: 103610 - DNA, 428 bp, Triticum aestivum
  Clone ID: PAT_TA_103610
tttttttttttttttttttttttctttagcaaacaaaaactttgtttgtcttttattcccaagcttgaactagcactgggcggggtcacacatgatggtgcacaccactttatttgtcatcgctacaacgattggggcatcagctaagcaacgatgatcttgcatttttcattggccaccaatgccagcgtctatgttggcatatggtatgttgatgggggaccaggttgttgaggttggatgatacccaaaccctgggcgagctgaaatagtggccgcaggatcggcaccccttgttgttgttcttgttgcatgatgatggaatgcgcgacactgtggatggctgcgcactggaactgttgaggaatttgtgctaattgttggcaacattgttgctgcatcacctggcaatcactttgtggcaaaat

SEQ ID NO: 103611 - DNA, 617 bp, Triticum aestivum
  Clone ID: PAT_TA_103611
tgtgtttgtcttttattcccaagtttgaactagtatagttcgggttcttacatgatagtgcatgtcacattattttttcaccgctacaacgaccaaaccatggactgagaaaacggtgtttcatatatctagtactagagttattttcttctcagttagtaccgaagatgccaaatggcgcgatggtgcaatatggagggatgtagacattgcacattgcaggtagcgtctgtagggctaggttccttatttcctcgaactggggcagttgttgaggctggacagagccctgggcctgtgggttttgctgagatggccggaaggagccctggcctaatggatattgttgcagaggctgttggaaggagacctggctcgatggttgttgttgttgtttttgttgttgatgcagaataatagcatgaacaacattgtggatggcctggcactgcgactgctcagggatctgccataggtgctgacaacacaattcttgcagcagctggtaagtactttgttgcaaaacttgtgattttccatgcactatgtttgtgttgctgcaatacaacatccatgcatggaatcagttgttgttgcaaaatttgttgaatgatttg

SEQ ID NO: 103612 - DNA, 531 bp, Triticum aestivum
  Clone ID: PAT_TA_103612
cagcttttcataggatcatcaattgcgagtagccaaagttagagaaaccaaattaagcgacgataacttcaacaacaaagagtacatgaattactagaggacaagcccacattaggtaagaagtacgcacacataaaccacggccggatcaacacggcaaattattacagtacgcaggacacagaagctaacgagcgctgcccacgcgactaaccagattgaacgggcttgtcctgcgatccttctgctgctggctctggctccggctctcccgtgccttcccccggcaccggcacgccgttggacgagctcccctcgtcggcacaggctcctcctttgctgctacccgcaccgtacgcaccttccccgtacccgtacccgtagtattgttgggccacgacctgttctccgccgaacacatggcactggccgccgacgttgggccgcacgggcgttatcccgacagtgtaaccctgcactggagcccggggcgcgtagacgccccgctgcatctgaacctgcaccggagct

SEQ ID NO: 103613 - DNA, 271 bp, Triticum aestivum
  Clone ID: PAT_TA_103613
ccccgcggttccccaccacctagctctcctcctcatggtcacctctccccgctcaccatctccactgaccggcttctctcctcgcacaggagagccacgcctaggcactggtggtggtgcgccgcgaggaggccccagcagcgtcgagctgctgttgctgcgggcacagcgacgtcggcgtggtcaggatggtcgcaggcgttgaagatacatcaaccacctcaagcccgcccgcctcggtgactgcatcgaggccaaggcgaaccccatc

SEQ ID NO: 103614 - DNA, 629 bp, Triticum aestivum
  unsure (1)..(629): unsure at all n locations
  Clone ID: PAT_TA_103614
cggctgggacgcgagcgggccgagtggctgcgcctgcactaccctttcggcctccgcgcgcgccgcggccccggggagcgcgtcgtcatgctctccggctcccagtcccacccgtgcgccggcgacggcggcgaccacatgctgctgcgcttcctcaagaacaaggtggactacgcgcggctccacggcatcgagctgctctacaacacggcgctgctgcagccccggatggtggcatactgggccaagatccccgtggtgcgcgccgccatgctcgcccacccggaggccgagtgggtnctggtggctcgacgccgacgccgtcatcaccgacatggacttcgcgcccccgctcgccaccaggtataaggagtacaacctggtcgtccacggctgggacgggaggtgtacgaggcccggtcctgggtcggcctcaacgccggcgtcttcctcatccggaactgccagtggtcgctcgacttcatggacgcatgggccagcatgggcccggcctcgccggagtacgcgcgctggggcaagaccctcaaggccacgctcagcgacaagcccgacgccgagtccgacgaccagtccgcgctcgcttacctcctcctcaagaacccgaaaaa

SEQ ID NO: 103615 - DNA, 572 bp, Triticum aestivum
  Clone ID: PAT_TA_103615
ccgcgccgcgacggaggcggaggcggaggcggcgcctccggcgatggcgacggcaacagccaaatgtgcgtgctgcggggggtgcgggttcctgttgtcggttgctgtcgcgccggttctcgcgctgtgatttctcgggcggtttcgaggatttgctggatggaggggatcgactggggtttggtagggtcttgagactagcatgcgcatgagggactagaatctgctgggcgtaatggggatttcgggagttccgtggctgctccttctgccgttccgaaaatagagggatcttgccgtcgatttgctagattagaagatccttaggtgccccgtttgtgtctatggagtgtcgtaactcgatttactttgttcgattgggccgtcctcctgcaccgatgcacgctcctgctgttgcttttgatgcaaatgagataataggaggattgtgtaaagtttgtgtgtttaaaactggatcgagatattcttggctccgaggggtcgaaatgggagcatactgatgctggattggtcatacttcgtggcgtgtttttcgtttgtgcaactgaaac

SEQ ID NO: 103616 - DNA, 250 bp, Triticum aestivum
  Clone ID: PAT_TA_103616
actacggtttattggtattcgtttcgaggttccttgcttggaatcttggaaaggactttgagattcaactcgacgagggggcgcagccataccactaagaacctatgtacactatgttatccaaaacaaaacaatactaaattcaactactatcctctactctgatactacattcgaagatacgagggcaaccccttacatcactgatgggtgccaatatatcgacgagtgcctacagccagttgtgtat

SEQ ID NO: 103617 - DNA, 409 bp, Triticum aestivum
  Clone ID: PAT_TA_103617
gcaaacgtgacatggacgcaacatctaaaaaaatccaacgactcacatgcatcagctcttctgcctaagctgtggcacccttgcccttcttcttctggagcttcctcatgtagaactccagctccgtgccctccaggatgtacccatcagctctgccacactgtccagggcaagacgaaatgcacgccagcagccttccaccactgaactgctcctcaatgtgcgagtccaatgtacgtccctgcgtggcgcttctcaagcttcctctggacattgttgctcttctttgcttcctctgtggcagcagcagcaacctcagcctcttgtccctcagcagcttccttcttggcagctgcagcagctttcttcttcctaccgatttcaactgcataatgagtcaggtaccact

SEQ ID NO: 103618 - DNA, 480 bp, Triticum aestivum
  Clone ID: PAT_TA_103618
gcacttgtacttgggttggctcttggcaatcccatttttcaccttcttcaccatggcatcaagaagttgtgcctcacgaatttgatcttccaaagtaggagagacttggaggttggcaagaaatccttgaggaacaacttggtgattcagcttgcggaaagcttcacaaaggtccggttggaagggtttgagaattaaactgttgcagtaagacttcttgctcaaagcgtcagtaataacattggccttgcctggagtatattcaatactcggattatactcttgaatcatttcaacccaacgagtctgcctgaggttgaggttgggctgagtgaagatgtacttgaggctcttatgatcagtgaagatgtccactttccttcccaacaatagatgtctccatgttaaaagatcatggacttctgccaactcgaggtcatgagtggggtagttctcttcgttgggcttcaactggcgaga

SEQ ID NO: 103619 - DNA, 138 bp, Triticum aestivum
  Clone ID: PAT_TA_103619
gtgctgccatccgctctccaactcaagcaagtgcattaaagcatgtgcttggtggacacagggaccttgggcctaaggtcctgcacgatgtgctttgacttaatatcccagatcttggtggaatcctgtgtctccgcg

SEQ ID NO: 103620 - DNA, 660 bp, Triticum aestivum
  Clone ID: PAT_TA_103620
cacgagcgccgccgccgtcatggatgagctgcgtcggccgcccgagttcgaccacatgttcacggacgaggcgtgggccagcatgacccaggacacgcggcgccggatcgtcgacatctcgtgccgggtggtagaggagcccacccaagaggaacgccgcatgcatcaactcatcgccggccccgtcttcaccgatgccgctgccgtcgctgaggtactggatttcgcggacagacatcaccgggaggcggagcgagaggactgggaggcggtgctgcaagggcggcattacgccgacgaatgcgcagatgacgatgaggacggcaagaccatgacgaagacgacgacggcgcagaccgtggacgcccggccgccgaaacagacattgtccagggatatacagaaatcaaaggcttttctgtggactcgataccaccagctacacctcctacaccgaccttcaccagctcggccgggtccgatgagatacgcttcgtgtgaatttggtggtgatgacagatgcccacacaatcctgtccctatgctacagtttcttgatgttatggtcgagctgtatacgaaatcttactgtttcgtcaagtttatgcgtgacaatatgctacaatcgaataatatcgaggtctatggcgtgatcgcagt

SEQ ID NO: 103621 - DNA, 519 bp, Triticum aestivum
  Clone ID: PAT_TA_103621
tggggtgtatattagtactggtttactgctacatgttattttcttttacctaacaaaaaacaagtcgggagagacgaaggggatgttctgatggacatggacatggacatggactggctggctagctaggggagcggccggtctggctggacggtggtcggcgggctagcctagctagacgacggagctggagcaggcggagggggcgacgatctccacggagccgtagtgggtgagctccctgatcatctcctcgatgcactcctcctcctcgtccacgcgcttgacgacgtcctcgaccctgtttcggcgagcggcgccgcctccggtcctcgccgccttggtcgcctcgacgttttgcaccggcggcgccgtcgccatgcagcatttctccagcttggcgcgcagggtcgcggagaggccgccgccggcggcggcggcaacaccgttggtggaggggaagttggtgcgcgccgctggcccgctcatgagcctcgccgcctcgtcgtacgcccgcgc

SEQ ID NO: 103622 - DNA, 587 bp, Triticum aestivum
  Clone ID: PAT_TA_103622
caacaaggtcagcagccaggacaagggcagcaaccgggacaagggcagccatggtactacccaacttctccgcaggagtcaggacaagggcaacagccaggacaatggcaacaaccaggacaagggcaaccagggtactacctaacttctccgttgcagctaggacaagggcaacaagggtactacccaacttctctgcaacaaccaggacaagggcagcaaccaggacaatggcaacaatcgggacaagggcaacattggtactacccaacttctccgcagctgtcaggacaagggcaacggccaggacaatggctgcaaccaggacaagggcaacaagggtactacccaacttctccgcaacagccaggacaagggcaacaactaggacaatggctgcaaccaggacaagggcaacaagggtactacccaacttctctgcaacagacaggacaagggcagcaatcaggacaagggcaacaaggctactacagctcataccatgttagcgtggagcaccaggcggccagcctaaaggtggcaaaggcgcagcagctcgcggcacagctgccggcaatgtgccggct

SEQ ID NO: 103623 - DNA, 508 bp, Triticum aestivum
  unsure (1)..(508): unsure at all n locations
  Clone ID: PAT_TA_103623
cacgagtaaacaaaaaagaaaataccaccatggtaaatttattcactttcagacaagatcaacccgtcccctttttgttttgttgctatgtatcagcaatgtcaatcatctactatatgggtatgcgaccatggtgggtggacggctgatcgatctgtctcactcctcctgctccttctgctccggccagtcgccgtagatgccgccgatcttccgttggctcatgagcatcagtctgttgggctttttgccaccgttctcctcggtcatctgggcaagacgatcacgcgcggccgggggaatcaccggcgggtacgggtacgccctggcggtgcccggggcggcgtancgcggccctggggatgtcagcaccttctggtccccggtgaggcgaatcgcatgacctgatggtgcagcgtgggggaaggcgcacctgtccccgaaatggcaggtgcccgtgtccctgaagttgaagcacaccttgccgccgccgttgacaaccctgccg

SEQ ID NO: 103624 - DNA, 469 bp, Triticum aestivum
  Clone ID: PAT_TA_103624
gttgtggtcaatactcaaatccaccatgaagacctttctcatccttgccctccttgctatcgtggcgacgcaccgccacatagcgtgcagttagagttccagtgccacaattgcagccacaaaatccatctaaacaacacccacaagagcaagttccgttggtacaacaacaacagtttctacggcagcaacaatcatttccaccacaacgaccatatccacaggcgcaaccattttcatcacaacaaccatatctgcagctgcaaccattttcgtagccggaactaccatatttgcaggcacaaccatttcgaccacaacgaccatgtgcacaaccgcaaccacaatattgggaaccacaacaaccaatttcacagcggcaacaacaacaacaacaacaactacaacaacaacaacaacaacaacaacaacaacaacaacgacaacaacaacaacaacaacaacagca

SEQ ID NO: 103625 - DNA, 307 bp, Triticum aestivum
  Clone ID: PAT_TA_103625
gcgtctctctccgcccccccccgcgtctccattgccttctccgttcccccaccccacgcctcgtccgcgggcggcgacgcgacgagacgagagcggcggcggcgccggcggaggcacgaatgcggatgttctccaaggcctgctcgctcgtcatctcctccctcccgcgctggtactcctccgcccccgcgattaggggccagccgtcgtggataccgagggtgaccaagaaatggctcgggaagccgctcatgtacgggatcggcactctgctggtcatgcccctgaagaccatccacggggtggg

SEQ ID NO: 103626 - DNA, 192 bp, Triticum aestivum
  Clone ID: PAT_TA_103626
tcaacccggcgttcggcgaccgccccgtgaaggacgcggcgcgccaccttctcttccaccgcgccatgggcttaaccccgtcgggcgacgcgcactggcgtgccctccgccgtctcgccgcggcgcacctgttctgcccgcgccgagtggcggcctccgcaccctaccgatcctctattgggacgcgcatgc

SEQ ID NO: 103627 - DNA, 443 bp, Triticum aestivum
  Clone ID: PAT_TA_103627
cacaagcttttgcaacaaagtacttaccagctggtgcaacaattgggttgtcagaagctgtggcagatccccgagcagtcgcggtgccaagccatccacaatgtagatcatgctattattctgcatcatcatcaacaacaacaacaacaacaacaacaaccgatgacccaagtctccttccaacagcctcaacaacaatatacatgaggccagggctccttccagccatctcagcaaaacccacaggcccagggctctgtccagcctcaacaactgccccagtttgaggaaataaggaacctagcgctagagacgctacctgcaatgtgcaatgtctatatccctccatattgcaccattgctcaagttggcatcttcggtactaactgagaagagaagaactctagtagtagatatatgatacaccgtcttcttattccatg

SEQ ID NO: 103628 - DNA, 268 bp, Triticum aestivum
  Clone ID: PAT_TA_103628
tgcaagcgcggatcgccgccgccgcccaccgctcctctacttcccatgggcccgagaaaacgtagccaagcacccgaagcaaccggagcggcgagtggcggaggaagggagagagcggcgggggaatggggtgatggcatcggtagctgcgggggtgcagacgatgcgggcgtcgcacatcctgatcaggcacgagtagtcccgacgcgaggcatcctggaaggaccccgggggccgagtaatttccgccactacctgcgccgatgcc

SEQ ID NO: 103629 - DNA, 362 bp, Triticum aestivum
  Clone ID: PAT_TA_103629
ccgccaggccctacctcacgaggcgctccgcttcctcggcgactgcgacgcggcgctcggcgtctggggcgccggcggcgtgggcaagaccacggtgctgaggcgggtgcgcgacgtgtgcggccgcgtcgcgccattcttcgaccacgtcctcctgctggcggcctccagggactgcacggtggcgaaactccagaaggaggtcgtggccgtgctcggcctccgcgacgcgccaaccgagcaggcgcaggccgccgggatcctgagcttcctgagggacaagagcttcctgctcctgctggacggcgtgtgggagcggctggacctggagagggtcggcttccctcatcccttgggggtgg

SEQ ID NO: 103630 - DNA, 457 bp, Triticum aestivum
  Clone ID: PAT_TA_103630
caagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaacccccactaccatttccgcggcaac

SEQ ID NO: 103631 - DNA, 175 bp, Triticum aestivum
  Clone ID: PAT_TA_103631
gcaccaggttctctgcactgccgttagtagcgctccgagagaggggaacgaggtgctggtccagcatctgcttgtcggcgaaaaggatgccaggcttctcgtggatttggagaagagcatcgcatcaggggcggacctgagtgacttagccgtggagcactccttatgtgcatca

SEQ ID NO: 103632 - DNA, 431 bp, Triticum aestivum
  Clone ID: PAT_TA_103632
tcgtgccgattttattgatgtatacccaggaacaaagcactcagcatacacagatacttcttgaatttaatttgaaaatctccaggtttcaggtacggcattattcttctctcttataggcactggtgtcagtatgacacgaacgatgatcccaaaaaaactgccatttttgtctctttgtctctctcggccagcagtacgaaggacggcactgtcgccgcgtctcttgtctcacaccggcaggtcaagcagcaggccgatgtggccgcactcggcgcccgagctgctggccgcgtcggagcgcgccggcggcgacctcatcacgcgcgttgacggcccgaacccgagcgtcagctccagcccaatttcgtcgtcgtcgcgggccacctgcggcagcactggggggttccgctctgcctggctgacgtgcg

SEQ ID NO: 103633 - DNA, 258 bp, Triticum aestivum
  Clone ID: PAT_TA_103633
tccattccattccattctacagaatatagcaaacaacagcgagatgctgccattacatcaacgaccacgaaccccagacactctaatctggtggtggtggcctagcctccgaatccgtagagggtgcgtccctggcgcttgagtgcgtagacgacgtccatggcggtgacggtctttttgctggcgtgctcggtgtaggtgacggcgtcgcggatgacgttctcgaggaagatcttgagcacgccgcgggtctcctcg

SEQ ID NO: 103634 - DNA, 175 bp, Triticum aestivum
  Clone ID: PAT_TA_103634
cacacgccacatttatggaatagctaacgagcatgcctgcctaaacaccaagcgagctgcacatagaacaatcactggcgggccaacaatgcgtcaccgtcctctagcccgcacattgacggaagatgtgccgctagctgctgtgcctttgccacctttaggcaggacaactggt

SEQ ID NO: 103635 - DNA, 499 bp, Triticum aestivum
  Clone ID: PAT_TA_103635
cttactcatcgtaacaatccttgcgatggcaacaaccatcgccaccgccaatatgcaagtcgaccccggctaccaagtacaatggccacaacaacaaccattcccccagccccaacaaccattctgccagcaaccacaacaaactattccccaaccccatcaaacgttccaccatcaaccacagcaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcggccccaactgccgcaacaatcattcccccagccacaacaaccggtgattcagctatctctacaacaacggatgaacccctgcaagaattttctcttg

SEQ ID NO: 103636 - DNA, 509 bp, Triticum aestivum
  Clone ID: PAT_TA_103636
gtagtagttaacgcaaatctaccatgaagaccttactcatcctgacactccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatatccccagcaaccacaacaaccgttccctcagactcaacaaccccaacaaccatttccccagtccaagcaaccacaacaaccttttccccagccccaacaaccgcaacaatcattcccccaacaacaaccatcattgattcaacaatctctacaacaacagttgaacccatgcaagaatttcctcttgcagcaatgcaaacctgtgtccttg

SEQ ID NO: 103637 - DNA, 236 bp, Triticum aestivum
  Clone ID: PAT_TA_103637
ctgggcctgtcaaaacaaatatggcgtccaagtccaactgcgttctcctcttggccgccgtcctactctacatctttgccgccgttgccgtcatcggcgatgaagattgcaccccatggatgagtactctgatcactccactcccaagctgccgtgactatgtggaacaacaagcatgtcgcatcgaaacgcccgggtcggcgtacctcggcaatcagcactgctgtggggagctt

SEQ ID NO: 103638 - DNA, 305 bp, Triticum aestivum
  Clone ID: PAT_TA_103638
tacagcatatcagcaccatgagctttgtacgagtagaccaaacagttcatcacaaggttaccacaatcctcatataagaagcatactgcattgcatcctaagaaggatgaaatgcggagtttcaactaccattttgcacatgaagttatccccacattcccaatcttgccaatgtggtggtggtgtaggcgaagttaaagagaaaggacggcacaagtgcacaccagctgatgaaagccattgtaacagcagtcctcaaccttaaacaaggaagggcttcgcagtacttcacatcattatcaatc

SEQ ID NO: 103639 - DNA, 415 bp, Triticum aestivum
  Clone ID: PAT_TA_103639
tgtttgtctttcattcccatgtttgaactagtatagttcgggttcttacatgatagtgcatgtcactttattttttcaccgctacaacgaccaaaccatggactaagaaaacggtgtatcatatatctactactagagttcttctcttctcagttagtaccgaagatgccaactggagcaatggtgcaatatggagggatatagacattgcacattgcaggtagcgtctgtagcgctaggttccttattgcctcaaactggggcagttgttgaggctggaaagagccctgggcctgtgggttttgctgagatggttggaagaagccctggcctgatggatattgttgctgaggctgttggaaggagacttggctcaacggttgttgttgttgttgttgttgttgttgttggtggg

SEQ ID NO: 103640 - DNA, 258 bp, Triticum aestivum
  Clone ID: PAT_TA_103640
aatcaggatactacccaacttctgcgcagcatccaggacaattgcaacaatcaacacaagagcagcaattaggacaagagcaacaagatcagcagtcaggacaagggcgacaaggtcaacagtcaggacaaaggcaacaagatcagcagtcacgacaagggcagcaacctggtacataggcagccaacgtactactcaacttctccgcaactattaggacaaggccaaccaaggtactacccaacttctccgtagcag

SEQ ID NO: 103641 - DNA, 357 bp, Triticum aestivum
  Clone ID: PAT_TA_103641
gcaaggatcatactgcccgcgcacctcgttcattaccagaaaaaacagtcggtaaatctgtcattcacatgcaggtattcgactctgtatatgcaagcaatggatgttgttcgcctgggtgacgcaagtgcggaagcgtttgagcatatgtgagctggtctgaaggcgttgatggtgagtggggcaccatttgcagagaaaagggatggtttgggtttttaggaccatttggcaaatctgccactagggaagcttcctggcaatggaggggttgcatttttatggaatggcgccgcagagcatgaagacagtgggtgcctctcggcgaatgtgaatgcacttcaaggactagctgct

SEQ ID NO: 103642 - DNA, 290 bp, Triticum aestivum
  Clone ID: PAT_TA_103642
ccgccccgccccgcccctccgccattccctcctgcccgctcgccaattttaaacgctttccccagccgccagccgctcgctcgcccggcggcgatccggggcggggcgcgatggaggcgccgacggcggcgccgcgggtgcggtcgatccgggagaggtgctggagagcgtggcggcgtaccaccagcagtatatgatgcgccgcgtgttccgcaagagcctctcctacgccggggagctctcctccgcgggggcctcctcctccgcctccctcgccttgctcgccgggc

SEQ ID NO: 103643 - DNA, 448 bp, Triticum aestivum
  Clone ID: PAT_TA_103643
agcgagaagatgtcgggccgtggcaagggaggcaaggggctcggcaagggcggcgccaagcgccaccggaaggtgctgcgcgacaacatccagggcatcaccaagccggcgatccgccgtctggcgaggaggggcggcgtgaagcgcatctcggggctcatctacgaagagacccgcggcgtgctcaagatcttcctcgagaacgtcatccgcgacgccgtcacctacaccgagcacgcccgccgcaagaccgtcaccgccatggacgtcgtctacgctctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaact

SEQ ID NO: 103644 - DNA, 449 bp, Triticum aestivum
  Clone ID: PAT_TA_103644
acagttttattacatccaaatacagtaaatgcagttcaacaactgtccttctgcgtgcgaaccacacttagcttgtcgggctaaaggagatgatgcgacgcatgttgcttgtgttgtccttgatcaacaccacctcgtatcttccatgtttgtcatcgtgattaactgtgtcgacaacgaggtgatatttgacaccggccacattttgttcccctccccctgttaccttgctaaacttgagcccgtcatgcacctgcttgacatgctccaccactgtccacctaccgatgtcctggacatgtggttcattgacattctcaataggagaccaatattccccggcggacgtggcagggtaaacaatggtgagagcagcaaggacaacaaggaggatgttgcaagtcctcatggcagttggttttgtggcaaggtatgctcctttggatcgg

SEQ ID NO: 103645 - DNA, 481 bp, Triticum aestivum
  Clone ID: PAT_TA_103645
tcaacccacggtgtatcttatccgctcccctcctagcacggcggaggaggagagggtgaggggcggcgccgcactctccaacttctgtctacacaccacctacgcgccgtcgtccgtccgggtggtcggcggcggctaccgcgccccggaggtggcgtctactccctgggcgtgctcctgctggagctcctcatggcaagtccccgacgcacgcgtcagggcgccggcgacgtacgtcctccttctcttctttcacgagacggctccgggcttcgaccaaatcccgcccaactcgcccagatcgaggccttcaggcttttgtggaatcctcgttcaactctccgcctctaccagatccacgctgaggggcttcggcgccatcccccggtgtgatttcctcatgggtcccggcttgatcgaggccaaaggcttcggccgtccgttcaccatggctgggacctgcgcggaaactgtagatgaa

SEQ ID NO: 103646 - DNA, 230 bp, Triticum aestivum
  Clone ID: PAT_TA_103646
acgcgcgccgcaagaccgtcaccgccatggacgtcgtctacgcgctcaagcgccagggccgcaccctctacggcttcggcggctaggctttcctttcctcgtggcggcttgtttacggagggagtgcctgttcatcctgttggtgttggtagtttggtgccgaatgttgtgttcctgatgtaaccgtgccctgttgcagtgaagtaaatcctggtgtcttaaaaaaaaaa

SEQ ID NO: 103647 - DNA, 177 bp, Triticum aestivum
  Clone ID: PAT_TA_103647
ttatatccttcagtatccatattgagagtatgaaattgtcttggcgatacaaatttatttgtttgaaacaaactcagataaataatttcaaccattgtttaaatcatacatagttccgtagaaacccaccggttcaaggttgaaataatcaaatcttatctagtgggtcacttaaag

SEQ ID NO: 103648 - DNA, 172 bp, Triticum aestivum
  Clone ID: PAT_TA_103648
tgttctgggggctcctcatattcatgctcgtggcgacaacaatggcggtcgtagtgtggtgcaaggaaccataacagtggtccttggagttggtgcgatccggcgacgggctacaatgtgagcgcactcaccggctgccgggcaatggagaaactccattgtgtgggcagtc

SEQ ID NO: 103649 - DNA, 577 bp, Triticum aestivum
  Clone ID: PAT_TA_103649
acaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcaaaccatccccgcaatgtgcgacgtgcatgttccaccatact

SEQ ID NO: 103650 - DNA, 433 bp, Triticum aestivum
  Clone ID: PAT_TA_103650
ttaccgaagcagaatagaaatacagtaattaaacgacagacagatcattgctcgctcgggataagagtctgaagcaacaaaagcaatgaccgtgaacaaaatccttctgcaagatagcgcgcctatttcttcttgatggcagccttggtaaccttggcgccggtggggtccttcttctccacacccttgatgacaccaacagcaaccgtttgtctcatgtcacgcacagcgaagcggccaagaggagggtaggtggcaaaggtctccacaaccatgggcttggtgggaatcatcttcacgataccagcgtcaccgttcttcaggaacttgggcgcagcctcaatctccttaccagatcgcctgtcaatcttggtcaccagctcagcaaacttgacagcaatgtgggaggtgtggcagtccagcactggggcgt

SEQ ID NO: 103651 - DNA, 347 bp, Triticum aestivum
  Clone ID: PAT_TA_103651
tgttttgtcttcataatccacataattgcctatctattgactgcaaaaaatatcccactggtttaaacaaaaagtccctgattgcctctcgatactccctataatccataatagcctagaatgttggatacagaattgcccaacgaatttgataggggggaatgcctcctgcgtactaatcccccttgctctccaacgaatttaaaagaatttgatgggacaaaaatgggcgccatccatgctcaccttcacctagtgaggccccccttgagctgcagcgtcctctccacccttgctcttggagatgctcactgtcagtgtgctcttatggtagttgcacacgggcc

SEQ ID NO: 103652 - DNA, 269 bp, Triticum aestivum
  Clone ID: PAT_TA_103652
ggaggcgatcaggtcattggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttacttagcagatgcaccaatcgatgtaacgatgacaaataaagtggcgtgcaccatcatgtgtgaccccgaccagtgctagttcaagcttgggaataaaagacaa

SEQ ID NO: 103653 - DNA, 576 bp, Triticum aestivum
  Clone ID: PAT_TA_103653
ctgtggcacaactgttgcagtaaatccttgttttgtggattcttgtcgccatacaacattggcagctaaaaacttgcccctgccctttaagttatcaaaactatataagaatttatatcttgtatttgtgttcagcccatataaaattgtccacagcataagtacaatcatcttgacggctaactgtgaagtttagatctgcctgcaagagaaaatccttatctcgtatcgaaaagaaatcttaaggagctgtaaaggcatatctatagaacatcaaagcaatgtgtgtattagtacatcaaagcaatgtgtgtattagtgtatcatgccatattgaaacaaaaaattgcgagttctcaagcagaaattacttctgcattaggatattgctaaattgggcattttattatgagaatcgtgtagagcatcatcttcctacctggtagtaagtgttgcaatggtaagatttccgaataacaaacttatattcaagtccttaccactagacagtgaaatacaaacaccagaaatttgcccagttagctgaaccgatcttatgcccatatatatatttat

SEQ ID NO: 103654 - DNA, 554 bp, Triticum aestivum
  Clone ID: PAT_TA_103654
tatatctggttgtttgcagtatgccttgtttatttcagttgttcacaatgtgatgctctatatgtgcaattatttaccgtgcagtacatttcataaatccagttttaaacataccaataggaatgcatatatttgcttgttgttaagcctgttatagctagcatatgcctcttttaaagttttttgattgttcagttgtttgtagttagcatatgtccagtttcaaatgctatatttggttgttcgtagtatgccttgtttattccagtgattcacaacgtgatgttctatatgtgcaagtatgaactgtgcagtttaatttcatcagtagcattttcaacaataccactatgaatgactacatttggttgctgcatcttgtagttaacatgcttttccatttttatttaacaataaccagtgtacttagaccagcacaataccagtttgaatgactatgtttgcttgttgttaaatgttacgcatgttgcagttagcacacctttccacttgttttgctttactagcgtgcttaaacctgcacattgaagcta

SEQ ID NO: 103655 - DNA, 100 bp, Triticum aestivum
  unsure (1)..(100): unsure at all n locations
  Clone ID: PAT_TA_103655
aggagatggattctcatgttggtagtggtaaagttatcacagcnccacttatcactgaggatggaagacctattaaggatcctttggttttacttgaggc

SEQ ID NO: 103656 - DNA, 178 bp, Triticum aestivum
  Clone ID: PAT_TA_103656
agaaatccccgctacccggcaccagcagcagtccccactcgggagccatgcgtccggccggcggcagcctcccggcccagccgggcacgccgggccgcccgcgccgccgcccggatctcaccctcccgatgccgcagcgcccggacgtctcctcctcgctcgccgtgccgctgccgct

SEQ ID NO: 103657 - DNA, 102 bp, Triticum aestivum
  Clone ID: PAT_TA_103657
aaatcacattagtagtcactagctcgcgagcgccggccggagatgatgtcgacgatggcggagctggcatggcgctttgcggccgcacacgtcctgctgttg

SEQ ID NO: 103658 - DNA, 183 bp, Triticum aestivum
  Clone ID: PAT_TA_103658
tcgccgcgatggtggtgctgctgtccgtcaccgtggcggagagcgccaccgtggagtaccagttcgaggtggcgaccatgaacgtgacgcggctgtgcggctgcaagagcctcgtggtggtttttcttcagttccccggcccctcggtgtgggcgagggagggcgacctcgtcgtcgtccggg

SEQ ID NO: 103659 - DNA, 166 bp, Triticum aestivum
  Clone ID: PAT_TA_103659
cgatctgggtaatcgacgagccatccgacgcttggtctggcaagcatccactccatgggcgcgtacacaggcggaggaggcggcagttccgcggcatcagtggtgatgttggaggcagaggcctcatcctcgtactcgatcccgccccctacagcaacctgttcgt

SEQ ID NO: 103660 - DNA, 242 bp, Triticum aestivum
  Clone ID: PAT_TA_103660
ttccagcaagcaagccgaacactagatcctcgatggctcgcatggcactgctcgccgtgttcgccgtgctcgcggcactggctgtggcggagatggcgtctggggcggtgacctgcggcgacgtgacgtccgccatcgcgccgtgcatgtcctacgcgacggggaatgcgtcggcaccgtcggcggggtgctgcggcggggtgaggaccctgaacggcaaggcgttcacctcggccgaccgg

SEQ ID NO: 103661 - DNA, 189 bp, Triticum aestivum
  Clone ID: PAT_TA_103661
cccattgttctgcaatacaacgaaacatatgggatgcggcgctgacactggccacagggtttgatgtggacgttgtctttaccagaacggatggatttacggagacacgagagtggttccttctcaattgcttaaatctaaatcttcgacatggttggattgctgtttttgtaagcaagtttatcatga

SEQ ID NO: 103662 - DNA, 292 bp, Triticum aestivum
  unsure (1)..(292): unsure at all n locations
  Clone ID: PAT_TA_103662
gtttccctcaaaccaaaagtattcctctgctcctgcacgcccgcggccattggcgaatccggagccagcaagccgccgggaccggacgaggcggcgccggagcggcgagctgacgagccggcgcgcacggacggcgccggcaacacccctcccccgccgttcctggaggtgacctgcaggagctccggcgaggtgcggcggttcgcggcggggacgaccgcccggtncgcgctgcacgcggtgaaccgcaagctggcccccggcgccccggcggcgctgcacgtggaggcgg

SEQ ID NO: 103663 - DNA, 302 bp, Triticum aestivum
  Clone ID: PAT_TA_103663
cgtccgtggtgaccgtgctggccgtggcagtgatcgttcgggccgtggtggtgatgctccgccctgagaagctgcagctcaagctctccggcggccgcgtggcagtcgactggatcccgtcgatgccgccgccgggcaacgaggtggcgctcaacttcgtcctagtggccaacaactttctcgggcgcgcctccgtcgagtgcaccaacgtcaccgtccggctgacggacgtcacgagcgcgtcgtcgccgtcgccgccgacgatcgccgagttcgacctgccggagtccctcccggtgctg

SEQ ID NO: 103664 - DNA, 442 bp, Triticum aestivum
  Clone ID: PAT_TA_103664
aggccaacatgacgctgcggtgcatgcaggcgctggtgcgcgtccaggcgcgggtgcgcgaccagcggctgcgactctcccaggagtccttgtccgccgccggtgcggctgcgtgcggcagcagcaaatcctcgtacagcgttgacacctccgctttctgggactccaagtacacccaagaatacgccgaacgccgctctgtggtccgtctctaccaaccagcattcgcatctgtcgatctcgtggcgctgcttgttagtacaagtttgattgtgatggattgattgggttgcaggagcggtcgcgagacggcagcagcttcgccgccgaagactgggacgaccggccgcggacgatagaggagattcaggcgatgctgcagacgaggaaagacgctgctctcaagcgtgagagagcgctctcatacgccttttctcaccaa

SEQ ID NO: 103665 - DNA, 150 bp, Triticum aestivum
  Clone ID: PAT_TA_103665
tgtcggcgcggctcacgccagcacgcgccgtcgacatgctcaaactcgccaggctctgcgacgcgcggcggctgtacctgcgctgcgcgcggctcgccgccaaggacttctccgccgtcgagcggtcggacgggtggcgcttcgcccgcc

SEQ ID NO: 103666 - DNA, 401 bp, Triticum aestivum
  Clone ID: PAT_TA_103666
tgctgcacgatgcattggattgctggggtgagtccagcaatggccaagccgagctcagcgggcaggtctctggagacggagagagcagcagcagctactggagcggcatcctcggcatggtggtcacctcggagctgccaccatcccacccccacccaccagcatttctctaggacgacggccgtctctacattcttcttcttttcggccagggcttccgccgaaatcgaccgaatcctccgaaatcggaagaaaatagcaagaggaagagcacgacactgcgattctaccacaactgcttcatcgacaggtcgctgtttttcgctcatcttcatgtgtaattagctgctactactgtattgtgaccctgaggatgcagtaaataaacgcatattgctttc

SEQ ID NO: 103667 - DNA, 365 bp, Triticum aestivum
  Clone ID: PAT_TA_103667
ggggttcagatggccgtgtacttctgaattctgatccatccatggggtaattcatggctaatagtcgatccatcaaagttgatctatgtccttgggagcccttctgaagaaattagtactgtcatgggggcagctcttaacctggctgattttccagtaccacaatggaccattgagaagcttccttgaagctaaattcttttccagaaaatacaaacttctatcacgggctggtactgctgagctctcattcccctccattcgaactggatgttataccatgcacgttagatgctctaccaaacagtggcttcagaataacatgtcggctagtttaccgtagtcaatatgattaccactctttg

SEQ ID NO: 103668 - DNA, 513 bp, Triticum aestivum
  Clone ID: PAT_TA_103668
tcgcgtttctgctatgcctgctcctacacgccatgctcttcgccgctgctgcaaaccgccgtcgcctcgcgtcgctgcaccgctgctccactgcagctccggcgaagcagcctgcgccgtcgtcgtcgtgcgctgcatcgcaacttccgccatggccgccgcgtgctgcatcgcagcatccgctgtcatcgccggcgctgcaatgaagcgcggccggggctgcaatggagcgccgccggggtcgttggagctccgccggggctgcattggagcttcgtcgatggctcagtgcagcgccgcagtggctcgatgcaacgtcgctggcggctctcaagggaagctcttggtgttgcattggagcgctcgccgtcggctccattgcagctccgccggagcgctcgccagccgctagacgtagcgttttggtgttgctatggagctctggtcatggcagctctccggtgctgcggcgacatgcggtgctgtgagatcgaagcacgggggctggttgaa

SEQ ID NO: 103669 - DNA, 543 bp, Triticum aestivum
  Clone ID: PAT_TA_103669
gccgcaatttctggggatgacaatagaaagcactttcaagcttgcatttgatgaggatcagcaaattgttgcagataaatggatacatattttccgcgctttgagtgacgaaagaggaccatggtctgctagtccctttccaaataatttggtgacatactggaaacatgacaagacagaggataaatggcggcggcgaatgaagctgaagcgtaattataagtttgatgaacgcatttgtcaaccactgtccaccaaatctactaatgaaaataccgccccgtctgttgatcctttcgttagtgccaagattccagaaaaaatgaagcgcttccttctgaaaggagtgcgtggaatcacaggggatgttggttctgaatcatgcgaggataacaatgatacaagtgagccttcccaaaataaaccatcagagaatcaggtgtcaagtgatgctgcaaattctgcagactcttcagattatcctactagtagtgtgcaaaataggaaagaacaatcatctactggtggagataatgattatgc

SEQ ID NO: 103670 - DNA, 258 bp, Triticum aestivum
  Clone ID: PAT_TA_103670
ggctggccgccgccctggactcaacgcggccgcccatcccaggcggtgagcctcgtcagggcgtggtcacgctccgccagtacaccccggactccggcgccaagaggtcgctcacctccagattcgccgccgcccagctgaaccggaccgccaccctggacgcattcgggctcgccgcgtacgacgctgtgtggatggcggcccgcgccatcgacgagttcctggaagaggggggaacgtcaccttctcggccgaccc

SEQ ID NO: 103671 - DNA, 388 bp, Triticum aestivum
  Clone ID: PAT_TA_103671
ccttcctctcgtgcccggcgtccgtctccagggtccgggggcgagagagcggccaccggagcgtctcaggccagctgctcccgcgcattccaccggcgcgctccgtcgaggtttggttagttgtctggtgtaaacaaatgaaggtgctgctgatttagttcgcccattcgacgactcatcagatggatcatctcactcttatgagaagccctttccgtcttctgctctcactgcatttgttactatccttattcaaccctctggcagtagcagatttggcctctgagagccaagcccttcttgacttcgcctctgcagtctaccgcggcaacaagcttaactggggtcaaggtacaccaccgtgttcatggcatggtgtcaaatgctc

SEQ ID NO: 103672 - DNA, 511 bp, Triticum aestivum
  Clone ID: PAT_TA_103672
tactattggatattctctgttaaggagcagtggtagaagtgatcctgctatgcagaatgctaacgctattgatggaagtaaaattaggactggagaaagcaatgcaattgattgtattcaggcaaaagatcactcaactggcagaacagaaatagcatcatgcctacgagttgctgaggttgcacaagtacgggtagctgctgcagaatcatcaatccagacagcctatctttctgtaaatgataaagttgaactggatgtaaaatatgctgatgaattaggttatacctttagtgaagcacttggagtagcacctgtgaagattgagacaaactatcctgatgttttgtcaattgtcatgcccagagatgtcaatggtacatatggcgcacatcaacgttttgtgctacaggcgagaagccatgggacagctcttgtaaggttgcacataaaccatccttccagaaaatcagatttcataatggtatctgttggtgcgcgaatgtatcct

SEQ ID NO: 103673 - DNA, 407 bp, Triticum aestivum
  Clone ID: PAT_TA_103673
acgaggaaaggagtcacatggcggccacggcggccgaggagccgcaggagccccgacggggcgtcgacggcgagctgagcggactcgaccccggccccgggtcgtgtgaagcggcgcccgcccgcgaaccggtgcccacggagatgccggcggcggcggaggcggagtcctcgtcgatgagaaagcttgggcggctcttcaggctcaccgaagtgcacctctgggatgatttttatgtgaagcctcacgattggcgtgccactgagacggttggttgcacgggatctcaaacagccaaaacccgcaacaaagcagccaagcagacagatgaagaccattcatttgttgaagatatggaattggctagtctcatgggttctttggggcttcctgtttcattcagcaca

SEQ ID NO: 103674 - DNA, 309 bp, Triticum aestivum
  Clone ID: PAT_TA_103674
gctgcaccagacgaccagcttcctcggcaccgccccgcggagcgatgacctcgtccgcatcgtcggcgacttcggcggccgcatcaccatgcgccggaccgtcaagagcgcgccccagagcatctggtacaggcctgaccgtcccaagtacctgggcccgttctccgagcagaccccgtcgtacctgaccggcgagttgcccggcgactacggatgggacaccgtcggattgtctgctgacccagagaccttcgccaagaaccgggagctggaggtgatccactcgcggtgggcgatgctcggcgccct

SEQ ID NO: 103675 - DNA, 616 bp, Triticum aestivum
  Clone ID: PAT_TA_103675
taccaggctgcggccatggcggacctggttgttgggttggccaagtcggtggtggagggcgcgctgaccaaggcccaggcggctatcggggaggaggcccagctccgggagagcgcgcagcgcgacctggtgttcatcacaggcgagtttgaaatgatgcactcatttctcaacgtcgccaccgcggagcgcgtggagaacaaggtggtgatgacctgggtgcggcaggtccgcgagctggcctacgatgtggaggactgcatcgagtttgttgtccacctcgaccccaagactggttggtggtggcgcatgctcccgccttggtgcatagggctgccaccatctcaactgtcgcttgatgaggctgtcggcgaaatcgagcagctcaaggcgagggtgaatgatgtgagtaccaggaactcgcgctacaacctcatcagcgactctggctccaaggcagccgtcatgcagcaccacatgcctgcgcctggcgcctcactcggtgcgccagcattcaacatgcttgctgagtcgagggacacagcgaggaagcagcaaggcttgggggatctcacacagttgatcaccaacaaggacaataccgaccctcaccttc

SEQ ID NO: 103676 - DNA, 405 bp, Triticum aestivum
  Clone ID: PAT_TA_103676
ccgtggggagccaccgtgaggtgtacaaggtgggcgccctcaatgcggcgctcgccgagttcatctccacgctcatcttcgtcttcgccggccagggctccggcatggccttcagcaagctgagccccgacggcgcggcgacccccgccggcctcatctcggcggcgatagcccacgccttcgcgctgttcgtggcggagtccgtgggcgccaacatctccggcgggcacgtgaacccagccgtgaccttcggcgccttcatgggcgggaacatcaccctcttgcgctgcctgctctactggatcgcgcatgtgctgggctccaccgacggctgcttcctcctgcgcttctacaccggcgggctccccaccggcaccttcgggctgattggcatcggcgcgtggg

SEQ ID NO: 103677 - DNA, 231 bp, Triticum aestivum
  Clone ID: PAT_TA_103677
agcgccgccgcaccatccaccaccagcagccgcgccatccatccatcggcgccgccagccacgaccatctccaccacgcaccaccagcaccataccatccatcctgccaacctccagcgccatcgcattcacggggcggccgaccagacaagggggctggtgccccgcgcgaccctgccatctgctgctggtcttccctactggccttctcttcttccccatcgccttcct

SEQ ID NO: 103678 - DNA, 586 bp, Triticum aestivum
  unsure (1)..(586): unsure at all n locations
  Clone ID: PAT_TA_103678
actaccagttgctcggtttggctgattacataaatgagaaattggctttngaaaaagactgacaattcgtgcgaggccgaattgacacgcaaagatgtgatcaagtgcattcaagcccagaaaatcagatttcgtggactgaatctatctggccttgatctatctaagcttgacttatcagaggtggacttcagctatgcgtgcatcgagagaaccaacttttcgtgtgctaatcttcataaagcaaagtttaggctggtggaagctgcacattctacatttgaacaggcaaatttacatgagtgtgagcttactggagcaaatcttcaagaagctgtcctggacagagcaaacgttcaaagcgcaaacctgcaagatgcatgcttaatgggatgtagcttcattgagacagatgtccgttcagcccatttacagaatgctaatcttacgggtgctgatttgaatggagctaaccttgaaggggccaatctcaagggggctaagttgtcgggtgcaaacttgcaaggggcaaatcttcagcgagcctacttgagagaagttgatttgcgtgaaactgatttaaccg

SEQ ID NO: 103679 - DNA, 399 bp, Triticum aestivum
  Clone ID: PAT_TA_103679
gcgcgggcggccctgtacctggcgtccgacgaggccaggtatgtcaacgggcacaacctcgtcgtcgacggcgggtttaccgtggggaagctgattcacacgccggatccggtgacgagtgagtgacagccatggcatggcatgacagcgacatccaaacaagcgtaatgactactccctctgtaccgaaatacatgtcgctggagtagctgattgggagtagtacccatcttccacagcatgcgcaataaattcagaaaaattaatggacgtgggcacggccgttagggcaatgtataattgtgacattttaaagatgacacataggataaatgctaagatggagaagagagatatcataataaaaagtttgtcttatcctaaaaaaaaaaaaaaaaa

SEQ ID NO: 103680 - DNA, 458 bp, Triticum aestivum
  Clone ID: PAT_TA_103680
cctcccccaactcaggccccctgatcagctcgcggccctgctcccgggtcctttccccgcatgcgatgcagcaccagctcggcggtggtggaatcctcgcctccttcacgaccgaccgcttctaggtgccgtgaacaggccatcacggtggtttgttcttcagctaggtgattaaactgatcaaggtgaataagagtccatggaggttgtcatctctcctggcagatgaaactcaattaccaaagaagcactaaaacaagaggcaaaatgatagatcttttctttcatgtaccatcaagatatttgttgggtggtcataatctaagttcttagtactagttcttcccggacatgtactaaaaataatctatgtatgcctcttgcgttttgttctcatgtactcaaatacgaaaatactcgaatgcttgctgagcagtgataaaaaaaaaaaaaaaaaa

SEQ ID NO: 103681 - DNA, 653 bp, Triticum aestivum
  Clone ID: PAT_TA_103681
catggcacaagcggcgcacgtcgtcatgctcacgagctccggtgccggccacgtcctcccggtgtccgagctggcgaagcgcctcgccgtgcgccacggcttcaccgtcactatcgtcacttacgccagcctgtccacgcccggccactcctcgccgctcgcctccctcccgccgggcgtctccgtcgccgcgctcccggaggtgtccatcagcgacctcccagccgacgcgcacttggtgacccgcatcctcaccgtcatcaaccgcgccctgccacaactacgcgacttactacgctccctcctcggcctcccggcggggatcactgccttcatgaccgacatgctctgccccgcggcgctcgccgtcagcaaggagatgggtctgcctgggtacgtcttctacacctccagcctcatgtcgctgttatcgttgctctacacgccggagctctccaggaccaccacctgcgagtgccgcgacctcccggagcccgtgatgctcccggggtgcgtgccgctgcacggcgccgatctcgtcgaacccgtccagaaccgctccgaccccgtgtacgagctcatggtcgacctcggtctcaactacctcctcgcggaaggcttcatcgtcaacaccatggacgctttggagcacg

SEQ ID NO: 103682 - DNA, 579 bp, Triticum aestivum
  Clone ID: PAT_TA_103682
ccgcctgtgggaaattggatctgcaaactgcatcaaagttttcccgcatagcaactttgtgacttgtgtccaatttaatccgacgaacgacaattgcttcatcactggatcgattgacggcaaagttcgtgtatgggacataactagatgcagcgttgtggactgggcagatgttagggacatagttacagcggtctgttaccgacctgatggaaagggtgcagtggttggaacgattactggaaattgtcggttttatgacgcatcggacaacctgctgcggttggaaactcagattgcactcagtggcaagaaatcctctttgaagagaatcacaaattttcagttctgtccaaacaacccaagtaaactaatggtaacatctgctgactccaagatcagaatgcttgacggaaccaatgtgattcagaattacagtgggctccgaagtggttcatgccagatgtcagcatccttcacaccagacggggagcacatagtttctgccagtgaagactccaacatttatgtctggaaccgtgacaaccaagatgattctgtgtggcgacaagcgaaaac

SEQ ID NO: 103683 - DNA, 313 bp, Triticum aestivum
  Clone ID: PAT_TA_103683
agcattcccttcccctctgcctccaccccatctccgtctcccctccggatggcgccgcagcagaaggtggtcgtgaaggtctcttctatgagcgacgagagggtgaagcagaaagccatggaaacggttgcagacatctatggcatcgattccatagccgcggaccacaaggatcagaagatgacggtgataggtgatatggacagcgtcgtgatcgcgaagaagctgcggaagtttgggaggatcgatatcctatccgttgggccggcgaaagaagagaagaaggatgataagaaaggggagaagaagtgat

SEQ ID NO: 103684 - DNA, 562 bp, Triticum aestivum
  Clone ID: PAT_TA_103684
tcccgccgacccatggcaggctccggcgccagcgacgacgaggtcgtcctggagatcgagcactgcatccgcgtattcaagagcggccgcgtggagcgctacttcggctccgaccccgtcccggcctctaccgacgccggcaccggcgtcgcctcgaaagaccgcacaatctcccccgacgtggccgtccgcctctacctcccgcccctcgccacggagggcgtcgatgggaagaagctacccgtcctcgtctacttccacggcggcggtttcgtcctccacaccgccttcaacgccgtcttccacgcgtacctctcctccctcgccgcgcgcgcccgggccatcgtcgtctccgtcgactaccgcctcgcgcccgagcaccccctccccgccgcctacgacgactcctggcaagccctacgctgggtggcgtcccacgcccccggcggcgccggcgaggagccctggctcgccgaccacggcgacttctcccgcctgtccctcggcggcgagagcgcgggcgccaacatcgcgcaccacctggcgatgcgcgccggcgccg

SEQ ID NO: 103685 - DNA, 420 bp, Triticum aestivum
  Clone ID: PAT_TA_103685
ctacatcaccttcatgcagatggttatgttggccgtgggggtgttatgggagaggatgacatagttcataagcatagacatttcgttgatcgtgttaacacatgtcaaacatgcgttttgttgtccagaggtcatctttttttgagaccacaagttttagaagctggtttgaacaggcatgatatattcaatctagatcgcttccgggagaggcttctacatggtgttatacttcctagagggattggcaaattgaaggcccttcactcactaggtgttgttaatggttccgggagaaacggaaatgtcactgtaaaagagtttggagagcttactcagctacgtaagcttaaagtgggtggtctgagctacagaaacatcaatgagttatggtctgccattgctggtcataattcaact

SEQ ID NO: 103686 - DNA, 684 bp, Triticum aestivum
  Clone ID: PAT_TA_103686
aaaccaccacgccccgccgctctccctcctcctctccctctctccatggcataaggccgcggcaagaagaagctagcttccctcacctgcaagagcggcattgctgctctttcctccggccagctactgtagttcttggtcggcatggcggcgggattgctgctgccgcaggcggccaggctctgcttctgcgtctgggccgtcgccgtcctctcgctcgccggctcctcggccgccgtgaacggcacgagcgcggtcagcgaggcggtggtggtggacgcgcgggccgccgtggcggagacggactcggcgttcgtgtgcgcgacattggactggtggccgccggagaagtgcgactacggcacctgcgcctggggccgcgccggcctcctcaacctggacctgtccagcaagatcctgcagaacgccgtgaaagccttctcccctctccggctacggctcggcggctccctgcaggacctggtggtctacggcaccggcgacaccggtgcgccctgctctcccttcaccaagaacacgtcggccatgttcgggttcacgcagggctgcctgcccatgcaccggtgggatgagctcaacgccttcttccagaaatccggtgcacagattgtctttgggctgaatgcgctgaatggccgggtcccaatgcctgatggctccatg

SEQ ID NO: 103687 - DNA, 484 bp, Triticum aestivum
  Clone ID: PAT_TA_103687
agagagagagagagatcgcctcgcgcccgcaccccaggaaggtaagttcaagggctgtcctgagaagctcaaatggctcccaaagttgctgttgccaagaagggcgatgccaaggcccatgccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactcgtcttcatcgtcgacctgaaggccgacaagaagaagattaaggccgctgtcaagaaaatgtacgacattcaggccaagaaggttaacaccctcatcatgcctgatggcaagaagaaggcgtacgtgaagctgacac

SEQ ID NO: 103688 - DNA, 312 bp, Triticum aestivum
  Clone ID: PAT_TA_103688
acagcatcggacatcgtggccgatgcaggcgaccacggtgcccttcaccaccggtcgttgttgtccagctttctcttgatttgttattaggtcatacaagtgcttgccggcgattgtggagatgaagcggaagcagtgtgacaccggcttgccgttgctaccaatctgaatccaacgtaacaacagatctcatctccctaatctgaatattacagaatatggacgaggagcatgacagggaggctgtcgctcatccaatctcgccggcgtgttagcccttactctagcattgttgagtaatcgacatgcgtg

SEQ ID NO: 103689 - DNA, 229 bp, Triticum aestivum
  Clone ID: PAT_TA_103689
gcttcgtcggctaccaccgtcgcacccttccaggggctcaagtccacggccggtctgcccgtcagccgccgctccagcggcagcctcggcagcgtcagcaatggcggaaggatcaggtgcatgcaggtatgtcgaggcacaaaactgatatgagtttcttcctcagtacgtacaatttactagcacgaagtgttaagcagttgtgtgcattccataatttccattcact

SEQ ID NO: 103690 - DNA, 186 bp, Triticum aestivum
  Clone ID: PAT_TA_103690
gatgggtgaacaaccgggaggaagatgcacgccccgtagaccggcgggtagtccaagagggacacatccgagaagctctgccacaaccaaccaggtacaggtccaagcagtccacaacgttcccgcagtggccaccctggccatgggcaccggcaccgacgccgactactagttctccgccgatgc

SEQ ID NO: 103691 - DNA, 315 bp, Triticum aestivum
  Clone ID: PAT_TA_103691
accatggcgcagcaaagcggcaatgatgtgaaggctgtaatggagaagctgctccaggcgttcgaggacgaagtggacagggacctgcctcacagggaggcgctggaccacatcttccgcatcctcaaggcaaacaaggagaaaatcatctcggagccaccggaggtggagaagaaggataagctgcccgagctgctgcgcagtatcggtgatgccctgcagcaatgcaaggcacggtccaagcagcagcagtctgagtctgacaaggccaagagcaagaagataacaatgccgtcggtgagcgactgcaaccct

SEQ ID NO: 103692 - DNA, 369 bp, Triticum aestivum
  unsure (1)..(369): unsure at all n locations
  Clone ID: PAT_TA_103692
aggtctttacctagagctcatcagccaactcaagggatagacaagctatgaacagtgccctctagggaaagatgaatatgtaggaaaaaaaattggagcttaagctttccctagggtggtgccacgtacaaacatcaaagcccaaaaaacatgaagagatgccccggtgtgcccaggtagattgacctcccgcgctacactcgcgccattttttttcatttcgcaaaggttggggccatagtccagtgagaaaaggatgggagaaagggcgcgtanaggaaaaaaatcgtatgtgtatccttcacgcctcgcccctgtcccaagcggggccgccaccagaccaaaacttttccctctctcagatctcat

SEQ ID NO: 103693 - DNA, 158 bp, Triticum aestivum
  Clone ID: PAT_TA_103693
ctctgctggcggccgcgcccttccatgtcgcagccttctcatccctatcctctccgtccgcccactcgccgtctgtcctccgcagcatccgtgggggcggccggggcggccgatgcgccgcggccaatgaggccatcctgtgcgcgctggaggggggg

SEQ ID NO: 103694 - DNA, 229 bp, Triticum aestivum
  Clone ID: PAT_TA_103694
catggcttcactcttccttccaacagcctgccaccgtggtccgctggcgagatggatctagcccgccgggttgagacgcaggcccgctggccggacggcagcaacgtgcgtcccctcacccggtccatatccacaactactccagatgggaaacagcacggtggcgaccgggccggtgccggagactctcacgggggccggcgtgcgagcgtgtgcgcctgttcctctg

SEQ ID NO: 103695 - DNA, 560 bp, Triticum aestivum
  Clone ID: PAT_TA_103695
ccatggcccccactgtgatggcttcctcggccacctccgtcgccccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcctatgtatga

SEQ ID NO: 103696 - DNA, 517 bp, Triticum aestivum
  Clone ID: PAT_TA_103696
aattttcggtaggtgctagtgaggaacaccaagggtgccaacaatggagattgtggtgggtgcttcggaggccaccatgaaatctctattgaggaagctcggtggcctgcttgctcacgagtatgctctcatcaggggcgtccgcggcgacatccagtacatcaacgacgagatgacgagcatgcaggcctttcttggcgacctcagcagcactattccccagggccatgaccgccggatgaaagactggatggagcagatccgcgatgtcacctacgacatcgaggactgcgtggacgacttcgcgcaccgcctctcccacgaccccggtggcgaagtctgctgcgcgtttgtcatctccaaggtctatgagttttggacgtggcagtctcgccgcgacattgcttccagcattgctgagctcaaggtacgtgcgcagcagattggcgaacggcgtacgaggtatggcgtcgataatccgaagagtggcagtggggaatccagtgcagttgccact

SEQ ID NO: 103697 - DNA, 389 bp, Triticum aestivum
  Clone ID: PAT_TA_103697
actgggatctgaagcgtggtggctctctcagtggggttccctgagttgagcagccccgccttgcgggatgggaaggctggccgtcaccgccgcggtggccgcttgggctatcccgatcgccgccttggttgactccatcgcgcctgacccctacatggatgagatattccatgttccccacgcacaggactactgccgtggatatttcttgacttgggatcccatgatcaccacccctcctggcctcatatcttgctttcctgtttgctggtgcatgggctatcaaggtacccgaggcatttgaccccctttgcaccacagcacttgtccagtcaactaatgttataatggcaatggtctgcggtgttcttgtccatgacctgcttctg

SEQ ID NO: 103698 - DNA, 417 bp, Triticum aestivum
  Clone ID: PAT_TA_103698
ctcaaacgccgtgaaccaccacgcctcgaacccagacagtctcccaggcaaaatgtgtaactccaacgtcaagaccgccggcgtcgcccagatcgacggccgcccggtcctgcagccggccggcaaccgcgtcgcggcgcccgaaggcgccaagccgctcaagaaatccctgcagaagtcgctctcgatgcctgcttcgtatgacaatgccgctgctgctgccgccaccgcttgcacggcagcgcccaagagcaccggcgccggcgagttcgcccgcgcggcggcggcgacgccttacctcctgccgccgacgccggcgaaggcggcaggagccaaggcggcgggcggcaggacggcggcgtccacgggcgcggacaagagcaggaagcaggcgcccaggaagagcggcgccgtgct

SEQ ID NO: 103699 - DNA, 560 bp, Triticum aestivum
  Clone ID: PAT_TA_103699
gttgttcattaactggttgttgcgcaaatttgggtatgggctgctgcattctgtcgagttaagattgaccaagtctagctgagtagtagactaaagaaattatatttacaatattgcattctttcaactaaaaggagaagtttactcagtcaaatgctcactcatgctaatttggaggcttaaaaactctatgactcctctaacaattagaacgcttatgaagagaatatgtaggagacatagatgtatatgcggaaggacattcaaggaatcttgtgtcatgctaagatctatgtttagacatatcatgcttctatttttatgatccaaaggaggagagacatgaacaattatttacaaaagcttagcagtatatattgaactgacatggatacatgtttcagtatcaggccgatacagatacgtaaatttgtcattttaataaaagcgccaatacgggcacacatttttcagcttgttttatgctaatacagcttgatccattgcaatctcacttaatgcattaagaggaccagaggagccatctggaggagaggatc

SEQ ID NO: 103700 - DNA, 536 bp, Triticum aestivum
  Clone ID: PAT_TA_103700
atcacacatcaggacattcgggatccgtcgtgcccgacaagaacggcgagagcccggtcctagaacatggtcatcctgaatggctgcaggatgtttggaaactcgttacaagtaaccatgaagcaaccggagaaagcatcgacgccattgttgatggagtaaggcgtgcattggacgagggccctgttcgtgggaacggagatgcttctgatctactgtatgaccgggccaaagtggaggaactgatcggcaatctgatcgacaaaatcacgtccacgatccgcgtttcggcagaagacgatgctgcaagatctgaatctttgttgtatgccaagcctgaactctgtgctcggctcgagtacctggttcatgtttgccatgatgtgctacagaggaaagccaggcttgaagattttatcgacgaggtttgcctggtactggagtatataatgagcatatacttctcgaaccaagttcgatcggacaccgtggacggtaacgaaaatgactttcatgcacatgttgaacctgacgtg

SEQ ID NO: 103701 - DNA, 593 bp, Triticum aestivum
  Clone ID: PAT_TA_103701
ctgatgtgctttgggagctacggcaatggcgtcgcttgtgcccggggtcctcctcaagctcctgcagcacatgaacagcgacgtcaaagtcgcaggcgagcaccggtcctcccttcttcaggtcgtcagcattgttcccgcgcttgctggcagcgacctcttcaccaaccaggggttctacctcaaggtgtctgattcctcgcacgcgacctacgtttccctgccggaggaccagcatgatctcatattgagcgacaccattcagctggggcagttcatccatgtagaccgtctggaggccgccaccccggtgcctatcttgaggggagtcaggccagttcctggccgacatgcgtgcgtcggcactcccgaagatcttgtcatgactagttcctccaagtttcttggcgagaaaaaggcacaaccacccgccaacggttccaaggatgcaggggccttgtcactagagaaagagcagagcaagttggagaaactaaatgcttctgtgaagagcaacgggatggaaagcaagaaaccgcagctgaccaagtcgaactcttcgctttcgaaacaagcgctggccagccttttcg

SEQ ID NO: 103702 - DNA, 436 bp, Triticum aestivum
  Clone ID: PAT_TA_103702
gtgggctgagttggtggcgatgtatctcgttcatgggctgtgttagcaacaggatgcgatcgagggtggggctgcggtcgaaccatcacgacgacgactgcagatcctcctttaatagtagagatatatgggtgtaatgatgttcttgaagctgaactgctggctttgtgttatgggatatctctggcaattcaatggagcatgctgcctctagatatagaatcatattgtctacaagcagtccagatgatagttggaggctctagcaacaagtccaagtatgtgttcatcgtgaaggagatcatcagtactatggaagaaagaagctcttgcattactcattctcgttgatgctgtaatttggctagtcattccttggctaattttggaagaacacaacaccgaacggtggtttggcttggctctggtccggaag

SEQ ID NO: 103703 - DNA, 525 bp, Triticum aestivum
  Clone ID: PAT_TA_103703
tcccaactccgcctccacggctccacgcttgacctcacctccatccgtaagcgtcgccgtcgcagtcgccggggagcgccatgcggccttcctcccgcatactcgctgcgaggcacctgctacgcagctcccgcttccaaccctccacggcggccgccgcctcctctgttttccggcggctcgacggaaccaatgggccgccagtgccgaagcctctccgtaatccccacctcggagaacccggaccaaactgtagggtttttcctgggagcagcgccccctttgcccacgtcaactgcttgctgccggactccacctacccgccgcactgcgcgcggcccctccgcgacttgagagggcatgcattctccacagctgccaattcagtgactgttgggaagccggctgatgataacgtgcataaagatgccccaaaaaaggacattgatgatcagatagcagacgcgcagattcttcgaaacctttggaagtacttaatgctgaatgatagccctgatttccgct

SEQ ID NO: 103704 - DNA, 307 bp, Triticum aestivum
  Clone ID: PAT_TA_103704
atatatcacactattcgagacactgcaagctccagggaccatgtcacgttctggaaggaatcgtggatgaaataatagacgcgccttgtcctctaagcctaagaggttgacattcataagttaatccatgcaggcctggcattgcactgcctaccactttcagcaggcgcaaaaagttgactccagcaagatcaagtgatcaacagtagtcaagggaataattgaatagggggtagagcctatggcaggccaaatatgtgacatgtccggccacttccaatgctaaccacgggattctggatttacg

SEQ ID NO: 103705 - DNA, 178 bp, Triticum aestivum
  Clone ID: PAT_TA_103705
gatgaccgacacgtactactacgcgttggggaggtataacgcggcgaaaaacacatggacaccggtggacgtcgacgccgatctcggcatcgggctaaggtacgactgggggaagttctacgcgtgcaagacgttctacgatccggcaaagaagcggcgcgtgctatgggggtggggg

SEQ ID NO: 103706 - DNA, 317 bp, Triticum aestivum
  Clone ID: PAT_TA_103706
ccgccgcccttcgtcccttcgccaccgccgctccatgccttcgccgctgccctcgcccatcaaagccgccgccctccatcggacgatccacttcaggagacgccgccgaccccgttcaggaccagccgccgatcacgtccaggatccgacgccgttccccttcagaagccgcacgccaccgcagatccatcccctgaaaaatcgagactcttgagatgggcgatcgagaggggatcaaaaggagtaactttcacctgcggccgcaaagggcctttacaccgccgccgagagccgtgcgcgggtggtgcgctgtgagc

SEQ ID NO: 103707 - DNA, 174 bp, Triticum aestivum
  Clone ID: PAT_TA_103707
gtaaaccatggagctgtacccgcgcgccatccgaaacgctccggtctccgccgacgacggtgcgctcgacggtagcccgtaagtcctgtctcgtgcccaacatggccagcgtgctcccgcggtgctgcccggccgtgaacaccacgttgaccgccgacaacaggcctggcgtgc

SEQ ID NO: 103708 - DNA, 525 bp, Triticum aestivum
  Clone ID: PAT_TA_103708
cagcagacattccattacctatggcgatgatggggtcgacggcggcggtgctcctggcgctggtggtcgtggcgtcgccgctgctgctggcggcgtcgcagccggtgggggcgccgcccgcggcgccggcgaccaacaactcgcggctggagaaggcgtacgtggcgctgcaggcgctgaagaatgccatcactgacgaccccaagaacctgaccaagaactggtgcggccccgacgtgtgcagctactacagcgtctactgcgcgacggcgcccgacgatccctgcgcgcgcaccgtggcctccgtggacctcaatcacggcgacctggccggcacgctgccggaggagctgggcctgctctccgacctcgccgtcttccacctcaactccaaccgcttctgcggcgcgctgcccgacgccctccgctccctccacctcctccacgagatcgacgtcagcaacaaccagctcaccggcaacttcccctcccagatcctctgcctccccaacgtccagtacgtcg

SEQ ID NO: 103709 - DNA, 296 bp, Triticum aestivum
  Clone ID: PAT_TA_103709
ccgcccctgcccctcctcctcgaccacgcctcgtcggagagagagagaggcgtcgcccccagcgactacggttgttcccccctcctccctcctccttcgcgcctcgcccacggcgcgccgccccggcgcgctgttttttttatttattccctccggatcaccgttgcccacagcagcgcggaatcaagatccaatcccctcccctcccgtccactcctcccccgcggcgtctgagatccagcctgatccgcctagttccatggcgaccgccggcgacgcccccgctcccgcaagcg

SEQ ID NO: 103710 - DNA, 419 bp, Triticum aestivum
  Clone ID: PAT_TA_103710
aaaaacaccccacgcccccaccttcttctccccgtctcattccccaccatcaccccacctgacgaacccccaccaactaccacctccctctacctacctcaggcgccgccgcctcggcctctcttcccgcaacgcatcctcccccaccccacctcacccccactggaccgcatctccacttacctccgcacctcccggcgcacctccttcccctcctcaatcccctcgcaggccccggatccaggtgaggtagaggagcaccgtcgcacctccttccccttccccgggcctcgccgaccctcccctcgcctcgatctgcaacgacctggacgacccgcagtagggcacgccacccttcccctcccctcgaatttttggggcgccaacgacccagcgcggtatcccgcggtcgggattgg

SEQ ID NO: 103711 - DNA, 424 bp, Triticum aestivum
  Clone ID: PAT_TA_103711
tttggttctatttagaattgaaggtgaacacaagctgcctccaaccacactgtcacctggggacatggtttgtgtgagaacatgtaatagccgtggtgagggagccacttcttgcatgcaaggctttctttataatctcggggaggatggttgcagcataactgtggctctggaatctcgccatggtgacccaaccttctccaggttatttgggaaaagtgtgcgcattgaccggatacagggattggctgatgcacttacttatgagcggaatcttgaagcattgatgctacttcaaaggaatggtttgctgaaaagtaatgcttccattgatgtggtagctactctgttcggtgacagcaaagatgtcatgaagatggagcagaattgcctgattgattggggtgaatcaagtgtacctgat

SEQ ID NO: 103712 - DNA, 324 bp, Triticum aestivum
  Clone ID: PAT_TA_103712
ccaagcggcggccgtccgctccctcttctccgccgacaaccccttccgccgcaaggagtccgctccggaggagcccccccgcgctcccccaccgacccccgcatccgccgccgtccccacgccggcgcgcaagcccccgaagcggccccaggctgaggcggaggcggagcccgcggtgccgtcccggaggaagcggagcgaggaggatggggagggcccggcagcgcggcgcaagcggaagcgggaccaggtggaggccgggtactagcggcggacgctgggggcggcgcccgcggacgaggagcagcggccgcgcccggtggt

SEQ ID NO: 103713 - DNA, 664 bp, Triticum aestivum
  Clone ID: PAT_TA_103713
atacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtaccctgacgcctatgtccgtgtcatcggcttcgacaacctgcgccaggtgcagtgcgtcagcttcatcgcctttaggccaccgggttgcgaggagtccggcaaggcctaaactacgagttgaaacaatggcctatctcgtatgaaagtcttttgtgaacttcacttttgtccaaaactctgctgtacgactctgctttctgaccggagcaaaaaaaaaaaaaaaaaaaaaaaaaaaaaa

SEQ ID NO: 103714 - DNA, 608 bp, Triticum aestivum
  Clone ID: PAT_TA_103714
tttcagaaatgttgaggaaacttttgaggggctcttctagccaaggctctcagggaaaaacaagccaaagagaaggaaaagcccaagtataatcttcctcgcttagcggaagtacggtcgtgtgaatggccatgcgaggatttcttgaaagaagctggaattcatgaagatttttattctttgatcgagactgcaggcctcgctgatttcatcaacgaccgaatcgatcagtatctcttactcacaaatactttcgtgcaaaacttttattagtatcctaagaagtcaccgcctgcagtatcatttcatttatatgatgaattcagagaaatgtctttaagtaatttttgcgcggtgtgtaggataccttatgagggagaattagaggaaccccatcgtgaagatgtgggtggctttgttaatactattgctgtagaggagccaaagaagggctctgaggcaaaagtctctagcatacactttcctgttttacgctactttgccatatttgctagtagatgcttgattggtcatggaaatagtggaaacttgagcgttcctgatattatcattcttcaacatgtcttgcttggagacaatacttttag

SEQ ID NO: 103715 - DNA, 585 bp, Triticum aestivum
  Clone ID: PAT_TA_103715
ttttttttttttttttttaaaaatcaaagtgtgtgtaggggagagttcaacttgaactgctcatctacccagaccgttccttccttctttcatacaattccacatggatgcatcccaggccttccttattaagtgcacttcatctttttttactgaagaagaatataagtgtactaacgagacgcagttccttttcaaagcaaatgtcttcctgaagaaaaaggaaaaccacggccagacttacaaatgccttcctgaagagaagtgtaaatgtcttactctgaatgcacttagctagcaacactcggactttagttttgaccatgcattctagccgccggccaccgcgatgtggctgtcattttttattcgaacgaccatgagaaatccatgtgccctgtacaaccacgtgatgttgaataagagcagcatcagtgacatcagatggaagaaggatagtagcagaggtaagcaattgcagcagcactacaaggctctcaagcaacagtcccacatgggctgaagcgaaagtgaacaatgggtaggcgagaacgcaagtgctggctagcagccgcacaggagtca

SEQ ID NO: 103716 - DNA, 348 bp, Triticum aestivum
  Clone ID: PAT_TA_103716
gaacgtcaaggcaagtgcgcaatggccacggcggagatcgcggcgaagcggctgatcggcaacgggctgcgccgaaaggacgggcagccgttcaccggctaccccgtcgtggggttccagggcaagatgcagacgtcgggctcctgcgcgcgcccgccggcctccagcccgctcacggcgtgcgcgtgggaccccaggttcaaggggctcttcttctacgagagcacggccatcttctcgccggcgcggttccggtccttcgtcctcgacgtgaagaagctgcgcgacctcaacccggacggcatgtgcggcgtggacgtctacaatggcctgctggtccggttcgtg

SEQ ID NO: 103717 - DNA, 488 bp, Triticum aestivum
  Clone ID: PAT_TA_103717
atagggaacgatcgatgtaaactgtgctgcattctcatctgtggagttatatcagactacatccatcacggaccaattgatgcacatgaatcagcgattgatctgtttggagaccttccagaggcactgcgccaaaatctcgtgctccatctcgtctcttgattgcagattactcatgtctacttgtgttcatttataatatattttttgttctgcagggcgtgctgtgcacaattttttcaaagttgtctctgaaagaggctgtaagaaccagtgccgtgtcaaggaaatggagatacttgtggacagtttgtcctaaactgagttttgacggaagtacaatatgtggcaacaacagatatgggaaacaagtatatgctctagcgttcattcgcattgttaatagggtcttggcacagtgccgtggcaagttgtttgaagagcttgcgatcaaaattgatttgaacaggatgtttgttgaacacctc

SEQ ID NO: 103718 - DNA, 397 bp, Triticum aestivum
  Clone ID: PAT_TA_103718
gccccgcgtcgccccagccctcccggtcccagtcccagcgccgctcgctccgccgcccgcgcaccccccggccacggcgagatgaggcccgcggcggccgcggccgcgtccgtgctgcaggcgccgcggcgcgcgctcggaggggtgtcgttcgtcgccgcgcgctgcgcctcctcctcctcctcctcggtcgccttcgccgccgccgccacttcgtacgatcatgtgtcctttgtcaaggaaatcgccgtgaccgaccccccggagcatctgaactctttactgaacgtgcttcatgcacgaggtgagaagatagtttctcctggagcttagagagggctcattccacttgttgttcccctgtcggaaagcccacaagggtacttgacattccttc

SEQ ID NO: 103719 - DNA, 401 bp, Triticum aestivum
  unsure (1)..(401): unsure at all n locations
  Clone ID: PAT_TA_103719
cgctcctcgcggcggggcatgccgtcaccgtgctcacggtcggcgacgagggctcggacaagatgaagaagccgcccttctcccgcttctcggagctgacgagcgccggggcgaagacggtgtggggtgacccggcggacgtcggcgcggccgtcggcggagcgaccttcgacgtcgtgctggaaaacatcggcaaggacctcgacgccgtcaagccggtggcggactgggccaagtcggccggcgtcggccagttcctgttcatcagcagcgccgggatttaccttcaaaccgacgagccgccgcacgtggagggggacgccgtgaaggagagcgccgggcacgtcngcgtggagaaatacatcgcggcggagttcggcagctgggcctcgttccggccg

SEQ ID NO: 103720 - DNA, 490 bp, Triticum aestivum
  Clone ID: PAT_TA_103720
actgtactggttgggaagaagagagagggagctaaacagcaaccagcaatggcgctcgtccctctcctcctgtcgctcctcctcgtctcctgcgccgcgcagtcgccggcctcgtcgccgtccgcgtccaagctgctccggtcggcgccttcccgccgcagacattcgccgcggcgccgaccacggtcaaatcaccgccgcaggcctcggccgcctcgccatcgcaggtgtctgcagcaccgccgacgttctcggccgcctcgccgtcgcaggtgtctgcagcacctccgatggccgtcgctgcctcggcgccacaggtgtccgccgcaccgccgacgaccgtcgctgcctcggcgccacaggtgtctgccgcgccgccgaccgtcgctgcctcggcgccgcaagctgccgcggcagctccgccgacagtggccgcctcgccgcagcttgctgccgcgtcagctccgacaaagagcttcgccgctgcacc

SEQ ID NO: 103721 - DNA, 454 bp, Triticum aestivum
  Clone ID: PAT_TA_103721
aaggatgaaccagtcatgaaggggcctgatggatggtggaaagaagaaagctccagcaagactggattaaggcacacgactgatctggtccagatcaaggatggtctactcagtaaggggcagttgcctgatggatggcgaaaagaagtcaggccaagaaaggacggaactaagagtgatccagtccaaatcaaggatgggctactcagtaaggggcagttgcctgatggatggcggaaagaagtcaggccaagaaaggacggaactaagagtgatccatactacactgacccagtcagtggttatgaatttcgctctctgaaggacgtgcaacgttatattgaatcaggagacataagtaaatgcaatgttaggccaaagaagagaactgcccagggtgcttgtattacacagaatcaagattatacaggaagatcatcagaatatgcaagac

SEQ ID NO: 103722 - DNA, 421 bp, Triticum aestivum
  Clone ID: PAT_TA_103722
agccgcacatcagcagcttgctctgttccatccggcagcaatggcggcctccaccacaatggcgctctcctcccccgcgatcaagctcgccggagcctcgtacgcgctcggcggcggccgcgtcaccatgcgcaaggccgcgcccaaggccgccgcctccaacagcccctggtacggccccgaccgcgtgctctacctcggcccgctctctggcgagcccccgagctacctcagcggcgagttcccgggcgactacgggtgggacaccgcgggcctctccgccgacccggagaccttcgccaagaaccgcgagctcgaggtgatccactgccgctgggccatgctcggcgcgctcggctgcgtcttccccgagctgctcgcccgcaacggcgtcaagttcggcgaggccgtctggttcaag

SEQ ID NO: 103723 - DNA, 392 bp, Triticum aestivum
  Clone ID: PAT_TA_103723
tttttttctgtcgtccgtcattatggctgttttttagaaaagcccctcagtctacatgaaatcaacccgcagtccctgttttagtaataaataataaagcatcccggcaccgcacggcgactgcgatcccacggcgcaccagcagcaggcgcagcgtatcccgacgccgcacctgcggctcttcctatcgcccaccagtgcggagggggaggccgtgccgacgacgatgaacgaagtggcggagcaggggccccggcgagcggggagcaggaggcgcatcgcatcccggcaccgcacggcgactgcgagcccgcgacgcacctgttgcccacgagcgcggacttcgaggccatcctgacaaagagaatcgggatgaggaggctgccgctgca

SEQ ID NO: 103724 - DNA, 198 bp, Triticum aestivum
  Clone ID: PAT_TA_103724
cccctgcagtgctcctgcttttgttggcgcttctgatcgtcccccgcggcggcgatggcgccgcggtgttctccgggtacacgttcaaggggcagggcgaggccgaggccttcgaggaggcgctgctgcgccaggcgtgcttcaacgtcacctcttcttcctccggggccgggcgcggttagggtgactgcgtctcgc

SEQ ID NO: 103725 - DNA, 576 bp, Triticum aestivum
  Clone ID: PAT_TA_103725
accgcataccacgccgcaagttgcctgaggccctcatgccgccgccgctcgcccctttctctgtatgtcgccaacgcaaccctgtgccccagggtcgttccctccttcccacaaggctcgaggaagcccaaggaggcggccatgaggagcgcgcagccaccggagtcgtgggcagatctagccggggccgtcagcagccatccctccctccgggcgggcatgaagaatttaagcggcttgggcagaactagcatatggaccatgcgcgcctcccgcgctaggagccaccggtcctcgttatctgctagcatccacgaggaatccatccatataatgttacgacatttaaaactgtcaaaggatgcgacgatgcaacgaaagaacttgagtagtgttctactcgccttggtggaaaggcaccaaaggacaaatggatatatgttgatggccacacatatagaggctggcgatcaactctcaaaattcatagtatacaccagaaaggctggcgatcaactctaagtttcacttacaaggcatacaaaatagatgcagctagattggctatctgctgga

SEQ ID NO: 103726 - DNA, 173 bp, Triticum aestivum
  Clone ID: PAT_TA_103726
tgtctttgatgccgatattgtactatgtacgtttgcaggtgtttcgtggacaaggtgcccatcacggagtaccgcaactcggacaagcccaacaggttcttcccgatcatgaagcccatgtacgtcttctccagcatctggaacgccgacgactgggccacgcgcgggggcct

SEQ ID NO: 103727 - DNA, 509 bp, Triticum aestivum
  Clone ID: PAT_TA_103727
cccgcgtagacgccacgccgtgcggcggctgcgcgaggcgggcgccattgtggtggggaagactaacctcgacgagttcggcatggggagcaccaccgagggctctgggtttcaggtgacaacaaacccttgggatgattcgcgcgtgcctggcggatcctcaggtggttctgcttctgcggtttctgctagacagtgtgtggtgtccttagggagtgatacaggtggaagtgtgaggcaaccggcatcgttttgtggtgtggtagggttaaagccaacttatggccgggtatctcgtttcggcctcatggcttatgcttcatcactggatgttgtgggatgctttggatcatcagtttttgacactgcaaccatattgtccgtcattgctggccatgacaaaatggattcaaccagtagctctcatgatgttccagactatagatcagacttggcatctctaagtttactagaatcaaaaccattaaatagtgtgagaattgggatta

SEQ ID NO: 103728 - DNA, 520 bp, Triticum aestivum
  Clone ID: PAT_TA_103728
aaccaccgaccgccgctctcctctcctctgccccgaccacgccggcgccccaactccggcggccccctctccttcttcttcttcttcttcttctggatttcttcatctgaccctcccctgcggttggcttctgcaggccatcacaaattcgccatggcacccagccccagatctgacagacaagggtctaggtgcggccggatccaagaccaagcacccctgcggttgatttcgatctgctctgcaggccatcacaatggaaggaggagcaccatggcgggcgtgcaggccatcgcctaggcgggacccacggccagatgcagggcggctccaaaccataactccctcttctttgatggccggggaggacgacggggaaggggggcaaggaggaccagcgccataatggagggccctcttctttgatgggcattccgttccagctccaatcccagcaggtcaaagtgcaaggttgccgtgcttgtggtctgctcaccttcacttcagccgcagcatccgc

SEQ ID NO: 103729 - DNA, 149 bp, Triticum aestivum
  Clone ID: PAT_TA_103729
tagtgcggtcggggtctaccttcctccgatcgggtggctgtggactgtggtcgccaagccagccatggccgtctccccttctgcggcgaggccgagaccaatcctcctcctggcggcgtcggtggtcgcggtggcggtgctggcgcgcg

SEQ ID NO: 103730 - DNA, 601 bp, Triticum aestivum
  Clone ID: PAT_TA_103730
ggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgctttccgacc

SEQ ID NO: 103731 - DNA, 132 bp, Triticum aestivum
  Clone ID: PAT_TA_103731
agcgcctcatcacttggtgcttgttatgctatcttgagcatcatgttgatgttgtaaaaaatgtgtgtctatgctattgctatgtagaactgctataatgttcatgttcaccccaaaaaaaaaaaaaaaaaa

SEQ ID NO: 103732 - DNA, 480 bp, Triticum aestivum
  Clone ID: PAT_TA_103732
cgtccgcacgcgcgcacgctcggctccataatcctcaccggcgaccgcgcagctcccgatctgctccgtcgtccccatgtcgccggtgaggatcgtcgagtcggcctatgtcggcgtgccggagaccgccgcgccgccgccggggccgatcaggttcaccgcgatggaggcgctctgggtcgtcttcccggtgctgcagcacgtcctgctctacgaggccggcgacgacatgccgcccttcgacgccattctccagtccctccgctcctccctcgcggccactctgggcagcttcgcgccgctcgccggcaagctggtccacctcgaggagacgggggacgtcggcatcagctgctccgcctccgacggcgtcaggttcgtcgtcgccgagtgcgacgccgacatccgccgcctggccggcgacgaggagcacgacctgcgcgtgctcgaggcgctcgtgccggaggtggacatggaccg

SEQ ID NO: 103733 - DNA, 614 bp, Triticum aestivum
  Clone ID: PAT_TA_103733
actcttgctcagaggtgttcactgatgcaacagttcaggagcattttgatgtcaaatgttgggtgtcagtttccagtagctccaacaagatggagctcgcagccgagatcctaaggtctgtcctaccggcctgggatggctccgctgacaagatgctggattttaaaatgcttcagtcggagctccgtcgagctcttacatccaagaggtatctgattgttcttgatgatgtgtgcaacatcacagatgaaacctggatggacatgctcgctcctctacagtcagcagataccgggagcagaattatggcgacttcccgcatggacaccatgcctcacatcttcagagcgtcgcagctgtacaccgtgaatccgctgaagagcgaggattgctggaccctgctgaaggaacatgctttgccaagtgatcccggtaatgtctatcaagaacttcacccgatcgggaagcagattgctgaaaaaatcaatggatcacctctggctgctaagctagtgggaggtttgctgggagatacaaggagcacaattcactggatgaacatcatggaaaaaggattacaagataatgctgttttctccgccctatgcttgagc

SEQ ID NO: 103734 - DNA, 592 bp, Triticum aestivum
  Clone ID: PAT_TA_103734
caagcccctctctctctctcaaaggaacaaccaaccagctgctgaaagctggatcggatcttcggaatccttcctgtgagcagatataagagagcaagctggtcatccagcttcacaagggagggcatctccaggtagcaccactggcaaccatggaggcggctctggtgagtgcagcgacgggagccttgaaacccgttctggcaaagctgggcgctctcgcaggcgatgagtacaagcggtttaagggtgtgcgtgatgatatcaagtcgctcactcgtgaactcactgccatggatgcatttcttctcaagatgtcagaggaggaggatcctgatgtgcaagacaaggtgtggatgaatgaggtgcgtgagctctgttggcccagtcccgacgccgagtacttccagcgacaggcaacgacgacgacagacaaagctcactgacgagctcgacgagttgcttttacgctgaggcgcaccgtagcaaagctagccttcagctagtaatcaatcctttgtctgatctactagtactagtacgtatgagcacttctagccggaagcgttccaatcgatctagctatctcacg

SEQ ID NO: 103735 - DNA, 423 bp, Triticum aestivum
  Clone ID: PAT_TA_103735
caatattcataattgttccgacctcgatccgtgagttgtgacgaaggggaagaggccggccggcgatggccgacacggtgttgagcatggcaaggtcaatgttgggcggcgccatcagcggactcggctcccctgcagtacgtcagaagagcctcgtccgccatcagcacggccgcctctgccgccgccgacgagatgagcctcctcatgggcgtgcgtaaggatatctggtaactttctcgtggctagctcgggtccaatcctatttcatttatggaagagtacagtcacaaatgtctatttttttatatttggaacgaacaaattacaaaactgaaagattgatgacaaaaataactcactcataaaagattggcctatgaagtttcgcctcaacggatattttatttttgcctgtggcac

SEQ ID NO: 103736 - DNA, 505 bp, Triticum aestivum
  Clone ID: PAT_TA_103736
cgacttcgtgggcggccgcttcggccgcgacggggagttctactaccagagccgtcgcgagcgggcgccccagaccagcgaagacgcgctctacggcgtcttcggcgagggggactccgactacgactctgaggaggacgaggcgtcgcgccggcgccggcgccgcaagcgccgcatggacgactccgagcccgacctcaccaggcccgtgcagttcgtctccaagggcatcagtgccccaaagccagaggaggatgaggagcagcagaggcctgggcttggccaggccgcgtcctcctcgggcactgctgccgccgccgcctccgaggaggatgcagaggaggaccaggatccgtacatcgacctgcccacagggtttgggcagcggatcgccgagggtgcacgcgcgaggcgggaggagaaggagcggcagcaggagtcggccaagcgccggcgcagtgcattcggggcagggtttgaacctggaaaaccagcgccgccacct

SEQ ID NO: 103737 - DNA, 438 bp, Triticum aestivum
  Clone ID: PAT_TA_103737
tccaccggatgggccccgctgcgtctcgtctgcaccctgcccggcccgccgcgcccctctcccccgtctcatctgtggagaagaccaagggtgccgccgcggcagccgacgaggtccagctggaggggatgccttccgagttctactatgaggagtggcaagccaatcagcgggagaggactaacgaatggcatgcatatggtcagaaagaggaagccgatgaggaagcaaaatcaagtgaataccgagagattgggatgcgtatgaaagcatacccacaggaagaagtttgtaaagctagggttttagtttcaagtttcataagagctggtgaagatgttgagaatgtaattgagaacgctgctgaaagaggagagcttaccgagcttgttctcatggtcatttggaatcgacttgatgttgctcggcgtgatgatg

SEQ ID NO: 103738 - DNA, 541 bp, Triticum aestivum
  Clone ID: PAT_TA_103738
tgaacaacaccaagctggccgccgtggcggacgcagagaacccggccgtcatgtgtggcgacgtggacgactccgtctcccagtcatccatcgacttcgccggccgcgccaactggctacgcgcggcggtgctgggcgccaacgacgggctggtctccacagcctccctcatgctcggcgtcagcgccgtcaagcccgaggcgcgggccatggtcgtgtccgggttcgcgggactactggccggggcgtgcagcatggccatcggagagtacgtgtccgtctgctcccagcgggacatggagatcgcggagctggaccaggccggaaagcgtggcggcgaggaggagaaggcactgccaagcccggcacaggccgccgcggcctccgcgctggctttctccgtcggggcgctcctaccgctgctggctgctgggttcatcgtgggttacaacctgcgggtggccgtggtggtcgtcgtggcgacgttggcgctggccgcgttcggatgcgtgggcgccgtgctggggcgggcccccgtggc

SEQ ID NO: 103739 - DNA, 151 bp, Triticum aestivum
  unsure (1)..(151): unsure at all n locations
  Clone ID: PAT_TA_103739
agctgctagatagcctaggaaattctgtgcctttctcaatccacctggttctggttgcatgggtggcggtggaggcggaggcagagaacgtgtagatagcctangaaattctgtgcctttctcaatccacctggttctggttgcatgggtg

SEQ ID NO: 103740 - DNA, 479 bp, Triticum aestivum
  Clone ID: PAT_TA_103740
caacgccgcgctcaacgacgagctcttcttctccgtcgccaatcacacgctcaccgtcgtcgaggtcgatgccgtctacgtcaagcctttcaccgtcaagaccctgatcatctccccgggccagaccaccaacgtactcctcaccgccaagccgttctaccccaaggctaacttctacatgttggccgcgccctactccaccatcaggcccggcaccttcgataacaccaccgtcgcgggcattctcgagtaccaaaagcccggctccccctccatgtcaagctttgacaaggacttgccgctgttcaagccagttctcccgcggttcaacgacaccggcttcgtcaccaacttcacctccaagctccgcagcctcgccacgccgcagtaccccgcggccgtgccacggtcggtggacaagcggttcttcttcacggtcgggctgggcacgctcccgtgccccgcgaacacgacgtgcc

SEQ ID NO: 103741 - DNA, 640 bp, Triticum aestivum
  unsure (1)..(640): unsure at all n locations
  Clone ID: PAT_TA_103741
gcaaggaatctcaaatcagttttgttttccaagcgaatcaagggagacttttgaaataactaattctttccaaaaccagttcgagagcaacttggttgggtccatttcacaaatatgtgatacttttatgtcacaaggcgtgtcgtgtgtgcctgagtcatccctcgcagttggaggtgtttctgcatctgttagcagcgatgaccttttatcaagtatggtgttcaatggcttgtctacctttaataatgatggtgtttgcactacgcctatgacggcactagaagacagcaaccatgcgaggaatctaatgtctggatcgcagaaatgcatggaagatgtggttggtgagacatgtgaagcttatgcagaatcatttggcaggaatgaacaggaaagttgttcaactacggggtatcaactgatggatgaatgcagtcgagctgatagcatttggctgctttctggcaaaaagactagcgactcttgcaaggttgaacgtgtacaagatacttggaacaggctacgtcgttgctgcctgtacttcctgtgagaccaatcacaatagaactgcttctggagctttgaacttgcttnccggggnctgattaatatcggaatcagatcttatgcttacccg

SEQ ID NO: 103742 - DNA, 640 bp, Triticum aestivum
  unsure (1)..(640): unsure at all n locations
  Clone ID: PAT_TA_103742
ggcaccngcctcaaggttcatttcagccgtgcaatttatcagaaaatggaccagaagaatattcaggagcaaaggatggattgttggatcatatagaccatctttatgatgatgaaatgagatcctctggaaacataagcacggaagtcaatagttggttatctgcatttgaacagggaatacatccacgagtcatgagtgacgacgagctgtcaggtgatggctggttgtcattcctgcggattgccatcagccacctgggtggactttcccaaccaaggtttctggaagagcagatcacctgtcaggatcaggttactgggcatcgtgtatggatcaagctacagcaacgctctggctggtcggttaaactggaagctacgcgccaccacctcttcgacgccctgcaggacgcggcaatgctggccgttattaccatgaggcagcatttcccttgcgagttcagaggcactccgtttgaagttctgcctgtggaacccgggcaaaggagcaggcagctagacgacggtgccgcggtcgtccgcggcggtgccatggcttncgcttttacggggatcgatcaccatgatgtccaacgncttctcgcggtcggcttcatgtcccttttncatgagcgttc

SEQ ID NO: 103743 - DNA, 640 bp, Triticum aestivum
  unsure (1)..(640): unsure at all n locations
  Clone ID: PAT_TA_103743
caacaaccacaacaaccatttccccagccccaacaaacattcccccaacaaccccaactaccatttccccaacaaccccaacaaccattcccccagctaacctcggagctgagtcatggaaataggatctgtggctcagaaggagcagtaacagctgaaacaacccactcaactgatgttaatctctacaggaatgtattcatcactagctttggagaggttcccggccttattctgtcggccgccatcgtggacaagttcggacgcaagctctcaatgtcctcgatgctttacgtcagttgcctgtgcatagctcctctcatgttcgctcagacggaatccctgacgaccatcttcctgtttggagcgcgcatctgcatctccgccagcttcatcgtgctgcacatctacgcccccgagatatacccgacagccgtgagggcgacgggcgtggggttcgcgagttccatcgcccgcttcggggggatcctgtgcccgctcgtggccgtcgggctggtgcacgcatgccaccagaccgcgggcatcgcggtggtcatcacggtgatgctcgtgtcggccgtggccgtgtcctaatttcccctggagacaagcgggccggaaactgancgaaccacattgc

SEQ ID NO: 103744 - DNA, 640 bp, Triticum aestivum
  unsure (1)..(640): unsure at all n locations
  Clone ID: PAT_TA_103744
aatcnnctcctnngaagagcaccccggctcgccgccccgtgtggtttgtttctactgtgggctaccttttacccttccgtcgggcggtaatcttgnccgggancanccgaaaatnggtgggaagaattttcctnnaccnttnnnttcnagaaccatnggaancnacngcaagatggtgaacggatccctntactggacacacccagggagantttncattancgngcttgacancgngacnctngaantctttnaaatggaactngcggcngttttggcngtggaagaaggnnataaccnggaatgggaattttgggctnggnaatnccaaggatggnaggccntgnatcgngtccccgnatccgtggggtggntgtaanctcctggtttttttctgganacccgatgaatncaacggtgtcaaaaggtggaanntggaccaggagttcaaactcaaaacgatccgtnggttcactganattgaanacgattcttatgtcnttgggcaccttatggntgttaccgatggaatcgtgtaccttgcgcactgctatgacgggtatactgaagttctnantgcncctatccttttgtctnnaaaacaggggttnttaaaaaaatctgggaatattaacacaag

SEQ ID NO: 103745 - DNA, 640 bp, Triticum aestivum
  unsure (1)..(640): unsure at all n locations
  Clone ID: PAT_TA_103745
atcatttaagccaagcaagctgtggtcaatacaaatccaccatgaaaacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccgcaactaccatattcacagccacaaccatttcgaccacaacaaccatatccacaaccgcaaccacagtattcgcaaccacaacaaccaatttcacagcagcagcagcagcagcagcagcagcaacaacaacaacaacaacaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcaacacctatggcagatccctgagcagtcgcagtgccaggccattcacaatggtggtcatgctattattctgcatcaacaacaaaaacaacaacaacaaccattgagccaggtcttcttcaacaagcttntgcaacaatatnc

SEQ ID NO: 103746 - DNA, 1058 bp, Triticum aestivum
  unsure (1)..(1058): unsure at all n locations
  Clone ID: PAT_TA_103746
gcangcntcattaaccctcactaaagggaacaaaagctggagctccaccgcggtggcggccgctctagaactagtggatcccccgggctgcaggattcggcacgagacaaaatncatnnncagcaacagccacaagagcaagttccattggtacaacaacaacaatttctagggcagcaacaaccatttccaccacaacaaccatatccacagccgcaaccatttccatcacaacaaccatatctgcaactgcaaccatttccgcagccgcaactaccatattcgcaaccacaaccatttcgaccacaacaaccatatccacaaccgcaaccacagtattcgcaaccacaacaaccaatttcacagcagcagcagcagcaacaacaacaacaacaacaacaacaacaagaacaacaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgntgntcatgctattattctgcatcaacaacaaaaacaacaacaacaaccatcgagccagttcttctttcaacagcctctgcaacaatatncgttangccanggcttctttcgggcatnttaagcaaaaacccacaggcccagggctntgtccaggctttaacaactggcccagttcgaggaaataaggaacctacgcttcagacgctacctggaatgngcaatggctacaatccttcatattggaccattgggccatttggaatntttgggacttacttgggaagaaaataacccttggncttngaaatttgnaaaanccggttttttnnacccanggttnggncnttntaaccggggaaaaaaanatggggcatngccctttnntnttnnaaaacccnaanttttcttgttnaaacttggggaatnaaaaaaaaaaaaaaaaattcgggggggggc

SEQ ID NO: 103747 - DNA, 1088 bp, Triticum aestivum
  unsure (1)..(1088): unsure at all n locations
  Clone ID: PAT_TA_103747
gnagcactctnatganccctcctatgggaacaaaagctggngctcnaccgcggtggcggccggtctagaactagtggatcccccgggntgcaggaattcggcacgagcacacaggctagggcacaagcagaaaatcaaagnacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagcttcagcaaccacaacaaccttttcccagccccaacaacaattgccgcagccccaacaaccgnaacaatcattcccccaacaacaacgggcattcattcaaccatctctacaacaacagttggaacccatgcaggaatatncccnttgnaacaatgccaaacctgngtaattgggggncaatccttttggggcaataaacttgggccccaaagcgaatggccaaatgaatgcggggaacaaaaggcttgccaacaacttggnacaagaattccttaanaggnttccagnggggcaanccnttccataagnggcggggcaattncattaatnatgcnggcaagcnngnnggaaccaacaacaaccaccangggatggcnnatcttttttggcccctattttangnngnaacaagggggggnnaanggt

SEQ ID NO: 103748 - DNA, 1019 bp, Triticum aestivum
  unsure (1)..(1019): unsure at all n locations
  Clone ID: PAT_TA_103748
gnnatgtngcctnntttgnccattncccttactaaagggaacaaaagctggagctccaccgcggtggcggccgctctagaactagtggatcccccgggctgcaggttcaagccaagcaagcaggggtcaatacaaatccaccatgaagacctttctcatccttgccatccttgctatcgtggcgaccaccgccacaactgcagttagagttccagtgccacaattgcaaccacaaaatccatctcagcaacaaccacaagagcaagtcccattggtgcaacaacaacaatttccagggcaacaacaacaatttccaccacaacagccatatccgcagccgcaaccgtttccatcacaacaaccatatccgcagccgcaatcatttccacagccacaaccatttccgccacaactaccatatccgcagccgcaaccatttccaccacaacaaccatatccacaaccgcaaccacagtatccacaaccacaacaaccantttcnnagcnacnngcacagccaccaccaccaccaccaccaccaccaccaccaccaccgnnaccacatanttttcacannntgtgcaacacctgngntncngtgggntntngcttnngcaactctcatatacatgngnctctcaagtattgngcaaagttnccagcagttgtgcaattatgttgtcagcaactgtgcagacccccatantcgcggnggcnagncatccaatgnngtcatgctattatttgnatagcaacacaccacgacacacnacaaccgntgagccagttcctacaagaacntaggaccatatncntnnggcanggttctttaancatttaagnaaaacccaaggnccaaggttttttcagcttnaaaannggnccaatttnnggaaataaggaacttaangttgaaaaccttccngcattggcaaaggntaaatccttcctatggttggacccccnttgggccanttgggatnattngggggnaactgggaaaggganaaaactttttt

SEQ ID NO: 103749 - DNA, 1560 bp, Triticum aestivum
  unsure (1)..(1560): unsure at all n locations
  Clone ID: PAT_TA_103749
natgcnatcatccntntgccatggatcccctccccntnttggnnaaaanaaaaccccngaaccnggacctntaaccanannggcccgggtcnacaaactaaaagngnaatccnttttncnttttcaaanaaanncccaccaccaccnancngggggcggggggttttaataatnnaaaanntctangngnnggcccaccnacanaaatcacnaangaanctaacccncntctccnctcaaaaccattnccatcanctnantataancctacnaatcccancctttaaacncgnnccnnccannnncnnactccccacannatttnatanttatctaaccaacccacnnatcaacncaaactaccnaatnnnntacnnncaaaacacancanataacatnctnccnncccttatcacaccctananctatcaccnncnacatatatatcnnncnatacacctntctcaccancnaaccatnttnacacacanacnnnacacacctctnccaantcaannntnanacactntcccacnacnnaccanacacatncacctnacanacnncactncacngccnactcnanaaaacnttntnnnattancntancntctntctnncananaccgnncacnctccannactancactcatacnatanctannacaannactaccnacacannccatcacacananacncaanctcacntatatcncatnanacancnctntcacncaacacacaccacncatcnnnncancnattnncannatcatncacacacanaanacnacccttcactncaccntctaccacnnannnntacanccacnncnntacntactcntcaacncnncanaacacanacaccctcacactncaccctantnactaacnnatcccncaaantncaacantncncnncacnnaaaatntatnntncnnccatnnnaatcacacnncanacanctatcacacatatcntncatattancacataanatatnnncacaccatcancnacnatncatnntcatancnantaatnnnaccccaccctcatncccctcaccccanancnatnctctcacnanananctcacacntacactatncanncacananacanncatatnacacactancgnacnanancactacacncacnaanacatcaatntccacaanccnntcnnaacacnnataacacccncntcnncaaactctcncantaacatcantacanatataaacacncncnctacnacncnacacatcaaancnatcanaacaccactatcctatattacacacncnccaccaccntacactctacncactaatcatattacacntcncactacncaacctctcctctncnacacanncataacnccncatctcccacacacacacncatatctntcanntntntttacacttcacnnncctcaacantacacataanacaacacctcctntatncnntcntctcnccttcctnntnactactcnatcctcacnaacacnntancacnctcatcactctctaccc

SEQ ID NO: 103750 - DNA, 640 bp, Triticum aestivum
  unsure (1)..(640): unsure at all n locations
  Clone ID: PAT_TA_103750
ggcacngggtagggtgcattantaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcagccgcaatcatttccaccacaacaaccatatccacaaccgcaaccacagtattcgcaaccacaacaaccaatttcacagcagcagcaagcagcagcaacaacaacaacaacaacaacaacaacaagaacaacaaatncttcaacaaattttggcaacaacaactgattccatgcatggatgntgnattgcagcaacacaacttagcgcatggaaagatcacaaggttttgcaacaaaagtacttacccaggtgtttgcnagaattggtggttgggnaggcaccctatggncaagaatc

SEQ ID NO: 103751 - DNA, 640 bp, Triticum aestivum
  unsure (1)..(640): unsure at all n locations
  Clone ID: PAT_TA_103751
ttcggcaccagcaaacacaaatcactctcctggaccgcgtagtccctagttcagaccatctcgcgaggctgtgaattcgatggctccccgggtcgccgtgctgctcgtggcggcagttgcggcctctgccttcgcctccgcgtgggcgcaggacttcatggcgccttcgtcggcgcccgctcccgcgccggacacgggcggcgcggcgaccggcgccgctccggcatccgcccttgccttggtgtctctcgcgctggtgtccatgctcggggcgaggctgatgcagtagacggtcatgtcggccggccttcgctggcgtgctggtttggatcggatggcgatgacggctgcttgtatatttcttttgagagatcgacctctcggtcttgttgaacattctctttcttgtatcgtagtatatctgatctttgtgagactgtgaataaagctgggtcgattctgtgttcaaaaaaaaaaaaaaaaaaaaaactcgagggggggcccggtacccaattcgccctatagtgaagtcgtattacaattcactggcccgtcgttttacaacgtcgtgactgggaaaaccctggcgttacccaacttaaatcgcttgcagcacaatcccctttcgncagctggcgta

SEQ ID NO: 103752 - DNA, 640 bp, Triticum aestivum
  unsure (1)..(640): unsure at all n locations
  Clone ID: PAT_TA_103752
gaattcggcaccggnannngcnaatnactctcgnggaccgtgtagacnctactnnanaccatnnagcgaggcnnaaanttcantngntacccgnatnnncgtgctgannntgtngnnanaagnggcctttgncttcnccttacgactntgcgcatanactntatggcgccttcgtcggcgcccgntcctgcccgnacacgggcggcgcnnanaccgganccgctccggnatccgnccttgncttggtgtnnntcgnnctggtgtncangctcactgcgaggctgatgcatnngacggtnatgtcannacggccttcgctggcgtgcngnannngatcggatggnnatgactgttgcntgtatatancttttnanagatcnacctatcgntcttnctgaacantatctttcttgnatccnaagnatatcngatctttgnnagactgtgnataaagctnnnncngattctgtgttctnaaaaaaannatnnnaannaanctccanagggggggccctggttcccaaantcccccctatanatganntgnaattacnaantgattgngcnngccagttttnacaaccatattnaattggggaaaaacccntggcnntaccccnaatttnantctaccttnana

SEQ ID NO: 103753 - DNA, 640 bp, Triticum aestivum
  unsure (1)..(640): unsure at all n locations
  Clone ID: PAT_TA_103753
acgagatttgcccaggnaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctnttgcaacaatgcaaccctgtgtcattggtgtcatccctngtgtcaatgatcttgccacgaagtgattgcanggtgatgcggcaacaatgttgccaacaactagcacagattcctnagcagctccagtgcgcagncatccatggcgtcgtgcattccatcatnatgcagcaaggaacaacaacaacnacaacancaacaacaacaaggcatncagatcatgcggccactattttnagcttggtccaaggttaggnncatnattcanccttaacaaccagttnaatntggaggtgatcaggccattggtnnt

SEQ ID NO: 103754 - DNA, 640 bp, Triticum aestivum
  unsure (1)..(640): unsure at all n locations
  Clone ID: PAT_TA_103754
aatcggcaccagaagacntttctgatccttgccctccttgctatcgtggcgaccaccgccacaactgcagttagagttccagtgccacaattgcagccacaaaatccatctcagcaacacccacaagagcaagttccgttggtacaacaacaacaatttctagggcagcaacaatcatttccaccacaacaaccatatccacagccgcaaccatttccatcacaacaaccatatctgcagctgcaaccatttccgcagccgcaactaccatatttgcagccacaaccatttcgaccacaacaaccatatccacaaccgcaaccacaatattcgcaaccacaacaaccaatttnacagcagcaacaacaacaacaatcaccccaacaacagcaatttccccaacaacaattcccccaacaacaacaattcccccaaaccacaaacaaataccccaacaaccaaccaatttncccaggcaaacaatcaccccaaacaacagcaattttcccaacaaacaaattccccnaaccaaccaacaatttaccggcaacaaccaattncccccaaccacaaccaaaatacccccaaacaaccaaccaaattnccccaacaacccacaacnattttccccagnaacaan

SEQ ID NO: 103755 - DNA, 640 bp, Triticum aestivum
  unsure (1)..(640): unsure at all n locations
  Clone ID: PAT_TA_103755
tcgnnncgaganagggnacnnntncnntnataacngnannngnaannnnaacnctaaatgntctgctnctcnnnggncacatccttctntnacaaagccncnntctncttgattatcgtntgtttcctctgnatnntgangccctnatnngcttgctgaangacaatgtcatactanagattatngtctatgacantccacactggcgnggagntcctgggntgcctacccatnnatgatcnctgntgncaacccaaggagaaaggntntnnccatctatcccggnttcctnatgtacatctngntggggttcctcataantgccatagantancccntggnntgancaatganctnncanctgnaatgntganantttccccgnngcaccgnnnnaacgtatcatgcatgattatactcngtacnncntatggagcncttttggatnggtnngntcagaanctcngcttcatnngagccaananacanaatgctgntaaanttagctngnanantaaatanatnttcnngnnnttnntgtcntnaaaaaaaaaaccttnnaaaaattcncnnggcgggggccccctnanccccnntntttcctcntntatntggnatntcnttctncataactanntnn

SEQ ID NO: 103756 - DNA, 640 bp, Triticum aestivum
  unsure (1)..(640): unsure at all n locations
  Clone ID: PAT_TA_103756
taacctgntanggaaacngaagctgcaacctgcaggcggccgctntagaatctagaactagtggatcccccgggctgcaggaatncggcacnggcacnagcctcctcagtcctnacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgccttccacaaggggagctccggncggnttcgagacggccggngagaccggcggctgcgactgnaacacctgcaagcgcggcaccgcngtgcggttgctcctgntgcatnctgcnaactgaaccngcgcccannaggccggnccggcaggangctganccacgacnatgaaggatggacaaggcaagcaagcaccnttaacccaccagnttcanccaancacccantcgnattcattnaccaagatcgncctgcantggcnacttngccgganccgccnncggccggcntnaantnaanaanacnnnaacccacncgcnctncgtggtntacaatnnatnn

SEQ ID NO: 103757 - DNA, 640 bp, Triticum aestivum
  unsure (1)..(640): unsure at all n locations
  Clone ID: PAT_TA_103757
gggctgnntggnaaacattatgggaacacanntcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagngtagcccagntgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcagcagcagcaacaacaaggtnaacaacaacaacagggtctggggttctagccagccacaacaacaaacacaactggatcagggttggattgcngtgataagggacatgggngattcagaccatnccgggcaatgtgcnacgtgcatgtttcaccatactgntacaccccatattaacattcagngacngtcactaccnanctnggccg

SEQ ID NO: 103758 - DNA, 640 bp, Triticum aestivum
  unsure (1)..(640): unsure at all n locations
  Clone ID: PAT_TA_103758
gggcgaggttggcaaccaccattntctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactngggcaacaacctnaacaacaacaattggcacanggtaccttttttgcagccacaccagatagctcagcttgaggntgatgacttccattgngcttcgtatcctggccaacgatgtgcantg

SEQ ID NO: 103759 - DNA, 640 bp, Triticum aestivum
  unsure (1)..(640): unsure at all n locations
  Clone ID: PAT_TA_103759
aanntccatntcagnaacagccacaagagcaagttccattggtacaacaacaacaatttctagggcagcaacaaccatttccaccacaacaaccatatccacagccgcaaccatttccatcacaacaaccatatctgcagctgcaaccattttcgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaagaacaacaaatccttcaacaaattttgcaacaacaactgactccatgcatggatgttgaatngcagcancacaccatagcggcgtggaagatcacaggtttggcaccaaagtnctaaccagttgttgcannaatggggttgcaagnncctatggcagatccctgagaagttgcagtgccaggccatccacaatgttgntcatgctattattctgcatnaacaccaaaancacancaacacttatngggccagggtttcttcaaaaagcnttagcaccatatccattaggccagggtttctttcggccatttaagcaaaaccccaaggccagggct

SEQ ID NO: 103760 - DNA, 640 bp, Triticum aestivum
  unsure (1)..(640): unsure at all n locations
  Clone ID: PAT_TA_103760
tnatttaagccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaaatccttcaacaaattctgcaacaacaactgattccatgcagggatgttgncttgcaacaacacaacatagcgcatgcaagctcacaagtattgcaacaaagtagttaccaacagttgcaacaattatgttgtcagcaactgnttcagatcccgagcagtcgcggngccaagccattcacaatggcggtcatgctattattctgnatcatcatnaacaacaaccaccacaac

SEQ ID NO: 103761 - DNA, 640 bp, Triticum aestivum
  unsure (1)..(640): unsure at all n locations
  Clone ID: PAT_TA_103761
cacaacnngagcacaagcngaaaatcgaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttcccagccccaacaacaattgccgcagccccaacaaccgnaacaatcattcccccaacaacaacgggcattcattcaaccatctctacaacaacagttgaacccatgcaagaatatnctcttgcaacaatgcaaacctgcg

SEQ ID NO: 103762 - DNA, 640 bp, Triticum aestivum
  unsure (1)..(640): unsure at all n locations
  Clone ID: PAT_TA_103762
cctttccggttctctcgatntncctcctnctctngtnctctccctnccgcaacgatgcactcgnacncatcgnctgctgccatcttgnttaatccccatctcacccatctccctcgctccagccacccngcaacagagcaccacgagcgccgccctactgtgagccccttcatgccacctcctnacccccaccttgcctctaccccgttggcttgcgacaccggcgccgaccttcaccaggagcctgcaacccctatgccttctcccacgcccattccaggcgccgnaggaccactgnttcgtnatctacttgcaagcccgncggncaccggtgccactgcagactgctgccaagcaccatctcgcccctcttcctccctgcttcgtccgccgtgccgacatgctgcagcactaccgacctcgacctacccgtcttcccggcttnctacgcgtnccctggctgnctntctctgcatcgaacagcagcagcttagagcctcaggatccatacaccccaagtccgntgcgacctanccgaagaacgccgacctngcaaggatcctcatcnggcagncgcgagccccgtgcctgctgctggcgatggatactttgtcaaatgaacggacaccttnaacggaga

SEQ ID NO: 103763 - DNA, 640 bp, Triticum aestivum
  unsure (1)..(640): unsure at all n locations
  Clone ID: PAT_TA_103763
naccagggggtttgagaggaaacagttcgacctaatggtgttaatgtttccataccaaggtactaagtaggataaactcttacgcaaaagaaaaatcttttggatgtgctctcccaacactatataaaccctatcctcctccccctcctctacacatagggcagttgaatcctctcaaagacaaaggagcaagtaccactttttctaccagactgtgcttgcaatggaaattccaggggcatcatcttggcgctccatagccatgtcattggcctcactgctaaaaagattcaggggcataccacagtcgccaaaagggtgcctctacaacccaaagagtaccggcgtcgggattgtctcggctattatggaaccaactgctgcatgtcaatgcattgttgggcctcatatccacgccaatgcgcgtgagatcctagaggttacactaccaaacctttgttggagcaataagaggccattccgaccagccatactgccgtgcggnctatgccgctgctgggtcggtagtggcaccatctacatgttcaaagtaagcaatcgaatgngaaagtcngcactttcccttagcattcaagaaaatggttaattatattctatgcatgcatngcatggtttgggg

SEQ ID NO: 103764 - DNA, 640 bp, Triticum aestivum
  unsure (1)..(640): unsure at all n locations
  Clone ID: PAT_TA_103764
gngacgagcancactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctgggcaacaacaaatccctgttgttcagccatccattttgcagcaggctaaacccatgcaagctattcctccagcagcagtgcagccctgtggcaatgccacaacgtnttgctagggncgcaaatgttgcancanancagttgccatggtgatgcaacaacaattgttgccagnagtttgccggaaatccccagnaatcccgntatgggggaaatccgggctatn

SEQ ID NO: 103765 - DNA, 640 bp, Triticum aestivum
  unsure (1)..(640): unsure at all n locations
  Clone ID: PAT_TA_103765
attcggcaccaggttnnngtttttttttttttttgngaaaacacatggaaatcattgctatatactacttcctctgtcccaaaataagtatctcaactttagtataactttgtactaactttagtacaaagttgagacacttatttgggaccgagggagtatctgccaaatatgccaagcaaataaattcacaaccaaagcacagatgataaggcttggaatgaataaacaggttcatcacagaagaaacatccttcagcctgagagaactagtctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgntaaaattcgcgttaaatttttgntaaatcagctcattttttaaccaataggccgaaatcggcaaaatcccttataaatcaaaagaattgacccgaggataggggttgagtgttgttccagtttggaacaa

SEQ ID NO: 103766 - DNA, 640 bp, Triticum aestivum
  unsure (1)..(640): unsure at all n locations
  Clone ID: PAT_TA_103766
ggcaccagcgtcttgggactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaaagcatgtccccgtgctgtcttttgtagatctcgagcccacttgtgattgatgaggtgaggactggtgcttaccgncagctttttcacccttgacagntatcagtggcaaaggaggaatccagccaacactttgcccggggcatttacaccatttggaaaggaaatggttgaatcttgggctttgaccgattaaggaaagntttaaaacaattgaactggncttcaagggattcctggatttcaacgttnttggaagggggaacctggnttttggccttgggttcgtttttcctggancgcttttttgtggacttttggaaaanaagtccaacnttgggttcacgggggganccc

SEQ ID NO: 103767 - DNA, 640 bp, Triticum aestivum
  unsure (1)..(640): unsure at all n locations
  Clone ID: PAT_TA_103767
aattcggcaccagaggggagctagtctcgagtttttnnttntttttttttttttttttcangtccnagagatcaaccnttggtccacaacgaggagtccaaaaataccaaagcacacatccatgcangaaacaggttnggttcnaaaccatttatatcaacatgacancatagcaatgggttaaaagctcgacagtgcaataagctgatganggnttccccntgcccatggngaaaccacgantgccatcangcatacntgggccannaggctgtttgtttgccacangtagtagctgntcaaccatnataagctgnnngttnggngnnatcccnactgnatggntgccacaactgnnnntaacctggcnatggnngntggcattgtgaatgngatgatgatngnngntcanntnattgnagccanngnctgggcctttaccgaancnccnangacctttnncacgcttngnaccttgcttgtnactgtngatntcatnaaacaggtgctntggnaatacatctgacagttgaaaggatccttnaagctgncnctcatttgattggtttnaantggagacgttttcctaccatttgcatcacctttnatgccctcccgtttttccttttactggaccctt

SEQ ID NO: 103768 - DNA, 640 bp, Triticum aestivum
  unsure (1)..(640): unsure at all n locations
  Clone ID: PAT_TA_103768
aattcggcaccaggaanggggcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgnaacaaccaccattttcacagnaacaacaaccagttttacctncacaacaatcaccttttccacaacaacaacaacaccaacagctggtgcaacaacaaatccctgntgntcaagccatccattttgcaagcaagctaaacccatgcaagctattccttcagcagcagtgcaagccttgtggcaatggnccaacgtcttgctaggtcgcaaatggttgcaagcagagcaagttgccatgtgatggcaaccaaccaatggtggncagcaagttgccggaaaatccccaagnaatt

SEQ ID NO: 103769 - DNA, 640 bp, Triticum aestivum
  unsure (1)..(640): unsure at all n locations
  Clone ID: PAT_TA_103769
cggcaccagtctctctctctctctctctctctctctctctctctctctctccttatccattgcctgcctccataccgccgggcacgccccgnctcttgccgccggcgtcgacgctgcagaagccaaggaagggaatggggaaaggcgtcgcggcgggtgttgtagagcgcggtggaccgaggcgtcgcgacggaggacgataaggcggccggtgtgctctcttgtggtgaggcgtcacggcgccccggcggcaagtgagggcggtgttggattctgtgaagcttgctgcagcggggcggcgtcaggccatagtggctgaactggattgcgcgcgctaccgcaacggcgaactggagagaggctccggcagaggacacggctatgacagagcagaccagggcgaggcggctgctgggccgtgcctggacgaggcgctggcttcctcgcagtcaacgcgagccgtgagccgaggaagcacgaggatgaagcggcgggccaaatcggacgacatcagaggacgagctcgaggatgaagcgggtcaggtaatggaggcttctgggcggtctgaatcggggttctcgaatagagggaggcggtcgaggccagtgccggagatgctcctgctgacgcggggcatgc

SEQ ID NO: 103770 - DNA, 640 bp, Triticum aestivum
  unsure (1)..(640): unsure at all n locations
  Clone ID: PAT_TA_103770
ggaattcggcacctctctctnngtctctctctctctctctctctctctctctctctctctctccnggtgccnaattcngcacgagactggctaacacnaatccaccatgaanaccttcctcatnttngctctcctcgccattgtggngacaagtgccattgcacaaatggagaatagccacatccctggtttggagagaccatcncagcnacaaccattaccaccacaacaaacattatcacaccaccaacaacaacaacccatacaacaacaaccacaaccattttcacaacancaaccatgttcacagcaacaacaacaaccattatcgcancaacnacaaccaccattttcacaacaacaaccaccattttcgcancaacaacnacaaccattatcncancaacaacaaccaccattttcacaacaacaaccaccattttcgcagcaacaacnacaactagttctaccgcaacaacaaataccatttggncatccatntatcttgcancagctaaacccatgcaaggtattnctncagcagcaatgcaancctgtggcaatgccacaaagtcttgctagggtcgcaaatggttgcagcagancanttgccatgtgatgcaaccaacaatgtttgcca

SEQ ID NO: 103771 - DNA, 640 bp, Triticum aestivum
  unsure (1)..(640): unsure at all n locations
  Clone ID: PAT_TA_103771
attcggcaccagcaccagcggggnncagtcctcacagcatcctntcagtccttagcttccttccctcgccgccacccaccaaggaaaggaggatgtcttgctgcggcggcaactgcgggtgcggcgccggctgcaagtgcggcaacggctgcngcgggtgcaagatgttccccgacgtggaggccaccgccggcgccgncgccatggtcatgcccaccgccttccacaaggggagctccggcgggttcgagacggccggggagaccggcngctgcgactgcaccacctgcaagtgcggcaccgcgtgcggctgctcctgctgcagctgcaactgagccggnncccaggaggccggccggcanaggcgagcacnaggatgangaggacaagcaagcaagcaccatcaccaccagttnaccaccacccatcgtatnatcaccagccgtnacatgcgcttcgatggncncncgcgctgaatnaaataaaaccaccgatcgtgttnccntantatctgtatgcccctgtcgcgtgtgttctaccagtaactgnnctttactngtgncatttnacttttaatnaaatatattggctnccttaaacttnnnnaatgaaaaaaanatnatttttnaaanctntgaag

SEQ ID NO: 103772 - DNA, 640 bp, Triticum aestivum
  unsure (1)..(640): unsure at all n locations
  Clone ID: PAT_TA_103772
ggaattcggcaccaggccaaggtcaatgaagcagcttacaaactggaactcccatcaggctctcaagtgcacccagtcttccacgtgtctcaactgcgacactgccttcgcccgggtacgaactcttcaactacacttccacagcttgctgacattcctgccgttcctgtggccgtcctacagcaccgttggcgcaagaaaaatggtgcaatgatcgagcaggtcttgattcgttggtcgaatcaagctgtactcggcgacacctgggaagacaagctcgcattgcaggctcggttccctggagcagaggcttgggggcaagcctcatcccaaggaggaggggatgtcagcgcccccacaccagagccacgccttgatgctgacgaaccgggcccagccggcaccgactcgctgcgcttgtccgctgcccagaggccaaaccgcgccaagaagcccaacgagcgctacactgggccggagtggacccagtaggcccaactgcgtcgacacttaagcgatggtcacgagacggatcggcgtccggtggatcaagaacctggcgacggnaccgaaccctagtccctagctggtctttccccttcttnctcaattcgtgtatctgagcttgtaactgaatnca

SEQ ID NO: 103773 - DNA, 640 bp, Triticum aestivum
  unsure (1)..(640): unsure at all n locations
  Clone ID: PAT_TA_103773
caggaattcggcacnagccccnggggggccgcnntncgngnccangggggcncncccaananggaannaanatngccnntacaggcagagacanaaananagcnnntacctnaaccannaannccantctncaattcnncnaangccgaatcaaangcttccnnaagaanngnccgntcnctcannncnncngttncnnnnctanacaatctaccatanncancnanccntttattacctcnncgncnagaatccttgnanctacnccnnctaacnccnntcaaangacnaacanagnaaataccccgnantttncnnaatccaannttganncttaccattccnctancaaccnncaagcnnctntaaggnntatncacnnanccgactaccannantgcnaannncnnntnnnnatccacaaanatttaacccctnntccaganccnncaataaanngcccntnanataannanccctantanggnntccncanccannncacaanncncnccaaaagangnatatnccnntnttcgtanaatcnnncatnaccaanaaaannccccacaaaaantaaatgcactccctnttncaatnaaaaaccttacatcttaanttnnaacaatcancnntcctn

SEQ ID NO: 103774 - DNA, 640 bp, Triticum aestivum
  unsure (1)..(640): unsure at all n locations
  Clone ID: PAT_TA_103774
aattcggcacgagccacaggngacatttccccaacctcaananacattcccccatcaaccacaacaacaagttccccagcctcagcaaccacaacaaccatttctccagccccaacaaccattcccccaacaaccacaacaaccattcccccagactcaacaaccacaacaaccatttcccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggnaacaatgctgccaacaactagcacagattcctaaacagctccagngcgcagccatccatagngtcntgcattccatcattcatgcagcaagnaggnggcaacancaacacaacaagggatgcc

SEQ ID NO: 103775 - DNA, 650 bp, Triticum aestivum
  unsure (1)..(650): unsure at all n locations
  Clone ID: PAT_TA_103775
tntgcaggaattcggcacgagggttngtttntttcactactaaaattctgtccaccattagcttacgggcaatgctccagatccacgcgaacatgcccgagtaaatgctctttatgattccatgttcttatgtaataagacttgatgngtttaatcttccaataattcanacacgggccttccacaacttgatncaagctgntgacaanagttanagggttaggtttgatattattattggtggtatgactattngttctcattatggcacaccttatttatcttntattcagttacatagctngcttgtntnactngaaacatanttataccgtgnacatttagggganactgntgtngagtaaaancganattcacnnttcaaatcacatactggatttagangtgtnccnttanaanccaagagntntttttttgaagaanctnccanaggnggnttntcattnatgaaaaangggggtgtacnanangggtgtttcnnaaaaactaggggggtagaagcagctttnctaanntgnttgncntggaaaaaattanaaccnggggngaacatanctggangcatctctaaatnnnggccnccccttggttttttgaaaccnggtnnntaaanncccccangaatattn

SEQ ID NO: 103776 - DNA, 650 bp, Triticum aestivum
  unsure (1)..(650): unsure at all n locations
  Clone ID: PAT_TA_103776
ctgcaggattcggcacagactacccnggntctttgcggcagccaggacaatggcagcaaccaggacaagggcagcaaccaggacaagggcaacaaggtcagcagccaggacaaggacaacaatcaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtacttcccaacttctcggcagcagtcaggacaagggcagcagccaggacaaggaaaacaaccaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtactttccaacttnttcggcagcagtcangacaaggggcagcaaccag

SEQ ID NO: 103777 - DNA, 640 bp, Triticum aestivum
  unsure (1)..(640): unsure at all n locations
  Clone ID: PAT_TA_103777
ctgcaggaattcggnacgaggtggaacttggaagatggggcngaagattnngatgaccaagctttgggcgctttctcttgtggttttggncctcgcggcggcgcctgncgtaccngcttttcntattatcnttatttcttcnnacttcttcntnggcttntcttttanatttntttttttnncttcttttntctntttcttcttctntttttttttntctttttttttntttttttntttnttattttttttntttnngttttttncntttttttttttttntncttctttctttttttncttttttaattcttttccantntttntttnttnttntttttttntttttttttnttcttttttngtnttttttttttgnttcttttttccnttntnntttnttntttcntntttttttttattttttttttttttttntnattnttntttctctattnttnttttnnttttttnttttttttttttnnnttttttttttctatttatttttnttttttnttttttttttntcttttttnttnnntnttntttttttctnctccncccccccccncccccccncncctttncntcccnttctccccccttccctnttnnctcncccncccntacnccctnc

SEQ ID NO: 103778 - DNA, 640 bp, Triticum aestivum
  unsure (1)..(640): unsure at all n locations
  Clone ID: PAT_TA_103778
attcggcacgagctggcctcagcgggcagctgcagaaagcgttcgtgacaggcgtgccggcgctcaagaggtcggagctccaggcggcctgcgaagatttcagcaacgtcatcggctgcctgtctgactacatgatgtacaaagggacgctgtcgagcggcgtcgagatcgccgtcatatcgacgacgaagaagtccggcaaggagtggtccaagcactgcgaagcgcggttcaggaaaaagataacaagcctgtccagagttaaccacaagaactttgtgaacctgctgggctactgccaggaagagcagccattcacaaggatgatggtgttcgagtatgctcccaacggcacactcttcgaccatctccatgtgagggaagacggtcacctggactggccgacgcggctgcnagtggcggtggggatcgcctactgcctggagcacatgcaccagctgancccgnccggagatcctgaagacgctcgacacgtncaccgtgtacctnaccgannacttnnnggncaanatcgcggacgtnttnttntgntccacnatnccnattccttnntnnacaagggccgnanatngnnancctnnanncctnntggnttttnncnananggnanaancntnnn

SEQ ID NO: 103779 - DNA, 640 bp, Triticum aestivum
  unsure (1)..(640): unsure at all n locations
  Clone ID: PAT_TA_103779
gaattcggnacgagcttcgacgagaagaacaacgccgtgacggtgtccgggccgttcgaccccgacaagctgtgcaggaagctctgctgcgaggccggccgggtgatcaaggagatgcatgtcaatggcaaggaacagaaggcggacaaggacggcggcggtggcgagaagcagaaggcacccaaggacggcggcaaggccgagaaggacggcgggaaggcggagaagcccaaggacggcggcgggaaggcggagaagcccaaggatggcggcgggaaggcggacaaggagaagcccaaggacgccgcggccgccaagccggagaagaaggtcaagttcgacgacgcgccgccggccacggacgccaagcccggcaaggccatgccgccgctgccgcccggcatgagcatggcccnacctcggcccgctcctggagaagatgaagcangcccagcantattttccacgccnnccccaanccgccgngcggcgagcccgctgggcctgccnatgatggcgccgncccgtgccgngcangnggtggccgnccgnccatctggncngccncgncnggncccatntcctncacttaccncncntccctnnancnccagcngncnnncncctcctnnntccgnct

SEQ ID NO: 103780 - DNA, 640 bp, Triticum aestivum
  unsure (1)..(640): unsure at all n locations
  Clone ID: PAT_TA_103780
cgcgcgtgcagtgggtgttcgtcagctgccccggngtgggcaaggccacctacgccggccgcctatcgcggctccacggcgtgccccacatcaacaccggagctctcctccgaaagccccctctgcagcgcgccgccaccatcagccccacccaccgcgcgccgccaccatcagcccccgccgtcggccaaccccccgccgtggagcgccgccaccgcctaccctcctcccatcgggacccccctggatccaaaaatccatccatccagtcctcgccgcgatttctaaatcgaacctaccggcanccggcgtactgncngtttgtnntgagagatncanatggttgaccngnngacnntannttngangcanctannttncnanngatannttctnngntntntnattnttannntttttnttnnntttnntnttnnnttnncttnttnnntttttnnttttnnntntntnntnntnntttntntnnnnntnnntntnnnnnntttntntttntntnnttnntttnntnnnnntttttntttnntntnnatttnttntttntntttnntttnnntntntttnttttnttntttttntttntnnnctntnnnntttttntttntttttncnttntctttnc

SEQ ID NO: 103781 - DNA, 640 bp, Triticum aestivum
  unsure (1)..(640): unsure at all n locations
  Clone ID: PAT_TA_103781
gaggccngccacacgtnccacccaaactagacctccccgcacgctcgaaccagcggcacccatggcacccaaggcggcagagaagaagccggtggcggcggcggagaagaccccggccgggaaaaagcccaaggcggagaagcgggcgccggcgtccaaggaggccggtggcgaggggaagacgaggggcaggaagaagggcagcaaggccaagaagggcgtggagacgtacaagatctacatcttcaaggtgctcaagcaggtgcaccccgacatcggcatctcctccaaggccatgtccatcatgaactccttcatcaacgacatcttcgagaagctcgccggggagtccgccaagctcgcccgctacaacaagaagcccaccatcacgtnccgggagatccagacctccgtccgnctcgctcctccccggcnagctcgccaagcacgccntctnananggcaccaaggccgtcaccaagttcacctnatcctangcttngncgttgttccatgagttgatggcatngngtangntagnttggcantattaatgttacnaatnttntntannaaatttgnnctnntttgnggnctttnaaanaantnnnnannngnttnttnttttgaacccnnnnnn

SEQ ID NO: 103782 - DNA, 640 bp, Triticum aestivum
  unsure (1)..(640): unsure at all n locations
  Clone ID: PAT_TA_103782
aggaattcggnaccagatngccgccgcaggctttgactccatcgcctctccctcctcttcgtctccggccggccaggtagttaacagctccagcagccatggggaaggagaagatccacatcagcattgtggtcattggccatgtcgactctggcaagtcaaccacgaccggccacctcatctacaagcttggaggcattgacaagcgtgtgatcgagaggtttgagaaggaagccgctgagatgaacaagaggtctttcaagtatgcctgggtgcttgacaagctcaaggctgagcgtgagaggggtatcaccatagatattgctctgtggaagttcgagaccaccaagtactcgtgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcatgctctncttgctttcactcttggtgtgaaacagatnatctgctgctgnaacaagatggatgccaccacttccaagtacttcgaaagcccgntatgaaaaaattgtcaaggaagnctctttataccttnaaaaag

SEQ ID NO: 103783 - DNA, 640 bp, Triticum aestivum
  unsure (1)..(640): unsure at all n locations
  Clone ID: PAT_TA_103783
ccaggcgattcttcnggtctcgccccagatccgccgctccacgcgcacccgccaccatcgccgccatggactacctcccccgttgtggccaccgtcgtcctcaccggcagatactgcgttaggagctccgcctgctccctctgcttctactccgaccacaagcccaagacctacgccactacatcgagcggatcgagctcctccctcttcttctgtcaccggcgcttctccgacgaattgctcgccgtcttctgctcccgttcctcgcagagccttccttctgctccacggtgagcctctcgtcaaaaactcgctcccttcccgctgtttccatgcccgtaacaattgcttccattaccaccgtagttagtcgtcgtcgtccgcttcgccgccgcggccaccgccggcttggcactcgcccgcctgcacggacgccccttcctactgccgctacttggcgctggtcaccccgccactactgctgctgctttgccgccgctccggctctgcttctgggccgctgcccacgctnctcttgctatngccacgaccccgcgagcgccccacttgttcggccgcgccggcctncgctggtcgcgcgccccgnctnccctgcccttgcccgncggnccgatgggcc

SEQ ID NO: 103784 - DNA, 640 bp, Triticum aestivum
  unsure (1)..(640): unsure at all n locations
  Clone ID: PAT_TA_103784
aggaattcgggnccagatnnctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaaccacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcaagccatctctctaacaacgtttgaacccatgcaagaatatcctcttgcaacaatgcanacctgcgtcattggngtcatccctctggtcnataatctngccacaagcgattgccaagtgatgccacnncaatgctnccnagaactaccnacatttcntaacncnctncgtcnncancatcccataccnnnctnncattnccaacntcttncccntnntnnncncncnnnnnccnccccnctcncnnnntntcn

SEQ ID NO: 103785 - DNA, 640 bp, Triticum aestivum
  unsure (1)..(640): unsure at all n locations
  Clone ID: PAT_TA_103785
gcgggaaggcgtgggggattcggcacaaggacggtgagtcctcgcccccctgctcactgtccgttaatttattggattggtggagtgtaagagaactgatagagtgtgtcgaatagtagagcatgaatggcccctctggatggagattgcagattgttgtgtgcaccaagctctgtttcggtttcggttgcagattgttgctctcaaattaatttggttgtgccagaatctgtctgatttcgatagcattgtcagaatggtttatagtgtcctggctaattttttaaggcatcattatgtttcctcggtcaaacacttnatctggataaaagaagcatagaacatgtaacaattatttaccaggtttgaacatgctttatccattgcatcactaggcccnccnnccntcnacccnctngatgtaccnaatntattcttcccttttttangncctgtnncnntatnnnntcntnnccttnncttncantttttnaaancctncgcttnttggcttnncncctnctnntntnnctattctagnttcnacaanggggcttttttntncnccntnannnntnattgntncaaagcccntnactcttgaancaaaattnncntnaattgtnggtttnccaagtct

SEQ ID NO: 103786 - DNA, 640 bp, Triticum aestivum
  unsure (1)..(640): unsure at all n locations
  Clone ID: PAT_TA_103786
gaattcggcaccagccgngttcgggntgctcttcctcgacagcccgctcggcaccggcttcagcgccgcgccgtcgcccgccctcatccccaccaaccagaccgccgtcgccgcgcacatcctcgccgccctccagtccttcttcgacgccagcccgccctcgttccgcaggcgcccgttcttcctctccggcgagagctacgccggcaagtacgtgccggccgccggggcgcacatcttcgccgcgaacccgacgctgccggcggggcggagggtcaacctccgcggcgtggccatcgggaacgggctcacgcacccggtcgcgcaggtggccacgcacgccgactcggcctacttcacggggctcatcaacgcgcggcagcgcggggagctggaggcgctccaggcggaggcggtggcgctgacgaaggccgcgcggtggcgggaggcgtcggacgcgcggggccgcgtgctcgactggctgcagaacgccacgggcctcgccacgctctacgactacgccaagcaancggccgtacgccgtcggngggccgtcggcaagtttgntcaaccggcncggaggtcaaggcggcngcttgggcgcgcgccccgggacgttgacnttgggaggagttcaagt

SEQ ID NO: 103787 - DNA, 640 bp, Triticum aestivum
  unsure (1)..(640): unsure at all n locations
  Clone ID: PAT_TA_103787
ggctgcaggaattcggcaccagcacacaactagagcacaagcatcaaatccaagtaagtagtatttaacgcaaatccaccatgaagaccttactcatcctaacaatccttgcgatggcaacaacaatcgccactgccaatatgcaggtcgaccctagcagccgagtacaatggccacaagaacaaccatccccccagtcccaacaaccattctcccagcaaccacaacaaatatttccccaaccccaacaaacattcccccatcaaccacaacaagcatttccccaacctcaacaaacattcccccatcgaccacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaagcttttccccagccccaacaacaatttccgcagccccaacaaccacaacaatcattcccccaacaacaacaatgggatgattcagtcatttctacaacaacagatgaacccctgcaagaatttcctcttgcagcaatgcaaccctgtggtcattggtgtcatctctcgngtcaata

SEQ ID NO: 103788 - DNA, 640 bp, Triticum aestivum
  unsure (1)..(640): unsure at all n locations
  Clone ID: PAT_TA_103788
gggctgcaggtttgtcatcccggcggnggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgnaccatccgctacccagaccctcttcatcaaggccaatgacactatcaagctcgacctggagaccaacangattgttgactttcatcaagtttcgacg

SEQ ID NO: 103789 - DNA, 1191 bp, Triticum aestivum
  unsure (1)..(1191): unsure at all n locations
  Clone ID: PAT_TA_103789
tatncacnaagccnctttgaaantcccccaagggatattaagctggagctcngncggggtggcngccgctnnnagaactagtggatcccccgggctgcattaattcggcaccagagaccatggtgcgggcgcnggggccttcttctcttctctacgntnccctgctcgtcgtgaccgcgctggtcgggcagtacccgacgggctcgctgcgggtggcgacggcgcagaccgtggcggcgccggtgcccgtgcgcgtcggggtgatcatggactggtcgaccaaggcgtcgtcggcggtgtcgctgaggcggcggaccggcattcagatggcggtggaggactactacgcggcgcacccggagtcggccgcgcgggtggagctccgcttcagcgactccaaaggggaggtcgtggcgccgcctncgccgcgttggacctgataaaaaatgaccaggtgcaggccatcatcgggcccaagacatcggcggaggcggagttcgtcgcccatctcggcagcggcgcccacgttccccgtgctcttctactttgcaccttccccgtctnttttccccggngcaaaacgccgtaacttcgtgcgcaccggccgcaacgantcnttcaaggcaacccccgtcgtttgccgtcttngnaagcttcggttggcnccccgtgaccgtcctgacaaggacttcccgtacggggccgggatcntcccggggcttgccaacccgntcaaaacgtaaatggcncggcaatcgtggaccncgtggcttttcccaacgggnccggaccaaaaaccccttnangccttgntttaccgcttaagggcaatgccaaccccgtgttcntcgngccacncaaccatgactttcccggcgggttttccggnggccaataaggnccggattaatttccgggggntacccctgggttgccccccacngggttngnaagtttcttgaaagggttnaaccccanggaccttgaatttattccanggggttnntaagcttcggggcttaacntgaantnccccnaaanaagttaaaaactttttttggccggttaaaggcaaggtttccgaaggaaaaaaccggcnttcaacaagaacctttttaaaannccaacccggaaaagctttgggctacnaaaaggcttgggaaatccccggngntttaaggggccactcct

SEQ ID NO: 103790 - DNA, 1201 bp, Triticum aestivum
  unsure (1)..(1201): unsure at all n locations
  Clone ID: PAT_TA_103790
agngncgtaaccntgtaaactcccnaaggatataaaactgnacngnggngggnngnnnancgggggngaactagnggatcccccggnctgnnttaattcggcaccaggcaagccacactactnggggggnttcttctnataccgtgtgcngntaantgttgggtagggactggacagggaagggccagagctttgtgctttattcttgctgctgtccttgccattcttgctgttgtccttgccattctttttattgcgccgggcctcgttgcgatcacggattgccttcttcgcagcagcagcatcccggcgcaacttctcaggttcgcggttctccttctcctcgcgggcatgggtggcgtgatgtcccgccacgacgtctctgttaaagtagccgttaaagtagccagggttttgcccgggccgcccgcggggagggcgacacgagcggagttgttacatcacatgcactgacatggacttcattatatgactgaactgtctcctcggcgtccactctggccatctagcggtcgtcacgcgcgcgacaccagataaatattcctgaaaaatgaccagataaatattcctgatggagtacaattgactacttttgtagaaaaaggtcaaacaacacaatttgttacgtatgatagtgtgaggcagcaacccgaattggaaatcttggaaggatggttggttaatctatagagagatccactttgncttatgcctggaaaagtctgggcaagttctnactcaacacnaaaggatatgttggtcaaacgcattggcngnccccttttggatgataacataatgggcatctgnaatgctaaggctattgaagatagagcccatcttttctttgaatgnaacttcaatttcangggtttggnaatacttgccaaattgaattgganaacatngnttntaagattccacggaangnattnttnccaaaccangggaaaanaatttggacaccccattntttttttganangaagcttccccanttgcttgggaaaatttggaattntgaggaantggaaaaaaccttnangggggganaanggctaccttttcaacatggggnaantaaatttggcccagnaatcctttanggggganaantttaagccnaagcnttttnaatggggnaaaaaccccccnnaaaaaaagntttttnttaaatana

SEQ ID NO: 103791 - DNA, 640 bp, Triticum aestivum
  unsure (1)..(640): unsure at all n locations
  Clone ID: PAT_TA_103791
tgagcctggcaagcaagtccggagcgcggtgaanatcaagaacatcancaagncccatgtggcgtncaagttccaaacaacagcaccaaagagctgcttcatgaggcctcccggcggcatacttgctccangagaaaccatcatagctacagtgttcaagtttgtggancatcctgagaacaacgagaagcctttagatcagangtgcaaggncaagttcaagattgttagcctgaaagttaaagggctcgagggggggcccggtacccaattcgcctatagtgagtcgtattacaattcactggccgtcgttttacaacgtcntgactgggaaaaccctgcggttacccaacttaatcgctttgcagcacatccccctttcgcagctggcgtaatagcgaagaggcccgcaccgatcggccttccaacagttgcgcancctgaatggcgaatggcaaattgtaagcgntaatatttttgttaaaattcgcgttaaatttttgnttaaatnaagctcattttttaaccaatanggccgaaaatcggcaaaattcccttttttaaatcaaaaagaatannaccggnnataggggtttgagtggttgtttccaagtttgggaaccaagaagttccacttntt

SEQ ID NO: 103792 - DNA, 1219 bp, Triticum aestivum
  unsure (1)..(1219): unsure at all n locations
  Clone ID: PAT_TA_103792
gnnntgagtcttnnnccctattaaccctcactaaagggaacaaaagctggagctccaccgcggtggcggccgctctagaactagtggatcccccgggctgcaggaattcggcaccaggaatactcctcccccaccggctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggcattcctccggaccagcagcgtctcatcttcgctggcaagcagcttgaggatggccgtaccctcgctgactacaacatccagaaggagtccacccttacctggtgctccgcctccgtggtggtatgcagatttttgtgaagaccctaccggcaagaccatcacccttgaggttgagagctctgacaccatcgacaacgtcaaggccaagatccaggacaaggagggcatttccccggaccaacagcgcctgatctttgctggcaagcaactggaggatggccgtacccttgncgactacaacattcagaaggagtccacccttcaactttgtcctgcgcctgcntggtggcatgcaaatnttcnnggaaaaacccttaccgggaagaaccattactnttggaggttnaaagcttccgaaanccnttganaacgtnaagggccaaaatcccggacaaagganggcantttccccggaccaanaaangnctgaanntttgttggcnaacaanntggaaggatgggccgaacccttnncnnattacaattttccnaaaggggtnccacctttnaccttgggcttngnccttcnnggggggatnccaaaantttnggaaaaanctttnccgggaanaaccttnnccctggngggtnnaaaanttcnnnccaatnnnnnaanntnangggccnaaancccggncangggggggntttnccccggnccaaaaannncnnnnntttttttg

SEQ ID NO: 103793 - DNA, 1214 bp, Triticum aestivum
  unsure (1)..(1214): unsure at all n locations
  Clone ID: PAT_TA_103793
tngnnatatttttnnncccttaattaaccctcactaaagggaacaaaagctggagctccactcgcggtggcggccgctctagaactagtggatcccccgggctgcaggaattcggcaccaggagagagagagagagagagagagagagagagagagagagagagagagagagagagagagagngtgngcntgtgctngtccgctnncgcnncnncgngcgcccncgcgccnncgctgtcntcntccncttnncnctgnatcnccgngtgnnnccnctnntcgnctacgngctctcntgctntcncnnanaanccngtngcaatgtncgnccctctgncncactnngcctctgggntctctcnntctctcnntctntacctttngngtntgcatntcttgtananntgtntatctgnccntgtacatccatacccncacantaccttctcntntccngcacgctnncntgntaagnngctgntaccgntcttnncctcaccctctanntatctnccganttatatattgctatgtngatgcctgancnctctgctggtnanctgatacttnatntntacntncacatatcnatagngccccagtccaccnnaactttnatgntgtttttnatactgtctgagantctgntgttgagcttgtgtnancntntannnctngttctcnctttcncatttgcgcactctttatctncnttttttgacttttttgnctcntttttgctntttgtgtnnntnaattttgcccattnnttntnccnnttgtccnngncttntnnntnnnnnttntntgnctnnnnnctctncctcttnanctgnnnnttnccctntnttctttttnaantttnnntccnnnnnnncntntnncactttntnggntttnctngnttnnnnnnttcntttntttttncttnnnttnnnnnnttgcnnttttnnnnntnttnngnnttnttntnntnntnnncctnntttnnttnnnannctnnnttttntnntttnnnncnnntnnnnnnnnncnnnntnnnnncnnnntnnnantttnnnnnttttnngnnnccccntttnccnttttnnnctttnttntnnnnntttnnntnnncntntnnnnnnnttncncnttntnnnctcnnnnnnnttncnntttnnntntttatnnnnnnnnnnnnttnncnnttnnnntntntnnnnnnnnnncct

SEQ ID NO: 103794 - DNA, 1174 bp, Triticum aestivum
  unsure (1)..(1174): unsure at all n locations
  Clone ID: PAT_TA_103794
tgnnatgntgttttganccctattnaaccctcactaaagggaacaaaagctggagctccaccgcggtggcggccgctctagaactagtggatcccccgggctgcaggaattcggcaccagatcagggcttctgaagtgcanaaacttcagcgctaactgagctcggtttccgagaaacatactaccaattccgatccaggttgagatgtcagggagctcatcccgcggcggcgacgacgcggcgtggagcgccaaggagaacaagctgttcgaggaggcactcgcctaccacggcgagggcacgcccgaccgctggctcaaggtgtctcgcgccatgggcgggaccaagacggccgacgaggtgcgccgccactacgagatcctcgtggacgacatcaacctcatcgagtctggcagggtcccgttccccaagtacaaggacaactgattcctcatggagcgaagcatctgaattctgaagatccggcaatcaggagaacctgtttataatctagtccttagttgggaccatgttactgaagcaataaaaagaagaaaacatgtgtgtgtgtgtgtttgtttgtgtgtgtgtgtgtgtgtgtgtgtgtgtaattttaggtttgtaagcaaatcaagtgcgcctagtcttgcatacagtaccatgtaatttccgtgcctatacttagcttttactccttcagtcctctncaatatgntttggagtaaacatcantggtgnaaatccccggnacttgnttgcaatggttatgaacccntgcttgtacaatatacatgctttgctaaaaaaaaaaaaaaaaaacttnagggggggcccggncccaaattgncctatagggagncnnnttncaattaatggccgnnntttacaangnnngaattggnaaaacctggggtncccaanttaannnnctttgnnnanatncccnttttnncannttggngnaatancaaaaggncccnnncnnatgncnttncaaaanttgncnancntnaangnnaanggnnaantntaannntaaantttngtnaaaanncnnnnaaaatttnnnaaaannnnnnnntttttaaccaannggccnaaannggnaaaanccctttnaannnnannaannnccccnnnnnggnnnnnnntnnnnccnnttnnaaaaaaann

SEQ ID NO: 103795 - DNA, 1300 bp, Triticum aestivum
  unsure (1)..(1300): unsure at all n locations
  Clone ID: PAT_TA_103795
tgccngagnacctgacctttttgaaacccccctaaaggtanaaaagctgcancnccgcgtggcnnccgctctngtactactaggatcccccggcctgctangatttattgncacaaactngaccacnaaaaccctnggggcttttntanaaanncnccaggnatgcccctattcancntcncccgncncncggacttctactcgctccccatcctangcgcctncgcctncgnctcccgcggcgcngccncccatancacgnncctgctccncccnctggccnacnacgcngnccgcacgatgcncttctccttnnagaccnttctgaacncganctccaccaacaagctcntccacatcctcaangcctacancaacttngccgactgacntcaactaccacgactcntnttnaggagntcccacataactnnacctntcanaattatctacaagaanggncttaannacatcantntnacacagaacnttactcaannangataagaacaacgnatntnntnattattgccccaaccntanntacatgtantactanccancancaacaancagtnancnaatgnatnannaatncngannacatnnattattnagcatcaacnttaanaatatccctnaattaannttttatnntcanattaactattcaaccaaaanttnncngncnaancctantaattaacnntgcatcnttcctantcnnannacannctnaananttcnttnnccnaataatnanatctnttaanaaattcnnnttatcatnantcaantantantacacatanncccttatnacaataantttctattntnacctttntnatatncaattcacncaacatncctncnnntatanctgcnatncanaccnnntnntnaatacnntttcntcantcanttatcnttnntnacacanntntaatntncaatctaaccctgctcananttcnancattttaccgantatatcttcatcnnattncttataatnnacatnttctatntnttcncnttcctntacntacntacncatnnatntntnntctnnactctnanananaatcatatntnctnnttntaatnccatatntntntcnttctnctcatnttnnttcccataccantcatctcncanatatnncaatctactacntatcatctntnnctataaataccatncacaatatcnctctcaccattnatctatatantaaancacttncaatcatntatactatnncatnctattntatntanannntntnncactncc

SEQ ID NO: 103796 - DNA, 1208 bp, Triticum aestivum
  unsure (1)..(1208): unsure at all n locations
  Clone ID: PAT_TA_103796
tgtgtnntacnnctctaaattaaccctactaaagggaacaaaagctggagctccaccgcggtggcggccgctctagaactagtggatcccccgggctgcaggaattcggcacgagcgaactctctgatccacccaacatttcccgtcgcccacagaacctacccctcctagctaggctacaacttcagcatcggtcggcgatggctaatctggcagaagctggctacgtgttccaacccaccggccgtgagctcgtcggccactacctcatgcccagggcggggctcggcggcttcttcctccccggcgtcatcgaggagggcgtggacgtcttgtccttgcgcccacgcgcgctctccttctcggaaaaccacaggagggattacggcgaggtatggggcttcttcttcgcggcaaagcccgccggcgagacgtgcccgacgcccgggtgctgggtgcaagnacggccagganaaggcgtactacggcggagagggcggccgagaggcagtggcgttccggcncaggttcgngtaccgatactcgtggagggacggngaggtaatatcgccgacgcnctggcggatgaaggantaccgnctcaacaggaacgcggncgtnttncgncgcgcgcacccggcccngtgccggnggacgtcgtcttcgnggnccacaaggtctacaggaagccgntgatccctnggccgncgncgncgccgtcnacagnncttncancgaggacaaggcttcnagagctacatngngtncccgcnanttgaagaancttatgcgggggntaacnctggggaactngggcnaccaaggggnggtgcttcttcttcnggaaggantannattnccccccaanntncatggtngatttnttnaacngtngnngnnnnntttggggntnnnaattnnttgnntggnccccctnnaantnantngnggnnaaaatggttnnnngnanntnnnnnnaanantngntttaannnnnnngggnnntttnnttnnggnnnntnaaaaanannttngggnnntggannnaanttnnntnnnnnnnnnnnnnnnnnnnnnnggggnnnnnnnccnaannnttnnnnangnnnnnnannnnnncccnatnggnnnnnnnttnggnnnnnncntnnnttnnaannaannaaaancccccntttnntnaaaaaaaannnnnnnnnnanannnnt

SEQ ID NO: 103797 - DNA, 640 bp, Triticum aestivum
  unsure (1)..(640): unsure at all n locations
  Clone ID: PAT_TA_103797
cacgaggttcgacttcctcgtcaagcgcctccccggcaccccctccgcgcgcctctgcgacctccagcccggcgacctcgtccccgtcggcggcagcgtcgtcggccgcgggttcgaggtaaccaggatcgccgacgcccgcgacgtcctcgtcttcgccaccggatccgggatcagtccaatccggtcactcattgagtcaggttttggtgaaaatgagaagattgatgtaagcctcttttatggggttagaaaccttcaaaggatggcttatcaggaaaggttcagtgactgggaatcgagaggaataaaaattatacctgttctctctagaccagatgagcagtggactggccagcgtggctatgttcagaatgccttttcaagggcaaagaaagttataaatccatcatcaacgggagcgattttgtgtggacataaacagatgactgaggaaattactagagctcttgttgctgatggtatgcccaaagatcaaatcctaacaaactttttgagttctangacacctttcttgcctttcttggctgttgnacacttactttaccacccgcaaatctaagtggcttcttggtttacaagcaaaatgtgaatgccgaacttaaggggtccccnaaaa

SEQ ID NO: 103798 - DNA, 640 bp, Triticum aestivum
  unsure (1)..(640): unsure at all n locations
  Clone ID: PAT_TA_103798
accaggagagaactagtctcgagtttttttttttttttttttttttttttttttttttttttttttttttnntttnnttcttncncntttttnttntnttnntancttggaactttgancnntactnttnntncntngnttgctnctantaaaancccngctttnacacangganaggnnctnantaaaaaaantttnanttaactagctangcctgccnaatggatcccnttccattacccnnnannaatngncnttntcnaaaanaaacatntcaccctaagcctcccgngggnggnaaaaggcnntcntttgcntaggnggngggggccctccgtaanaaaaaancntnggcccnaaaaacccttattgctttgccnaaatgngtgcnttntnttgggaaatnggggggtaggtgtttnngnggnctccntacnccccnantngggccncccccnncnaagattnttanataaattttccggaggcccccggtaactttngnncnnnnaagtaaccccnccanttttcnaaanagggcncctttggccnctntccccnattggggccntnggggctattttntaattttnccccccgggggnttttgncccntttttttttnntttanggnancgaa

SEQ ID NO: 103799 - DNA, 1244 bp, Triticum aestivum
  unsure (1)..(1244): unsure at all n locations
  Clone ID: PAT_TA_103799
ngnnatgtnnnanatccntttnaaaaccctcctaaagggancaaaagctggagctccaccgcggtggcggccgctctagaactagtggatcccccgggctgcatgaattcggcaccagatttaagccaagaaagnngggctcaatacaaatccaccatgangacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaaccatttccgcagccgcaactaccatatccgcagccgcaactaccatatccgcagccgcaactaccatatccgcagccgcaaccatttcgaccacaacaaccatatccacaatcgcaaccacagtattcgcaaccacaacaaccaatttcgcagcagcagcagcaacaacaacaacaacaacaaaaacaacaacaacaacaacaacaacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcaagcagctgtggcagatccccgagcagtcgcggtgccaagccatccacaatgttggttcatgctattattctggatcaacagcaacaaccaacaacaacaacaacaaccaaaaaacaaccattgagccaggtcttcnttcaacaggcttaaacaaccaattttccatcaggccanggcttcntttcagccatnttaagcaaaanccacanggcccaagggttttgtccaagnctttaaaaaactggccccaatttgagggaaataaggaacctaacgcttganaacgttaccttgcaatgggcaaaggggctaatattccctccattattgggaccaattggttccanatnggnattttttggggacttaactgggnaaaagnaanaactntntggggnnggtnttantnaaacccccggttttttaaaaccaangggtnggnnccntngancccnggnaaaaaaatttaannnggnagggcctttnnnttnnnnntaaacccct

SEQ ID NO: 103800 - DNA, 640 bp, Triticum aestivum
  unsure (1)..(640): unsure at all n locations
  Clone ID: PAT_TA_103800
anacggcacgagngcggggggccnccnagnnagcncgggccgccccccnnacccccaccagngcnngagngcacancagaggccnccnccnggcagagggacgacagngccgacnccgcnnggcagcggncgggngcgcanacccgaancgccaccccaaggaggnggcgcccgnccagnaccccggngcgcagcacgccgccnnggcncccgncanaccaccngcngagcgacgancgaggccaacagnnagnngaacacgcacgggcccgnncgangcgcgcaacgaggggnggggcnnacacgncncnnnacccggcgaagaaggganngncaccaaccacagngcaggncccaggaacgcgnccacgcgnacaagaacnacnccacgccggncaccaaccaangcgcncgngaaagancgcngacaacnanaccnaccaagcggncancgncanngnaccannnaagggccgccnaccnaccacgggaaccccccgacacangcccgnncangggcgccnnnncaccggaaagangncgngcgncnnaaaagaacgnccccnnncaggggggangnnncgaccngcccccggaagccaaancnaaggcaccaccnacggggnncnaccccaaagna

SEQ ID NO: 103801 - DNA, 640 bp, Triticum aestivum
  unsure (1)..(640): unsure at all n locations
  Clone ID: PAT_TA_103801
gcaccnnagatatcaaaanctnngggggntctcancanngattgcaagnnggtccatgnaaangtgtgctnggctagtgtagntnctactcaaactntgnactgcaancttcatgcnnntnatgttctctcacaattcnatgccnatanctaaatcnccgcnagccncatgttntaattcgaatnattagtcccaacgcattanaagccactggancttacaaagtcagatnntncttcaattaaaanatcncctccatngtcaattnannnatngatattgtnttgnanaatntannagntctttnctccttgaaagttnaccangtannnantacctncngnaacattgcttcatnccnaaactctgcttncatattaccacaanctcttangattntncaccttctcgtataatgantccttcnaaacttatttcttncnngctagatttttccagancatnttgttanatancatccngtntcatgtaagtttcttaatttannctaacantttttaanaagtaccnntntatttcnnatcattnccnnntntnncangatncaacttccncngttagaattattcntaanaanattcnntccntanngttgcnccatntngcncatcgcnatttt

SEQ ID NO: 103802 - DNA, 640 bp, Triticum aestivum
  unsure (1)..(640): unsure at all n locations
  Clone ID: PAT_TA_103802
caccagcgcgantcctccncctcccctgcttctcnngnaaanncanggancgctgatgctaactgctcatggtctgctngngctcgtnnttgctggcggacgaacncaccctcactacggagaancctaacanggacgngcncgggngcngctnctntnncnaagnggcccnccttatnancgagnacccacnggncnncnccntcnccgncggcngcggctgcngcagcctnntcctccnattctncgataaccgagntttcnctntcggnaatnacntcngccncgngnggaacaagnccggatnacanaatnnttcaaaanntgatanntggngnccaacttacnntaanngggcnnacttanagatgggcngnggcatgagncccctnannacgannnnngggaaaaaattnaccanatatgntttngtccaacccttatnaantaannaancnagganattggnnananncanntttttntanccgnnganttncnanncttgtcacttaatttcnaccaattngggangaaccncntttatcattnggaaaacanttcaattacttnaaanggcnnctccntattaaaaanattaacaatngttnttnactnggnaaanaaccattgnctattt

SEQ ID NO: 103803 - DNA, 1186 bp, Triticum aestivum
  unsure (1)..(1186): unsure at all n locations
  Clone ID: PAT_TA_103803
tnncntacccnctcgnaattaaccctactaaagggaacaaaagctggagctccaccgcggtggcggccgctctagaactagtggatcccccgggctgcaggaattcggcacgaggtcgagtcctctgacacgagcgacaacgtcaaggcgaagatccaggacaaggagggcatccccccggaccagcagcgcctcatctttgccggcaagcagcttgaggacggccgcacccttgctgactacaacatccagaaggagtccaccctccacctggtgctccgcctgcgtggtgggatgcagatcttcgtcaagaccctcactggcaagaccatcacccttgaggtcgagtcctctgacacaatcgacaacgtcaaggcgaagatccaggacaaggagggcatccccccggaccagcagcgcctcatcttcgccggcaagcagcttgaggacggtcgcacccttgctgactacaacatccagaaggagtccaccctccacctggtgctccgcctcaggggtggtatgcagatcttcgtcaagaccctcaccggcaagaccatcaccttggaggttgagtcatccgacaccattgacaacgtgaaggcgaagatccaggacaaggagggcatccccccggaccagcagcgcctcatctttgccggcaagcagcttgaggacggncgaccctngctgactacaacatccagaaggagtccacccttcacctggngctccgtcttaagggtggnatgcagatctttnntaagacccttaacgggnaagancattacnctngaaggggggnccggtacccaattcgccctatagngaagtcnnattacaattnattggccgnngttttacaacgtnnngaattgggaaaaccctgggggtnncccaanttaanngncnttgnnnaaaatccccntttnnccannttggngtaanancnaaaaggnccnnaccnannggccntttcnaaaantnnncnancntnaanngnnaaagggnaaatnnnaannnnaaaaatttnnnaaaaannnnngnnaaantttngnnaaaannnnnnantttttaaaccnanngnccnaaannggnnaaanccntttnaannnnannaannncccnnaaanggnnnnnnnnnnnncnnnnnnnnanaaaannnccnntttaaaaannggnnncc

SEQ ID NO: 103804 - DNA, 640 bp, Triticum aestivum
  unsure (1)..(640): unsure at all n locations
  Clone ID: PAT_TA_103804
gctgcaggaattcggcacgaggcgctccacgcagcatccgccgcagcagccgcccagagaagtcgccgccggagaaggaggaggatgtcgtggcagacgtacgtcgacgaccacctgtgctgcgagatcgacggccagnacctaacctccgcctncatcctcggncacgacggcagcgtntgggcncnntccccnaacttnccncagtncaagcccgatnagatngctggcatcattaaagactntgaggaanctggacatnttgcaccaactggtctttncntttgaggcacaaantcatgttcatccaaggngnncctgtgnttgacattctttttaaagaaggncaccgattngaatnnctatcaataaatnccgncttgncntctgatatnggtntctacgatgagnctatnncttctngccagtggcnaatttngntttttnttagnctccnctnntannanttttttnnnngntttttttntttncccctttnntttnttttnttnaaatggntngttttcatnnttgntccctcctttattcaaagntggattgtntttnnaataccgtttggncntccttnttnancannctnattttntnnggttcttcntctttttccttaaccacnaaa

SEQ ID NO: 103805 - DNA, 640 bp, Triticum aestivum
  unsure (1)..(640): unsure at all n locations
  Clone ID: PAT_TA_103805
gngannnncnnatttttgaataccccaagctagnacnaacccttactaaagggaaacaaaagctggagctccaccgngggggnggncggtctagaactagtgggatccccccgggctgcaagnaatttcgggncccgagntngatttttnanaannctgaacgtctntgcgacanngccgnctaacacnggantgttcngccggngncgnccannaggggntnatgnaggntannctnntntaantctcgntgcgccangcgagngcaaactagaactggntntcaanggagaccggagaacgcctngnnntnnggccncnanngaannnaggaagncgggagncgctaccacngacgganagnaactcnntatcnaggcnnccnnngcttggaaaccccgntgctntnncatagnnantnctntatcnattncaatngncgngaacatntagcnncctcncgntattgcacagnganggggtgcntaancgnnngntnangcgcnaccncnctcnttctntaagacacaagtnttaccctcnccnaanaggatannggggaactacccncntcatctctagggnanannccantntnngggganaactccncnnggtggcgttnnccnccctgtanacg

SEQ ID NO: 103806 - DNA, 640 bp, Triticum aestivum
  unsure (1)..(640): unsure at all n locations
  Clone ID: PAT_TA_103806
ggaagcggcttcatggcnggngccacggcaatgccccgtcgtgggagcggcggaggtctgattttggggtggtgggtctggtggacgagggaggctcgctcgatctgcgccggctgaggaggagtaggcgcgcggtttcgagggggtggagggcgcacggctggcgtggattgtggaggaggggcgtggtgccgtctgggcagaggcgcggggcgaactgcagtagagaagacaacggtgctgctgaagtgctgatggtagggtgcttctcctccgtaggccaacggtgtgcttgacggggagagtaaagagattcagaacatgtgtttgagaataaacatgcatgatgttcaaaacttggtaaccgttctgctttttgcttgtgagacgaatcaaataagctttggcattttttgaatctgcatgattatccttcagtccgagtgcataattattcgttgagtgttttgagtgcatgggggcgatttaattgatagtccatgcacaagagtgtgatacacgcctatcgatttcattttggtagagatccacaacatcatcacgtcacttcttatgattcttccactgcagttgccatttttttaccatttgaccatnttaaccanttgggnggttggna

SEQ ID NO: 103807 - DNA, 640 bp, Triticum aestivum
  unsure (1)..(640): unsure at all n locations
  Clone ID: PAT_TA_103807
cgggctgcaggaatcggcaccagcgcagccgcaactaccatattcgcagccacaaccatttcgaccacaacaaccatatccacaaccgcaaccacagtattcgcaaccacaacaaccaatttcacagcagcagcagcaacaacaacaacaacaacaacaacaacaacaacaacaagaacaacaaatccttcaacaaattttgcaacaacaactgattccatgcatggatgttgtattgcagcaacacaacttagcgcatggaagatcacaagttttgcaacaaagtacttaccagctgttgcaagaattgtgttgtcagcacctatggcagatccctgagcagtcgcagtgccaggccatncacaatgntgntcatgctattattctgcatnaacaacaaaagcaacaacaacaactatngagccaggncttctttcaacagnctnagnaacaatattcatttggccaaggnttctttcnggcattttagcnaaactnacaagnccaaggnttttgttcagactnaaaaantgncccanattnaggggaataaggggcctatngcttnagancctatctggaatggtgcaangggtacatancncnatattgggccctattggccctntgggatnttttg

SEQ ID NO: 103808 - DNA, 1070 bp, Triticum aestivum
  unsure (1)..(1070): unsure at all n locations
  Clone ID: PAT_TA_103808
gnatgnngccttantaaccctcactaaagggaacaaaagctggagctccaccgcggtggcggccgctctagaactagtggatcccccgggctgcaggaattcggcaccaggttcttgcttgaaggtatcaggaaagacacaaggcaaatgatagaagagcaagaggctgtccgcggccggttgttcaccatccaggatgtgatgcagagcactgtgcgtgcctggttgcagaaaccggtcagtgatgagcaggtccaagtgagaaagttggagctccagcagctagtctccatgttccagcacgaggccgagacacacgccaaagtgagagaaggagtcctgaggagcgacttgcctcctagagcagctgatctcatctatgataatgtgcgtaagcttggaaggtatttctcgttcgaagcaaagtgtgagccagcgcttcaaggttatcacttggtttcgctttgcaccctgtagtagcaacatgtgaggccaagagagcagccgcaaatgcggttggttcgttgcagccgtatagaccggtcctgaagaaactccgcgagcgtattgcggatcaagtttttcgtttcangtctaccatcgtcgcatctctgtaaagtctacgtgtatgtggtatcacaggatacngatgtaatggtccttgagcactgatanggtgctattcacgtggcccagagcccctcgatgngattggtaactttacttttacatgggcaacgacagtgaaggcccatgtanctacaacttttcnagngcttactttcanggtcaaaatgttcaaaaaaaaaaaaaaaaaaaactncnggggggggccccggnccccaatttnnccctataggggggcnnnttacaaattanttgggccgnngttttanaacctnnnnnaattgggnaaaaccctgggggntncccaantttaatccccttggnagaaaatcccccttttnccaanttggggnaataaccaaaaagggccccnncccnnaggccctttccaananttgcccaanccttaatggcaaaaggnnaaatttnaaccctttaanttt

SEQ ID NO: 103809 - DNA, 1069 bp, Triticum aestivum
  unsure (1)..(1069): unsure at all n locations
  Clone ID: PAT_TA_103809
gnagannctntttggaaattaaccctcctaaagggaacaaaagctggagctccaccgcggtggcggccgctctagaactagtggatcccccgggctgcaggaattcggcacgagccccagnaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgaacaaccacaacaaccattccccagcctaacaaccccaacaaccattttcccaagtacaggaaccacaacaacctttancccangcccaaaaaccggaacaaccatttccccangaacaacnaccnntgnnttaaccnttnctaccacaacnggtgaacccctngaaggattancttttggnacaatnnnaccctnggncaatgggggcattccttgggnnaatgaanttggccnaantgnatgnaaggngatnccgnacaatngtggcaanaacttnccanaattcttaanangttcanngggcaagcantcattgggncnngcatttcattatttgncncaggacaaccaccaccacnacnaccccaccagggntnnacanaatgtgnggnctttnttanatttngcaagggncagggtttttntcnactntaaaaaccnattaaattggggggagaacagggnattgggttttggnaacttttnnaactatggggnaacggnttttgttccacccngagggcttcacccccaaagggncccntttgccannaaaaatccccccaaattggngggccaatggaaaaatgcaagcgttttgcttaanagggnaannggaacattngntggnttaantgaatgcccccaatngnttgaaaccntgaaaaaataaagngggngngccccattatgtggggancccnancaagggttnnttaaaactttgggaaataaannccnaaccaaaatttttggttgnntaanaattgnttggnaaaaaaaaaaaaa

SEQ ID NO: 103810 - DNA, 1113 bp, Triticum aestivum
  unsure (1)..(1113): unsure at all n locations
  Clone ID: PAT_TA_103810
tncngtntnaanacctttgtaaaantccccncactanttgntaacaaaatcncganctccaccgcggtggcngccnctctagaactagtggatccctnnntctgcaggaattcggcacgagctcgtggnggttcanaaacgccgtctcgctctnnctncgtctcccgcctnctccccccccgctccgccgccagatcccgtcgagccaagcccacccgcgtcgaagatgagggagtgcatctcgatccacatcgggcaggccggcatccaggtcggcaacgcgtgctnggaactttactgctngagcacggnatccagcctgatggccagacgttcngtgacaagaccatnggaggtggtgatgacgccttcaacaccttctttagcgagactggagccggcaagtncntnccccgtgcantctttgnccgatcttgagcccaccgtgaattnacnaggtncnnaccangggcntncccggcagttttttcaaccccgngcngtttattaagnggaaagggggaccccnttnaaaaaattttncccgggggnnactnnnaaaaatttgggntanngaaatttgngtantttttttnnggnnnnancttttnnnnnanggttggnnntanaancntttnnttnnccatannnggntttttcgnngntnaaaaaaccccnctntggnntnnnaaaaaccnngttttgngnttnggggtncntntttntttnnntnngnccntttntttttcttnctttntnanaaaanaattcnaatntttnngttntntnnntttnnccctttttntcntnggngggntcnnctctttttgnnntntcnctctnnaaananatgttttnnttncccnccntcnttttttntnntgtnnnannccaancnnnttttttcncnatctttttttaaaaaatnnnggtnttttttnaaaantattntgngngcnctcttatntaaattttttntgnggncccnctnntttntnnnnttgattncngcnntnnttgnttntntntnnnannggntnnttnttntctntatnnntntntnntngtggngnngtntannnnnaccntattaanttnnntnttttatattct

SEQ ID NO: 103811 - DNA, 640 bp, Triticum aestivum
  unsure (1)..(640): unsure at all n locations
  Clone ID: PAT_TA_103811
caggcgcttttacacttaatgtgtnccggaaagttgacaccaacaactgagtccactcttctggttgatatgttgatggccgcggacaaatttgaggttgtttcttgcatgaagctttgtagtcaggggctcatagacctgcctatgaccctagaatcggcagtgaggtgcctagatctcccatgtaccattccattggcagctgccatcaaagaggcagccaagaccttctttgctgaaacttacaaggaattcctgtcaacaaagttccaagatgaactgatgagggtccctcttgctggaattcgggccatcttatcaaggaatcaccttgggattgtatctgaaggagccgtctatgagttcatgcttaggtgggcctgttcacagtactctaattcagaagaaagacacaagattttgagttcacggttacttccactagtcccacgagtcctcagtatgaacgattccattctaattgatcacccgtctggtataattaactttactatcaagcgtgagaagtgttacgggctcttccgttaggatcgatgcgttcgncgncgttccattgtgcggggcgtnncttntaccttacgggacctgtatggcgacngacanttcagaattttcgncc

SEQ ID NO: 103812 - DNA, 650 bp, Triticum aestivum
  unsure (1)..(650): unsure at all n locations
  Clone ID: PAT_TA_103812
ggaattgtggtgccgccggagcacaccacggcggntcgtgcaagggcgccgcctcacaagaagccccgaactgtcacgtgcaacgtctgntttgaggacgtctcccggccgtccgatgtctccaccatggactgtgggcattgcttntgcnacgactgttggancgcaacatttnttggcgttcctgngcaacagnggaagaaacacatccactgcattcaattnaaatgnccggccnattttctacnactgcaccnttncggtgccttnnttttggccgnaagtaccccngaaccgnccaagngctttttacaaaccttnnttcttngacttnntnacntgnnnaaaaaaaacncnnttnggttaaaanngtgaccnnannncccccatttttttnnttttcccaaanctttganntttnanccctngncanctgttntntannagttngnatntncnncttntnntntataaanttttntntttaaatntttatcnattcncaattncnnttnaacatatccnttttccacntttnnaataaannntnttannatnnnataannttttaanttgnnannatanatgtaantctntatnatttatcannanntcctaanaantntnaantttattaattntgcnnntta

SEQ ID NO: 103813 - DNA, 650 bp, Triticum aestivum
  unsure (1)..(650): unsure at all n locations
  Clone ID: PAT_TA_103813
atttaagccaagaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaaccatttccgcagccgcaactaccatatccgcagccgcaactaccatatccgcagccgcaactaccatatccgcagccgcaaccatttcgaccacaacaaccatatccacaatcgcaaccacagtattcgcaaccacaacaaccaatttngcagcagcagcagcaacaacaacatcaacaacaaaaacnacaactancaacaacaacancaacagatncttnacaaattttgnaacaacaactgatttcatgcagggatgttgtattgcaacaacacaagcatnaanggtatggaaanctcacaaagtttttgcaacaaaagnacttaccaancttgggngccnacaatttgttntttgnaaaanagctnntnntt

SEQ ID NO: 103814 - DNA, 650 bp, Triticum aestivum
  unsure (1)..(650): unsure at all n locations
  Clone ID: PAT_TA_103814
accggtaaacctccgatccgagcgacccgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctacgtggtggtatgcanattttgtcaagaccctnaccggcaagaccattaccctggaggttgagtcctnanacaccattgacaatgtgaaggcccaanatccaggacaaggagggcattcccccggaccagnanngcctgatntttncnggcaaagcaactttnggattgctcatcttnnggattanaacnttcnanaagggagtccncccttcnctttngtgggttaagcntccnnnggggnnantcnnaattttttanaanaacnctnannggnanataccattaatcnntngaaggggnngannnttttnacnantcnnaatnnaactnattanggtnnaaanatctnaatnttcngnaattgnnttnttccnnc

SEQ ID NO: 103815 - DNA, 650 bp, Triticum aestivum
  unsure (1)..(650): unsure at all n locations
  Clone ID: PAT_TA_103815
aatctgttgagggggccgacggggaacaccggcagggaaaggccgtcgcggatgtcgccgacctcgggcccctcgatcgcgtcgaaggtgttgacgatgaggcccgacgatcgcctcgccgcgtcgacgaaccgctcgagcaggccggcgaaggtatcgaggctgctcgcgtcgatccgctgcaggtctctcacccggaacggcggcagctcctccacgggagcgtccgcccgcgactcgtcgtatggcaggtggcctttggcgagcagcgccgggtaggccatgaaggtccggaagctggccgcgctgctngtcatgagcgccagcgccggcacgccgangtccctcgctgccgcctgcgccgagaaccacaccacgtcggtgaccacgcancggacnccccccttnggnganganccgcnggtcaagcccgtcctttaangcggncccgcaagaggcattnaacgcctncaggaacncccnnatttttcttttancncnnnnnnnaangtnnnnntgcnnnnnancgncncnaaaaanggnnnnnttccnanngnntnnaaccccnnntncnnnnncntnnnanntnnnnntnntnnaacnnnnnnnaattnnnnnnnnnncnncnnnnnnnnanannncnnnnnnna

SEQ ID NO: 103816 - DNA, 650 bp, Triticum aestivum
  unsure (1)..(650): unsure at all n locations
  Clone ID: PAT_TA_103816
cctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgnatcaccatgcgcaagacggcgggcaagcccaaggtggcggcntccagcagcccgtggtacggctccgaccgcgtgctctaccttcggcccgctctccggcgaccccncgagctacctcaccnggngagttccccnggtnactacggatgggacaccgagggccttttngccnaaccncaaacctttnccaanaaccngnagnttgaaagntnannccnttnncggttgggccatgcntnngcgncncntgggctngantntttnccngnaattncttctccctgctaaggnnntaaantttnnntaangtcctntntgnttaaanggacnntttttnaaaaanttttatacnanagggnggngctnttttnntantttngtnntaanctcnanccttnttgnaattttnaaanaantntanttnccantttttgnncttcnaagnanttantnaattngccnnntatnnntnnnttantatntttnttntnnttnatccantttncn

SEQ ID NO: 103817 - DNA, 650 bp, Triticum aestivum
  unsure (1)..(650): unsure at all n locations
  Clone ID: PAT_TA_103817
gccgccgccgcctcctcgtcctctcggtcccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgaaatgaacaagaggtctttcaagtacgcctgggtgctttgacaagnctcaaggcgnncgtgagaaaaggattnaccatcgaatntttgcccttntggnaagtttaananaacaaagtacttcngacccgntnttgnnncccctngtnancgggnnttnaataaaaacatgnnnnccgtancntccnaggtngannggntnntttaaanantnaaattccncanntgggggggtttnnagggtngtttttncaaangnnngggaatacccctnaancncncctttcttttnttttnncntttttgngtgnaaaacataaanantctnngagntntaaaaaaaantntannnnccnnnnnttttananaanctttaaangtnttttnttnnaaaaaaaatantnnnnggnnntcntttttatctcncnataaannngnttntttaatactt

SEQ ID NO: 103818 - DNA, 650 bp, Triticum aestivum
  unsure (1)..(650): unsure at all n locations
  Clone ID: PAT_TA_103818
ggaattcggcacgaggcgctgctgtcgngcctgctggtgctgctcctctccctcgacaagttcctcctccactacctcaagcgctggctctccggcggcggcggcagcataatcccccggatcccgaccggcgccttcaggccgcgctcgcaccgacccatggcggccgccggcaggtggagcgagacggccatgctcgtcatcgacatgcaggtgcgcgctctccgttcctcgatccgggccgttccccttcctccttcctttttgttgttaaagaatccagtttttgttgaggcgggtcacctgaccgacctgcttgtgagttattgcagaaggatttcgtggacccggctatgggcagcccggtgctggtcgccggcggcgaggccgtggtccccgccgtcgctgaggccgtcgccgtggcgcgggagcgcggcatcttcgtcgtttgggttgtcagagagcatgacccttctggaagagatgttgaacttttccgtcgacacttgnattctggaggaaagggtccgacagtgaaaggttttgaaaggtgcananctggctgacgggctttttatcaaagaangtgactacnaagttggtgaaagacaagaatttaatgctttcttttgcgangcacctttgattcc

SEQ ID NO: 103819 - DNA, 357 bp, Triticum aestivum
  Clone ID: PAT_TA_103819
gctagcgcgtcgctcgccgtgctcaacgccgtcggcttgcacggccgccgccgacgtgctcgccgaggtggtagacgagcttccatcgtgggtgccgactgcagatcgtgcgctcctcgaaggatcacgcgccggcgccgtccaagcggacgtggtggtggccaaagacgggagcggcaagtacaagacggtcaagcggcggtggacgcggcgccggaccgcggcaagaccggtacgtgatctacgtgaaaaaaggggtgtacaaagagaacctggaggtgggaaaaaaaaacgccagctgatgatcgtggggggacggcattgacccacaatgatcaccggcagccccaacgtggt

SEQ ID NO: 103820 - DNA, 650 bp, Triticum aestivum
  unsure (1)..(650): unsure at all n locations
  Clone ID: PAT_TA_103820
gaattccgcaccagagangagagagccgcccttnnctncccccaaangccagagacggacacnatggcggngcccacctnctncgcgggattcaccctcgcccccttntccaccccaaaaccctaccgccgcaccgccgcggaggctcatcctctgtcgccttctntncggccgctccaccccgcatgcgccctatcagtctcgggcgcccgcgccgcgcggtcgccgcatggtcgcggncccggccaaggtcggcgccgcatgccgtcgctcgacttnnacaccgccgtcttnaacaaggagaaggtttcctnncccggcacgaggagtacattttgaggggngggcgcaacctcttccgcttgttccngaggcttnaanggcgtaagcaaatcggggtnatnggatgggnttccaaggtccgcgcaggccaaaaacttanggattctttgtggaagccaantctgacattgttntcaanaatggcctcaggaaaaggttccaagttttttaaggaagacgttggtgcttgatttaaccgaggagaacgggaacctttggaganatattggaaaacggcttttgcagngatcttttcttgntgtgatttaaattttgccagcagacaactntaaaanatnttttttnat

SEQ ID NO: 103821 - DNA, 650 bp, Triticum aestivum
  unsure (1)..(650): unsure at all n locations
  Clone ID: PAT_TA_103821
aattcggcaccaaactgggntgggggttcnccgccggcctggtgtcngcntccgcggcgactggaacgagcgtgccgccgccgctnccgatgctgccatcccgacggcggcgcaacttgcgtggcancggcgcgaggtcatcatgttcttcacttcgggatgaacaccttacggacgtggancggggcacgggggccgaggacccggccctntttgcccggccgcgctnaacgccaaccantggatggacgcggcggnggncgccggcgcctnnctngccatctngtngncaaacaccacgacggcttntgctntgggcgttcgnctacaccgccacttcgtncgcgccancccctggcacgccngcaacggngacgtcgtcggtgagttacgggcgcgggccgcgcacgggcgttnaccccggctttncttttnccgtgggaactttaccaaccgncgtntcggcaaaaagtngngtacaaccaagtactacatggccancttnacnagctttttaaccggttccgggaaggtntgnganatttgtttnacgggaacaaaggggacaaacccnaancaaantnacttaccatttccagantngtttaaaccnnanggaantttagggttnattnaaattttttccnaac

SEQ ID NO: 103822 - DNA, 650 bp, Triticum aestivum
  unsure (1)..(650): unsure at all n locations
  Clone ID: PAT_TA_103822
tgcaggaattccgcaccngggnggggngagntagagagagagagagaganacacagagagatatagagananaganagagctttggcaaccatccgccagaagtctgtgttcactgacgtccgtgttgaagcgcagtaccgtcacatcgaggtttttgacatgggtttgccggaggagccacttcaaatcactcggtgtaccaagccaaaaggcgaccattacaacccctttgtaatggatggtggcaagtacattggctaccatcgttgcaaaagcgaccatcttgagcatggagatgatgtcccgaggcggttcgacaagctgcagtcccatcatgaanatattggtctgtttagggttgccggtgcattcccggcattttccaaanatggctctaagcttgcattctcgataacgagttcaaaaccgtgtggctggccnatagtgaccgaatgcgtgttgtcttnnaaacngatggncttatggcgtcttntcacccggggtggaacccaaaaaaagatatctttatnttttttttggaaccgtctttttaaagcgaaccaaattttggagaattacnccttcctcacctatnanttggtgccccaaaaccggnanntgtttccaaagggaaaattcaatnatgctt

SEQ ID NO: 103823 - DNA, 650 bp, Triticum aestivum
  unsure (1)..(650): unsure at all n locations
  Clone ID: PAT_TA_103823
ccggctncangaattccgcaccgagccgnggtggancgccccgtcgcggaggaggaaagcgaggactcccccgccgcggccgcttccggcgaggaggaggacaccggtgcccaggtcgcccccatcgtgcggctngaggaggtcgccgtcaccaccggcgaggaggacgaggactctntnctntacatgaaggcgaagctatacaggttcnacaaggatgggaaccaatggaaggagaggggcacgggcaccgtcaagctgctnaagcacaaagagaacggcaaggtcccctttttatncnccagccaanacacttaanatctgcgccaatacctantgatcttnaccaccaanatcangaacacncccgcagcgacnagttctttgtnttgcacnccgcaaactttttttaccgagaacttaaagatganatgtttccattccgttttggcacccgttgagaattgcaagaagtttaagacttaatttatgaaatccttaatcctttcaaanaattaaaggcggtgaaancnaaaaaaggttntttcccaacttgacttgttggagaaannttattttnacnaaancaaaacttatggnaaacccccttaagggggaatnaattnttttttaaggngaaaaaaaaccna

SEQ ID NO: 103824 - DNA, 650 bp, Triticum aestivum
  unsure (1)..(650): unsure at all n locations
  Clone ID: PAT_TA_103824
attccgcacnggnnnggnttgctntggtccatcttatacccttgtaccaaactgttgcatacggctaggctcaactttgagcccaacaaattgaaaaatgtgcagacacagcacatgcacattggcacatatctagtggccgttcattttgaaatggcagcaatccanccagggctggagcacggcactctccttgttgaatggtttcatttcattcaagtggattgatgtcaaatctggattgcatctagcgccattgttatctcgttgattagcatcgtcaactcgttggagatcgaccgggtggctagctaactagcattgctgatacaaccatggcgggcactctaggcgcatcccttgccgctcgtcggccggtccccttnaanggcgtnggngacngtgatgaccatccctctcccnccgaagaatacgcggacgttattttcgcatgctaccattaccgngcgcnganggcttgtgatcgccaaaaacaaggncctgggagttcacaatgggtnggggggtcttttttttcannggggttcncttaaaccccacgaatgggttnctttttttaaancttttacnccgncannaaaacaaattnancccttcctnnccannttatanaaaanacttcaacnntt

SEQ ID NO: 103825 - DNA, 650 bp, Triticum aestivum
  unsure (1)..(650): unsure at all n locations
  Clone ID: PAT_TA_103825
ctgcaagaattccncacggggngcgggatatactgctggacatctacttctaagaacatgaataagagagcatgtttggaaaattcagttatgttactgaaattcttggtgtgttgtttcagaaatccctgacatggttttctatcttatactttggaattatgtcacgcggttaaaataagggcatcattagatgggttttgaattgcttgtgggtatggcactttgctagagttcaattgtatgttttttccactggacacctagacacagtttggtctcagtgtgatgtgtttattttcaaagctgatgtggacaaactgctctggcagttctttggctaatcatatttagggtaaaataaattctttggcagttctttggcctgccccaactttgnttgggactaaagggttttggtggtggttggttattgnttcaaanataactttattttctgttnaaaaataactcccttaaaantggatctccaaaaagcctntgtgattctcctgagaattgcatcctcnaaacaccataatggagccttaaaatggatcttcacttgagttcataaaanaccttggcanttgttggttgaacctcaatataaaatgttaanaggnganatttgatgtctttntttnnan

SEQ ID NO: 103826 - DNA, 650 bp, Triticum aestivum
  unsure (1)..(650): unsure at all n locations
  Clone ID: PAT_TA_103826
gaattcggcaccangggggnngcngtnctnatnggacagntccgtcggcgcccccgagctcgcaccggcacggcgaggctgaccactgctcgatatcctaactncaacccanccaactcccgcgcgtagaccctaattcaaaggcaacctaatccctcgccatggaggattccctngtgccgccggtgcctnctgccccaaccacccttttctnactngccggcgatcacatnttgacagngccttctaccgcacgctctccggntcttttccactggcttcaccaccgccctngcagntngctgcccggcgcccctggaagtcgagcccgcnctncgaaccctatctgcnacgagtaccacaagggtgctcngtaccgnctgnataccccagtttaacggggnaangacttatgagaanaagagactgcggtaaggactttttttatttanaaaccctcaccnccgnagttgatgcaaccacccggtaacctatttgaaaacccgntttggnacccaaaaaaacattggagcatnaaatggccggaggtnaacnggcggagggcgtaacaaaaatggttntngggggnacctttccntganaattttncttantggaaganattggggcaaaagattttttaagnccan

SEQ ID NO: 103827 - DNA, 650 bp, Triticum aestivum
  unsure (1)..(650): unsure at all n locations
  Clone ID: PAT_TA_103827
ttcggcaccagctnnnnctgtgcactncccccctccgncgacgccccaccactctnccccttctncttcaccgncgccgccgccgncgcaatggactccgtcgcgtcgtgggggctgaccccgctggcggacgcggacccggacgtcttcgacctcatcgagcgggagaagcggcgccagcggagcgggatcgagctcatcgcctccgagaacttcacctccttcgccgtcatcgaggcgctcggctccgcgctcaccaacaagtactccgagggcatgccgggggcgcgctactacggcggnaacgacgtcatcgacgagatcgagaacctttgccgggaccgngccctcgncgcttcgctngacgccgctctggggcgtaacgtgcagcctactccggttngccgcaatttgncggatacccgggctcttaaccgacgacggatatggggctngacttcctnaggnggcacctcaccacgggtatacaccgccggggcaagaaanctcgccacttcatntantttagagctgnctacaggnaaggcgcacggtaattnctacaaaagctgagagaagcatggatttcnccaacttatattgggaggaggctacccaggatggatacccagntaagggcgtgcnaaagg

SEQ ID NO: 103828 - DNA, 650 bp, Triticum aestivum
  unsure (1)..(650): unsure at all n locations
  Clone ID: PAT_TA_103828
gcaggaattccgcacnggggnagntagttccccagctncaacagccattatcccagcaaccacaacaaacattttcccaacctcaacaaacattcccccatcaaccacaacaacaagttccccagcctnagcaaccacaacaaccatttnttcagccccaacaaccattnccccaacaaccacaacaaccattnccccagactnaacaaccacaacaaccattttcccagcaaccacaacaaccattttcccagactnaacaaccccaacaaccattttcccaacaaccacaacaaccatttccccagactnaacaaccccaacaaccattttcccagcttcagnaaccacaacaacctttttccagccccaacaacaattaccgnaggcccaacaaccgnaacaattattttcccacaacaacnggnattnatttaaccatntttncaacaacaggtggaccatgcagaatatctttgggacaatgcaaactgngnaatggggnattcctctggncaanaatctgggccaaancgaatgccagggatgcgggacaatgntggcaacaaattnacanaattnttanaggtcagnggngggcctcctgggggggngtttcnttttttgggggggggggacaacaacacaac

SEQ ID NO: 103829 - DNA, 650 bp, Triticum aestivum
  unsure (1)..(650): unsure at all n locations
  Clone ID: PAT_TA_103829
aggaattcngcaccggacgggcaaagcactcaacaatgatgattctttataatctacatgattcagcttgctctgcctgtcaccgggccatggatcaacgctttgcgtggcggtgcctggtttgcactggctgcaaattttgtgattcatgctataaacaagatggcgaaaatttgcacatacataaactcaaacagacggncaatcagcaacaactgccaaactacactctgcaggattaccttgagagcttggtgcatgcatcaaaatgcttccatgatccgcataattgcagtttcaaactgtgtgttacaatgaanaagttgttctaccatggtgtacgatgtggnatccgcaaccaaggaggntgcaggaattgtgtcttcatgtggagacttntgctcactnactcaaaacaagtgtgatcaccaagactgntnaattccagatcagagatctaaaagtattnattggcaanggccaaatgctttctgctngacctntgcccgggnatgctaccggncaaaaaataacccctaggtttttntagcncaaaaatttntgntgnaaatccataaaatgttggtgtcctccccctttacccgattgcaagtgcgaaanaaannaaaangggaacttgtggngggggg

SEQ ID NO: 103830 - DNA, 650 bp, Triticum aestivum
  unsure (1)..(650): unsure at all n locations
  Clone ID: PAT_TA_103830
gggctgcaggaattcngcacggggnagnngagcgcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttcatcacaacaaccatatctgcagctgcaaccatttncacagncgcaactaccatatncgcagccgcaaccatttngaccacaacaaccatattcacagncgcaaccacagtattngcaaccacaacaaccaattngcagcagcaggagcagcagcngnacaacaacaacaaccacaaccaatctncaacaaaatttgcacaacactgattcatgcaggatgttgtntgnacaaccaacatacgcatggaactnacaaagttttcaagaagtcttaccactggngcacaaatgtgttgtcagnactgtggaaatccccaacaatncggggccaagcatcacaatggtggtaagcttttttttggttaa

SEQ ID NO: 103831 - DNA, 650 bp, Triticum aestivum
  unsure (1)..(650): unsure at all n locations
  Clone ID: PAT_TA_103831
ggaattcnncaccaaaagnggnngggnccaantnagtgtttnttttctttctccccttccttnctagcaaanccagaggcagccagtggtggngcccattttctcgctctgatccaagcctttcctcaaagcccccggcttttgccgattgtttggtcacttcaagaatctccgaatatgttcttgctcctgccgccgccctgctctgatccgccacccatccctgctctggaccctgtcgcgctctntntctttnctnctgcggcggcatttcgcggcggctgggttctctgccaggagaggattctggcggcctggtttctgcnngatttggaanccaattttnggggcggnttcgccnnggtgtggaacaaggttnctttttttgcggggcaggaattngggatgaattntctggttcttgaaagccgggagantnttttacgaccccccctgcgnccgtttcttgggggcaannttntnggcgaattctnnccgaaantccgnnaanntgggcngttgagcccgttctttatccccgggctccatttntcttngctccgnaaaggcctttccaattcccgagcccaaagcgnaggnagaggcccgtgttgnnctncgtgaccggaaatttncncnnngcctctttn

SEQ ID NO: 103832 - DNA, 650 bp, Triticum aestivum
  unsure (1)..(650): unsure at all n locations
  Clone ID: PAT_TA_103832
attcggcaccagggnnnttgnctccttctggagcactaacaacaacgtgtctgcacaagcagccttcgtttacccagtgccagaaggatcatacagcgtaaacatttcgtgcgaaggctttcaatctgttgaccacatagggggcaacgaggatggatattggattggtttgattgcctactccaattcgtcaggagacaattggggtgtaggcaattacaaagggtgcagtttcaagaacttcttggcaaccaatacttggagaccaggccacaaagatctcaagttgaatgattgtcaagttcacagatggacaaatagttgaaagggatgccgtgatgtcttttnacgtcgaagctacaggtctgatgcctgtttctacctaatgggtccaaaacaatgaaaactgacaagtncactatgtttgtctnttaccgngggnacacaaacaaacnaatggnatttggtccatatctgtgacatcnatgaatccnatgttgaggcagaacgcatacaaggaccctnnaacttccatccgttccaagacatctttgttccagcggtttangagccatggccacataaccnatcaaggnttgggtgatgtgaaacttccnncaaaacaaacattgtggttgaanaaanaaaaa

SEQ ID NO: 103833 - DNA, 650 bp, Triticum aestivum
  unsure (1)..(650): unsure at all n locations
  Clone ID: PAT_TA_103833
gggctgcaagaantcggcacgggnnggggtgagaaaagcagacactacncatcanaaacagactaatcagaaaaatactgccagtcaggtacattcgagccaagaaaagtcgccctttcaaaagcaggctggacagaaatacgttgccaattactcacagtcaccacaaagccatggaagcactgtgaatcacatacaaactaatcagcaacgcactgccaatcagaatcagtcagagtcgagccaggcagacacagccaacgttttaagagctacaaaggaattctttgtgaatcactcactgctgaggcaagcaggcgtgaacaacatgcagagtaaccaggagaacaccgccattcgattacaattaggtcaagccgacactatnaagcaaatgcaaactgtgcagggaaatagcactgatcggtcacagctggtccaangcttacctgttaatcaaacacaaactattcaggaatctttacttagcactnacaagccgagcccagtnaatcttgtgnatcaaatgcagattancgagggaaacactggcnatcaactacnantnaatcaacttgctttttnaacaaggacaaactttgcaggggaatccancagtcgatcacagttgntcanggttaactgtcaac

SEQ ID NO: 103834 - DNA, 650 bp, Triticum aestivum
  unsure (1)..(650): unsure at all n locations
  Clone ID: PAT_TA_103834
ggcaccatttnnncaaggccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctcagtgtgcagccattcatagtgtcgtgcatttcatcatnatgcagcaagaacaacgacaaggngtgcagatccggcggcactggttcagcttgttcaaggtcanggnattattcaacctnaacaaccagctnaattggaggngatcaaggcattggtatttagaacttttcaaccatgtgcaacgtgtatgtttaactgatggtcaccattaacgcaccatttgcancatantcttgganttgtnggcaatgaaaaagcaaagtattcttataggagatggataatngtgcttactgatgcncaancgttgtacg

SEQ ID NO: 103835 - DNA, 650 bp, Triticum aestivum
  unsure (1)..(650): unsure at all n locations
  Clone ID: PAT_TA_103835
ggcaccangttgggggcngncctnctgccgcgcctcgtctnctccctntncgccgcgctgggcaagttctaccctntnctcggccgcgtccgcccctgcccggacagcggcgggtacgagttcttcttgcccncgggaggagggggtggcggtgacaccgtcgagctcaccgtcgccgagagcgaggatgatttcnacgaagctctncggcgacggtccccgggacgtcgcccggctctactcgctcgtgccgcggcttcggtggttgaggggagcggggacngcgggttcgcgctcgccgcggtccaagtgaccgtgttcgccgggcgcggggtcgccctnggcgtgtcatcaccacgtcgctgcgatgactngagctacatgcatttngtcaaaaactgggccggcactgccngttggctttccgtggggaggaaaccnggaccgcgctgccgccccgccgttcttgaccgcgcggncatngcggacccccanggcttgccncaggaacctttaacaaatgcgggagttgnggcaaanggcttcttcttaaccccggggccgganggccgncgcccaactggtattcgttgttacctggncccgggtgattnanaaattaaaaancgtgggcgccacccaaggcgctt

SEQ ID NO: 103836 - DNA, 650 bp, Triticum aestivum
  unsure (1)..(650): unsure at all n locations
  Clone ID: PAT_TA_103836
ccggnctgcaggaattcggcacgagagcngnatgtnactgctccatgggaagccgtgagataaacagggagtttagcgggatcaaagtgccccgcagggatcgccaatttatatacagcaggttcaagccatgccgtgtttgccgtgttgaatccaccatagtaacaaggttccttccttcgcatggctgaccaccacaganacaggggtgtcctaagcggnggnggngccttnggcgaccgcagtggccatggaggctacggnggngaccaccacgagcagcaccagcagaagcagccgcgctgatgtgcgccctnaaaggcgcgacggnggcacgggcgccgggtcgatgcttcttgtattccggctgatccttgnangcacccgtcatttggctnaacgtgggcacttccgtgctggtaatnttanacccgtgcttgtgcccgngggcatttcgcttgngctnattttccgccgcttttttancttccggnggcttggcgtgggggngctnttcctgntntnntgggtttcaaaaaccttaaccggnaagaacccnccggnggccaacaaattgaacacccccaaggggnggtttggttcaaaggccccnaaaataaagaagnccggccanaaccccattaacaaan

SEQ ID NO: 103837 - DNA, 650 bp, Triticum aestivum
  unsure (1)..(650): unsure at all n locations
  Clone ID: PAT_TA_103837
cacaacaaccatntccccannnaccacaacaaccatnnccccagactcaacaaccccaacaaccatttncccaacanccacaacaaccattnccncagactcaacaacnccaacaaccatttcnccagctccagcaaccacaacaaccttttccccagccccaacaacaattaccgcagccccaacaaccgcaacaatcattcncccaacaacaacggtcattcattcaaccatctttacaacaacagttgaacccatgcaagaatatcctcttgcaacaatgcaaacctgcgtcattggtgtcatccctntggtcaataatctggccacaaancgattgccaagtgatgcggcaacaatgctgccaacaactagcacagattttcaacaagnttctgtgcgcanccattcatanntgtngtgcattccatnattatncagcantagaacaaccacaanaacaacaggcatgcatatctttntgcnnctatttnaggngaacaggtgggttcaagnttttntantcaanggcaangcattatcaaancacaacaaccngnttaattggnngnnaannnatcattggggttgcaaantctttcnntcatgtncaangtntttgtcccnacaaagtgnncnttaagaagggn

SEQ ID NO: 103838 - DNA, 650 bp, Triticum aestivum
  unsure (1)..(650): unsure at all n locations
  Clone ID: PAT_TA_103838
tggtcgtctgtatatagtaggctgatacataatgagtttgcccttctttccaggtaattagatatatactgactacaaatggaacacaaagctccgccgcgcgaagtgatctagagcagatattagtcgatgaaaccgcagaacccacggccctgccattatcacttttgaaggacatcacaggtgatttctctgacgatcaggagattggacacggtggatttgcagtggtttataagggaatatttggcgataaggtgatcgccgtgaagaagctgtccaacgcttatatgcatgaaactgaatttgatcgagagattgaatgcctaatgcgggcaaagcacaaaaatgtagtaagatttctgggatattgtgatgacacacaaagaagtagggaaagattcgatggaaaacatgtcatggcagaaatccaccaaagattgctttgcttcgaatatgtacctaaagagggtcttgataagtatatcaatggngcatatcgngagtggggaacgtgctataaaataatcaaagggatctgtgagggtctgcanaccttccgatatcatattattacctggatctgaacccgcnatatctgnttnacgatacatggaaccgaaaatactgattttggcctttcaanatct

SEQ ID NO: 103839 - DNA, 650 bp, Triticum aestivum
  unsure (1)..(650): unsure at all n locations
  Clone ID: PAT_TA_103839
ggaattcggcacgagccagcgcctcccantgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtcggccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggcttccagatcttcagcgagggcgggctngactacctcggcaaccccagcctggtgcacgcgcanagcatcctngcatctgggccttgcangtggtgctcatgggcgccgtgganggctaccgngtngncggcgggccncttggcgaaaacctggaaccggtttacccggcg

SEQ ID NO: 103840 - DNA, 650 bp, Triticum aestivum
  unsure (1)..(650): unsure at all n locations
  Clone ID: PAT_TA_103840
gattcggcacgagctccgcttccaccccagcattatctcatatcccccgtccccggcgaccgcgggcatggcggcggcgaccgaggtctactctccgacgccggcggagcagcatcgggagcaggcggcgtggcgggcggtggtgggttggctcgggctcctcctgcaggtccttctccaggtcatccgcggcgcgccctcctccctggcgaagctcctcaggtccctcggcctccgccaccccctcctctctgccgcccccgcggtgaccttcgtgcagctcccctccaaggcccccgccgacgacttgccgcccctgtctccgccgcctgggcggctcacggtacggacccatgtgttgccgcgcgaaaggatatagtctgctatggtaaggatcaccgtggtggttggggtttatacgagttagtggttaactgcagctaaaccagctgcggttctagaactggatcgctatctgcagacaggagtgtcgagcaaggttcattccgagtatgatttcttaggcatgattaacagattagcactatgtctatcttaattaagaancatggtacttgnacactacaaatgtttgnttatttgntgntttcgaatatcaaagcttcttcggttagctttctttttgaact

SEQ ID NO: 103841 - DNA, 650 bp, Triticum aestivum
  unsure (1)..(650): unsure at all n locations
  Clone ID: PAT_TA_103841
gggtctgnttccaccggaatgccactattggcccttgcangtgcgccgngnngcannggcacaaggtgcccaagagcggtntctgggcgcagtccctctcgccgtacgacaaccggatcctcgacttccggatgccggcggacccttcgagatccgtcgtggtgtccacggaggaagagttcttgctccatagggtggtgttcctggtgttggggatggtgctgatggctctggcgcacacgcttagccagtcactggtgttctactatggtggcgccatgaccatcggcattttccttgtggtgctgattatactctttcagggaatgaagcttttgcctactggcagaaagagttcgcttgctatttttgcatactcttcagttgttggcatgacaacatattttctgcactatttgtcgggacttctgcgttcaattcttgtggaaatgggaatcgccgaagacatgcataatcctgtatctgggtatattccttctcgtttgcgtcatcctagctggagcctggttttggtttctggggtgtccgtaaacttggtctaacggaaaaangatctgttgatgctggcgtgcctatttcgtcnagtgggctatctttgattggtttctgctgnctttgaaccttcaaaa

SEQ ID NO: 103842 - DNA, 650 bp, Triticum aestivum
  unsure (1)..(650): unsure at all n locations
  Clone ID: PAT_TA_103842
gggncaccgatggccgtcggngnggaggtcaagctctccatctccggcgcggccctcgcggcgctcctccaccgctgcggggccgccgtgggtgactgcgacggcctcctcttcggccgcgcccaccgcccccctccgccggcccccaccctctccgactacgacgaccaaacccccgccgccccgtgccttttcatctccatctccggccactcctccctctccaacccatgctccctctcagatcccctcggncgncccaacccgccaccgncctcctccccttnccccctcggcttcttttcgtcccgccgncgngcccctctncgccctncatgcgcgagctggccctcgcgtgctccctgtccaaaaccctatcgcccatcgnccacccgctcctnttcatctcgtcttcccctccgcttncgacgatctcttcacccactcctttgattaccgngctttcctcctcgtcggatccgnctttgtcccgaactngctcaccgtcgtcaacgtcgggccccgctttcgggacaagaacacttcttngcccngagtcnccttccgttgttnaaantnaaaccccgncggcgggccccaacaaaacaatcttacaacattggaaaancaaaaaagccggnggaatgcca

SEQ ID NO: 103843 - DNA, 650 bp, Triticum aestivum
  unsure (1)..(650): unsure at all n locations
  Clone ID: PAT_TA_103843
gggctaattaacaaggnatccangntgaanacnttcctcatctttgctctccttgccattgcggcnacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaacaacaacaacaacaacaaccaccattttcncagcaacaacaaccagttctaccacaacaaccaccattttacaacaacaacaaccaccattttcgcaacagcaacaaccattttcacaacaaccacctttttccacaaacaacaccaacagttttccacaacaacaaatncctgttgttcaaaccatccnttttgccancaancttaaaccccatgccaagggtggtttcctttccaaccanccanttttaacccatnntngnccaattgnnccccaaacccttcttttcttaggggtc

SEQ ID NO: 103844 - DNA, 650 bp, Triticum aestivum
  unsure (1)..(650): unsure at all n locations
  Clone ID: PAT_TA_103844
ggggcactagtnaancaccannggaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaacaccaacagctggtgcaacaacaaatccctgttgttcagccatccattttgcagcagctaaacccatgcaaggnattccttcagcagcagtgcagccctgtggcaatgccacaacgtcttgctaggtcgcaaatgttgcacanancanttgccatgtgatgcaacaacaatgtttgncagcagttgccgcaaaatccccancaattccgctatgaggnaattccgggctatcatctacttca

SEQ ID NO: 103845 - DNA, 650 bp, Triticum aestivum
  unsure (1)..(650): unsure at all n locations
  Clone ID: PAT_TA_103845
gggnagttaacancaatccacngtgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggnggtccttcaacagcaagtgtaaccatgtggcaatgtcgcaacgtctttgtangtcacaaatgtggcaacagagtaattgncatgtgatgcaacaacaatgttgncnacaggttggcggaaaatncccgaaacaaatcccgcttctgagggnaatnccggggccatcggct

SEQ ID NO: 103846 - DNA, 650 bp, Triticum aestivum
  unsure (1)..(650): unsure at all n locations
  Clone ID: PAT_TA_103846
gaagngggtcggctacaaccctgagaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaancctggtatggntgttacctttggccccactggtctgacaactgaggtcaagtcccttgagatcaccacgaagtcctctggaggcgctttcttgtgacaatgtcggctttaacgtgaaanaaactttcttttaaaggatcttaaaacgtngggtttttttcattccaacttcttaaggatgaacccctttnccaaggggggnaagnccaancttttaancctntttaagggnnattaatttattgnaaancccncccctttggttnaaaaaaatngggnaaacccgggtttaccccccccccaaaangncnttgggaaatttgnccacaaaaccntttcccaacaaanttttntttnttnaaaaaaattttttccttttaaaaccttgggggggnnccccc

SEQ ID NO: 103847 - DNA, 650 bp, Triticum aestivum
  unsure (1)..(650): unsure at all n locations
  Clone ID: PAT_TA_103847
gcnggggtagttaacaccaatccacaatgaanaccttcctcgtctttgccctcctcgctcttgcggcggcaagtgccgttgcgcaaatttcacagcaacaacaagcaccgccattttcgcagcaacaacaaccaccattttnacagcaacaacaaccaccattttcgcagcaacaacaacaaccaccatttacacagcaagcagcagcagcaacaacaacaacaaccatttcacagnaacagnaaccccgttttnanaanagccnccanttttaaggnggaaaaacanncccntttttngagaanaaaaaaancccaattttttacnggggaacaaanaaaaaaccaanntttttttttcccctttttttttttggccaaccnttttaaaccccnccggcgnggggggtttttttcncccaaaaaanngaggggncccttccttttttgggggaaaaaaaaaaaaaaaaattttttttttttttgggggnnanaaaaaattttttnaaanaaaaaaaaaattttnccccttggggnntgcnacccaaccaattttttttnccacccaaattttntngggnaaaaaaattccccccgaaaaaaaattcccccccccattgaaaaaaaaaatncccggggccnnntnaaaat

SEQ ID NO: 103848 - DNA, 650 bp, Triticum aestivum
  unsure (1)..(650): unsure at all n locations
  Clone ID: PAT_TA_103848
agcanggggntactcttgcgtcggcgtgtggcaccacgaccgcgtcgagatcatcgccaacgaccagggcaaccgcaccacgccctcgtacgtcgccttcaccgactcggagcgcctcatcggcgatgccgccaagaaccaggtcgccatgaaccccatnaacaccgtcttngatgcgaancgtcttattggcagaaagtttgctnatgcccctntccaaanatgatattaaaaaatgggcnnacaaaggtttttttttgcccccaaanaaaactttnttnttgttgcgaaacanagggnggaggacaaccntttttaatntnaaaaaattttttcnatggcccnaaaaaaaaagcgggaaaaccnttgnggnttncctnggggtaantttttnaaaaatgtttgttttcacccggnccttttttattttaaatgtattncccaaaagggcnnggccaaccaaaaggganccccgggnttttttttgggnngggtttttaaaaagggggaaggnnntttttnaannaaannnnnccccaaannnnnnnnnttnnnaaatttncntttatngggnnntnnaanaaaaaaaagggcttncccccntnttnnngnaaaaaaaaaaaaanttnttttttttttttngnccnngg

SEQ ID NO: 103849 - DNA, 650 bp, Triticum aestivum
  unsure (1)..(650): unsure at all n locations
  Clone ID: PAT_TA_103849
aggngggatgaagcagaggaggctcaggtacgggaggctgttccggacgcacatcctgggttgccccacggtggtgtgcatggacccggagctcaaccgccggatgctgctgcagggcgaggccggcggcctggtgcccggctacccgcagtccatgctcgacatcctcggccgcaacaatatcgccgccgtgcacggccagctgcaccgcgtcatgcgtggtgccatggtcggcctcgtccgccccgccgcgctccggcaaagcctnctncccaagatcgacgccttnatgcgcgaccacctctgcggctgggccggcaccgttgtcgacgtccangccaagaccaaggagatggccttgctgtctgcacttaagcaagatcgccggngtnacgggccggnccacttttttgacgccctnaaaacggagctgtacacgctttgtgcttngnaccatnttctttgccattaaancttccaagggaccaacttctaccaaaggntttttangccaaggnaaaaaacttctgttccatttntaaaancaaaatgaatcccnggaacngggaancctnttggngaatgcttcaaccaaaaacatgtttggatgctttttttnaaaaaacggnaatnaccgcnccccgggnaaa

SEQ ID NO: 103850 - DNA, 650 bp, Triticum aestivum
  unsure (1)..(650): unsure at all n locations
  Clone ID: PAT_TA_103850
aggngggggataacattntggatgctcgntgtntattttctacatacaggtttggtggtagtgctggtctctgtggcttagtttctgatgtttagagggtacccctaaagggggactaacctgagacatgtggttgtgttctattagtttttagtaatggaaattggagctatgctcctaggtaggattttttttggaaaaatgggtcatgaggctagctgagtattgtgctcttttgttctatatgtaatcctgacaaacagttctctaattttcacttggtgctttcactgaaataaacttttcagtttgtttgtccaatgagcagcgtggatcttctttgtcctctccaccaacagcgtcgactacccatctcccccaggtagtgcctcatctatgtcccttgccccaagcagtntncaaaactcggaagctgaatatgaaatattggatgttggtttgcatattgatgaacttggtaagcattacaatgnttggaccatgacccaatttcttaaccaggagaactcttttctaaaaaaataccctttcnttnaaaaagcccccaaattgtnaaaccattttgccaatgaaataatattttcactttcaaattattcccaatgtgcccaaggantctttaccttaaa

SEQ ID NO: 103851 - DNA, 650 bp, Triticum aestivum
  unsure (1)..(650): unsure at all n locations
  Clone ID: PAT_TA_103851
cgagngggagagagagagagagagagagagaganagagagagagagagagagagagagagagagagagagagccactaactanccanctancagcttaaggaactagcttgcagctagcgatccatggctcgtctcaacagcaaggctntggcggccgccgtggtcctggcggcggtggtgctgatgatggccggcagggaggcctcngcngcgctgtcgtgcgnncangtngactccaagctcgcnccgtgcgtggcntaccgtgacggggagggcgttctcaatcagcaaggagtgctgctcccgcgtgcaggggctgaacngcctngcccgcagcancccggaccgcaagataacgtgcangtgcctnaagagcctnccaccagcatcaantccatcaacatgggcaangtctcccgcngtgccccgcaagtgcngcgttagcnttccctttcccatcagcatgtcaccaactgcacaatgtcaactnanttaatatatnatcctttctacctgccttcatngacccccctttcnntgganctttaatttntncctttgttggaatgcctcatacccntttttgggcttctttaaaaaaaaaaaaatnaaaatttgcccttttttttttttnaannnnncnnnnnnn

SEQ ID NO: 103852 - DNA, 650 bp, Triticum aestivum
  unsure (1)..(650): unsure at all n locations
  Clone ID: PAT_TA_103852
agcgnnggggggccggaggcgccgccaatcgggcnaccgacccgcagccgctgcgcgcaggcgattcgggcgcgatgagcggcggcggcggcgcgtacagcgacaccgagtcgtcggagagcgacggcgacatggacgagtttgtgctcgtgaaattagcagaaatccgaaaagaagtccagtgcccaatctgtttaggcattatccggaagacaagaacggttatggaatgtttgcaccgattctgcagggattgcattgataaatctatgaggctaggaaataatgagtgtccagcatgccgtactcattgtgcaagtcgacgttctttgagggatgatcctaattatgatgcacttattgcaaccttgtatccagatattgataagtatgaggaagaggaacttgctttcggtgaagaggagaggactcggaataagaaggtaaagtttatctgctgggtaataactaatagctacagcactgtgtttcacatcttctcatgcagtatttatcttccttctcatttttattttatcatcgatatcacttttttgatggaagaatcaagccaccctcgaggagatgattccaaaagcagtccggaggccctcggtaaaaancgtctacggaaaaacttcttgcnatgc

SEQ ID NO: 103853 - DNA, 650 bp, Triticum aestivum
  unsure (1)..(650): unsure at all n locations
  Clone ID: PAT_TA_103853
ttgtcggggggggaacttnanagagccttcctgttcaatatcatcatcaaaagcagcaagttcatcataacccgccacatccaccgacttttcacggtagttttttgccgctttaccgcccaggcaccagaagccacgcccattagtgaaacncttcatngtgagcgtnttatcccggtgctttttgccataccacggggccagcgccancagcgacggaatatcacgaatagtcggctcaacgtgggttttcataaagttctcggcatcaccatccgtcggcaaccagataagggtgttgcgctgcttatgctctataaagtaggcataaacacccagcagcattttggaataacccgacacgggcanagggggggcccggtacccaattcccctatagtgagtcgtattacaattcactggcccgttttttacaacgtcntnactggnaaaacccttgnnttacccaaattaatcgccttgcaanacatcccccttncncagctggcntaaataaaaaaaaaaggcccccacccnatctttnctttnncaaaaattnccccanctctnnaatggnnaaaaggnaaaattntaaancntttattttttttnttaaaaattcncgnttaaaatttttgnnaaaatnaann

SEQ ID NO: 103854 - DNA, 650 bp, Triticum aestivum
  unsure (1)..(650): unsure at all n locations
  Clone ID: PAT_TA_103854
ggngngggaactgctccaatatcgatggcctcgtgcggctcatgacgtggaggtaccctcgtcacctcctcgaccctgttctggatgatttgcgcgggggggaacagcttaccgccgactgcatctacaagatatgtgacctgctgcgctgttcgtggccgccgcagccaatccctgccccaattcctggcatttatcgggacaacagtgggaacgtcaccacaatcaccaagatcagaaaagacgttttcgtcacaaccacagtatctaaagaccatgttccgacagccacaatcacctcaacttgtccgagcaatgatgactgcactcaagacgacggtgttcatatctcaacggaattagccacagacatatcctccagtgtgaacagtanagtctgcttctggcgggagaaccctgatttctcccactgttgaagatgtnttttntcgacaccgggcatggntttaaatnnangccctgggcatgnttccaannatgcgttangggaaagcaccttntttcgggccgtcttananntggacactgntatggncccttggaccctgtgtnaaacatnatactcaacttcatntggnaccacccttgtntttccgctnttnggatgatgtcttccaatcaaattggag

SEQ ID NO: 103855 - DNA, 650 bp, Triticum aestivum
  unsure (1)..(650): unsure at all n locations
  Clone ID: PAT_TA_103855
ccgagnggggatccacgggcccnaaganccgcccatntttngcaactnnccnccatttacaacttnccccgctnntnngttnacttacacaaggttttgtgctatttgctaccatctggtgaaaggaaaanccgctccnatctgtgaggatgcccaccaaggnggcctntnttgacaacttntgccctgccccttnggtcacctcgatttttnttnctncacancataagtgcaacaccncaggttgngtgctctttgctaccatctggtgaaaggaaaagctgctccaatctggcgaggatcggatgctaccaaggnggcctctcctgaaaanttctgccctgccatccggggggcttgattatttnttctcccnccanttggggnaaaaannngntnaaanaaantttntnanggggggggccnncnanaaaannnaaaattttttgnnngnaaaaantnancccnnnnnnnnaaaaangnnnaangggnnnaannntttttttttttnnnnnnnnnnnnnnnnnnnnnncccngnnnnnttttttnaaaaaaaaaaaaaannnnnnnnnnnnnngnnnnnnnnnntnnnnnntttttttttttnnnnnaaaaaaaaaaaaaannccnnnnnnaaaaaaaaaaaaaan

SEQ ID NO: 103856 - DNA, 650 bp, Triticum aestivum
  unsure (1)..(650): unsure at all n locations
  Clone ID: PAT_TA_103856
aggggnnctcagtcctnacagcatcctctcannccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgcccccatggtnatgcccaccgcctnccacaaagggaactncggcgggttccaaaccgcccgggagaccggcggcttcgantggaccacctgcaagtgcggaccgcgtgcggnttgttcttcttcaacttcaactgancccgcgcccaagaagccggcccggcaaaagcnancaccaagattaagaggacaagcaagcaaancccattaccaccagttcaccaccacccaagcgtttattaccancccnccnattccntttgngggcgcgcccgctnnaataaaaataaaaaccacccttcgtgttccnaanttttttatgccccttgtcncgntgtgtttcaaacaaagantggtcctttcttcntgccttcaatttttaattaaaattttggnccctcaactttnaaatnaaaaaaaaaaaaaaaaaaaatnnagggggggggcccggtncccaaattnncccttnt

SEQ ID NO: 103857 - DNA, 650 bp, Triticum aestivum
  unsure (1)..(650): unsure at all n locations
  Clone ID: PAT_TA_103857
tatnnncctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcancacggaggccctcctcaagcaggtcgactacctgatccgctccaagtgggtgccttgcctcgagttcagcaaggntgggtttatcttccgtgagcacaacgcatcccctgggtactaccatggccggtactggacaatgtggaaactgcctatgtttcggtgcacccaccccacccaagtgatcaacgaagtggaggaggtcaanaaaggagtaccctgacccgtattgtncccattaattggatttcgaaaaacatgcccccaagtgcaatggcgtnaactttaattngccntttaaaaccaaccgggctttnnaaggagttcccggnaaagggccttaaaaaannttnaatttaaccaangggggccaacaataatnaaaagggnccaattggngggttttttgnnaaaactntttnaca

SEQ ID NO: 103858 - DNA, 650 bp, Triticum aestivum
  unsure (1)..(650): unsure at all n locations
  Clone ID: PAT_TA_103858
ccagggggggacggcgcgtcngcggagcggcncccngtggcgctgcgggtcctgctcgcccgcgccgaggggtcctcctcgtactctcccccgccgcgggggccccangaggangcgcggcggggcaagcancantggctcgcgctgcgcctgcgcgacctcggctgcgcgtccgccgccgcgtcccgggcccacncgcccgtccccgcctngggctccgtgcgcccggccccggcagcggaggangangaggaagaaaantangangactntccccagaattnntttgccncggcggnnaaattnacnagggtaaatnnaacnngaacccnantcnnnnnngncnnnnnnnnnnnnnnnnnnnnccnnnnnnnnaanntnnnnnnnaaannnnncnnnnnnnnannncnnnnnnnnnnnnnannaannnnnaannnnnnannnnnnaaannnnnnncnnnanaanttnnaaannnnnnnnanatnnnnnnnaaaannnnnaannncnnnnnnntnaaaaaantttnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnntntatnnnnnnnnnn

SEQ ID NO: 103859 - DNA, 650 bp, Triticum aestivum
  unsure (1)..(650): unsure at all n locations
  Clone ID: PAT_TA_103859
cgnggccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacnagaagttcgtccacaagcacaccaagcccgggatcctcttcatggncaacgcccgggcccaacaccaacgggttccaatttntttattttgcacccgtcccctgcaatttgggttnacgggaaacacgttggtctttnggcgaaggtccntncnangggcattggaccttnnttcaaaaaaaaattnnaaaaaaggngggggctttcccncaannggggaanccttggtttccaaaacaaggtnngntnaattnncccnaacttggggggccaanntttttaaaaanccccccc

SEQ ID NO: 103860 - DNA, 650 bp, Triticum aestivum
  unsure (1)..(650): unsure at all n locations
  Clone ID: PAT_TA_103860
agctnngnntctctctctctctccgcagccgcaaccatttccatcacaacaaccatatctgcagctgcaaccatttccgcagccgcaactaccatatccgcagccgcaactaccatatccgcagccgcaactaccatatccgcagccgcaaccatttcgaccacaacaactatatccacaatcgcaaccacagtattcgcaaccacaacaaccaatttcgcagcagcagcagcagcaacaacaacaacaacaacaacaacaacaacaacaacaacaacaaattcttnaacaaattttgcaacaacaactgattccatgcatggntgttgtattgcagcaacacaacatattgcatggaagatnacaagttttgcaacaaagtacttaccaactgctgcgagaattgtgttgtcagcacctatgggagatccctgagcagtcgcagtgccaggccatccacaangntgntcatgctattattntgggtcaacaacaaaaaacaacaacaacaaccntttgggccagggggttcttttnaaaagccttttggaacaatattcatntagggcanggggtttntttccgggcctttttanaaaaaaacccccaaggncccagggnttntttttcanncctttaaaaaantgggc

SEQ ID NO: 103861 - DNA, 650 bp, Triticum aestivum
  unsure (1)..(650): unsure at all n locations
  Clone ID: PAT_TA_103861
accagcanngggnatatctgcagctgcaaccatttccacagccgcaactaccatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatccccgagcagtcgcggngccaagccattcacaatgntgntcatgctattattctgnattaacaacaccaccaccccaacaacaacaacaacaacnacnaccacnaccggtgagccaagtttctttcaaaggcttagaacaatttcattaggcanggntttttcaancttttaanaaaccaaggccagggtttttagcttnanaactgcccaattggggnaataaggaactangctttaaaaacttctttgaatgnggcaagggggtaattccttcatatttggaccattggttccttttgggattttttggggncttaa

SEQ ID NO: 103862 - DNA, 650 bp, Triticum aestivum
  unsure (1)..(650): unsure at all n locations
  Clone ID: PAT_TA_103862
ccagngnnnccctcctcctccttgacccgccgccacctntcctnaccgggaagaaaaccctagctagagagcttcaaagtttcccgcagcacgagagatggcggcgaagggcgatgggccggccatcggcatcgacctcggcacgacctactcgtgcgtcggcgtgtggcagcaccacagggtcgagatcatcgccaatgaccagggcaaccgcaccacgccgtcgtacgtggncttaccgacttcgaacgccttatnggcgacccgcaanaaccaagtggccatgaaccccatcaacaccgtcttngatgccaancgtnttattggccgganattactgattntactgtccanaangatattaaactgtggccctttaaaggttgtttgcttggancctggtnacaaagccccattgaatcaaatggttccaantnccaaaggggtggaagggaaaaaaaacaaattttttncnnnnntttgggggggagaaaaaannnttttntttattnggggncccccccnaaannaaaaaaaaaaancccnnnnnnaaaaaaattttgnnngggnaaaaancnntttttttccntttttgggnccccccccccctttttnnnaaaaaaaaaaaaaannnnnnnntttnnnnnnaa

SEQ ID NO: 103863 - DNA, 650 bp, Triticum aestivum
  unsure (1)..(650): unsure at all n locations
  Clone ID: PAT_TA_103863
ggggggatgtagagcgcaacgccgacgattgccggacctggcgccgcttcgactacgggcacgtgtatgcatcaaagtccttcttcgactcaagcaagaaccggcgcgtgctatgggcatgggccaatgagtccgacagccaggacaacgacatcgccaggggctggtccggcgttcanacggttccnaggaaagtgtggctggaccaaaaccgtaagcangtaaagcagtggcccatccangagatcgagacattgaggagcaaacnagttgtcgctttctangaacgcaagtgaatcccgtggcgtgaacaaanatcacttgtgttggccccccaagctnacctggaagccatctttcanaatcccatnccttanaaaaagctgagaacttttcancccaactgggttcttggacccccaaaaactttttccaaggaaaaatgggngccnttccctncccaagcnaagggnngggcccaattngggcttgtttnntaattgggcctcccnccaaccattcccnggaaaccccaccggnttttttttttttttaaaaaangggttnnnnaacccccaacccccngaaagttnccaaaaagtttntttattttttgnnancccnnaacctttnnnaaaaaaaaannaaaa

SEQ ID NO: 103864 - DNA, 650 bp, Triticum aestivum
  unsure (1)..(650): unsure at all n locations
  Clone ID: PAT_TA_103864
cctgnttgancncactgangngtntatccttcttgacnnnnaggccatatatgacatntgncggcgctcccttgacattgagcgcccaacatacacnaacctcaacaggcttgtttntcaggtcatttcatcnctnacagcttncctgaggtttgatggngctctgaatgntgntgttaatgaattccanaccnanttngngccctacccgaggatccacttcatgctttcctcctatgccccantgatcncagntgaaaangcctaccatnancagctgnnaggtnntgatatcaccaacagcgcctttgagcctncatctangatggtcaanngngacccnnnccacnngnagcacanggnctgntgtctcatgtnccggggggatnttgatcccaaggatggccacgctgttgnggtcccatcaagaccaaancactatcannntgttgactgnggccccactggctncaanngtggnnntanctaccagnnccntgtgtggctaagcggngannttntcaaggccngngggctnngnncatnntancnaaatcaccggngngggnnggnnttntccnnaatannncncnnntttgantaaannangnncnnnnngcttnnaccnntntnccnngggnanggnnann

SEQ ID NO: 103865 - DNA, 650 bp, Triticum aestivum
  unsure (1)..(650): unsure at all n locations
  Clone ID: PAT_TA_103865
attcggnaccaggnggnagttctagctattctgatgcctacaattgctgtcatattggccatccctgttgtgtactttttctgttggaggaagagaagaccagaagaagtgtatctaccttctacctcagatgatattcaacacatcgattccttttttctcgaactaaccaccactngagaaattgncacccgagactttgacaacnagcaaaatgnttggtaaangangaattggtatgggttataagggagtcctacctgacggtgaagaaatagccgtgaaaaggcttggtcagacttccagacaaggaataggagagctgaaaagtgaactggttctagttgccaagcttcaccacaagaatcttgtgagacttgttggcgtttgcttggaagaacaagagaaaatacttgtttatgaatacatgcccaacaaaagccttgatatgattntttttgattctgaaanaaacaaaaanttggactggggaaagaggttcaaaganaatcaanggaaatcnnttngggggttttncaaatcccctccccnaaaaaatttttaaanttggaaaaaannnncccccccngnnnaccnttaaaangggggggnnaaannnnnncnncncnnggggnnnnnnnnnnnnnnnc

SEQ ID NO: 103866 - DNA, 650 bp, Triticum aestivum
  unsure (1)..(650): unsure at all n locations
  Clone ID: PAT_TA_103866
ggtnnnacctaagntaagctaaacagcagcgcgcgagcaatggcgtccacctcctgctttcttcaccagtccaccgcgcgcctggccgcctcggcacgccctgcgcccgccgtcgggcgcacccagctgttcgtctgcaaggcgcanaagagcgacgaggctgcatctgacgctgccgtcgtcaccagccggcgcgccgcgctgtccctnctcgccggtgcggccgccgtcgccgtcaaggncttccccgccgctgccgcctaccgagaancancgaacgtgttttgnaaggngaaaaaaaacaccgactttttggggtacaacggggaaggggtnaaantgatgatcccgncagtggaacccacaangngcgtgagttccttggnagggctttctatangacanttttacncccacaactttnntntataaaccccccaaaaaaatangctcngtcctggggngtttcagnggtttttnncaganntcgggganacatcnngnggttataaactttnannnaaactaaaantccntgngngnaaaaaaaaanaaanttcaaaancncgnaaagaggannaannattatncccccnnnngangnnttttttnnnnngnccnnnnnaaaaangngtnggnnnncncnnnaa

SEQ ID NO: 103867 - DNA, 650 bp, Triticum aestivum
  unsure (1)..(650): unsure at all n locations
  Clone ID: PAT_TA_103867
gctngtccgcaggggccaggccaattgcaacaaccagcacaagggcaacaaccagcacaagggcaacaatnagcacaagagcaacagccaggacaagcgcaacaatnaggacaatggcaactagtgtactacccaacttctccgcaacagccaggacaattgcaacaaccagcacaagggcaacaagggtactacccaacttntncacaacagtcaggacaagggcaacaagggtactacccaacttntncgcaacagtnaggacaagggcaacaagggtactacccaacttnttcgcaacagtcaggacaatggcagcagccaggacaaggacaacagccaagacaagggcaacaagggtactacccaatttnttcgcagcagtcaggacaagggcaacaaccangacaagggcaacaaggatactacccaactttttcttagcagtcaggacaagggcnacaaccaggacatgagcaacngccnggacaatgggtntaaancaggaacaagggcaacaagggtacttttccactttttttaccacanttcagggacaaggggcttttaaattaangaacaaggggcaaccnangggttcttaacccaactttttttttnttgngnaaccaanaaanaangggcaaana

SEQ ID NO: 103868 - DNA, 650 bp, Triticum aestivum
  unsure (1)..(650): unsure at all n locations
  Clone ID: PAT_TA_103868
ttcggggccagaggggaggaactagttcggcttttttttttttttttttttttcaaataggaatatcacgtatttattgtgagatacgggccggctacaagaggtggtctcattctcaaggacaaagaggccgagatagcgagagcacgtgtgcacgggagcgttttgaatatccggggcttcattagttaactatgaccatgaccacacacacacacacacacataagtatatancctgcagtatatacgtaacgcncggaagntagtttttgtnaggcggntggtcgctggctagttctcgaagctgcanaggcggtcggtggcgagcctgcccttgtgggtgctgctnttgtactccttccaggtgaactccntgtagcggntccggccgccgacccctancagntggcgcagcggcgccagcctttngccgaacggcgggcccccgaanaanatcgtggacaccctcggcctntcgctgttaccaccaccctgtgcctacgctcctgaaccttccgttcntcaacacctgcagggcntcccnactttgaccaaaaaggagtnggngtngggccggcacgggggtncaaganccnttcgcccgcaaatttcaacncggacnttccctttggagccngaacacggaaa

SEQ ID NO: 103869 - DNA, 650 bp, Triticum aestivum
  unsure (1)..(650): unsure at all n locations
  Clone ID: PAT_TA_103869
aattcgggaccagctggctgctccgcgagaccgcgaccgcaccgttccccctcggtctcggcggtgctccccggcctcggccgtcggcccctgcctccgctgcgccgccgaggccgaggaacgcctactcccgcagctgctctgcgccccactgcttctcgccaacgcggcgacgtgccgcagccaggctgctgcttcgcttcgccccgggtattgccttccttccactgttgatcaggtcgtgggaggcatatatnaatnaaaccactgatttggaanattgttgtcccntctgaaagatatnttanggngaaagggctattaanatgagtttttgtattttcttnaanancctattntnccttaanaaaaanacngggggcccaaaatgtntatncccctatgtggntttnttttaacaaccntttantgnaaatnnaanaaanaaatntttttnaaggacactagtgcaaattatnaccgngntttnanaaagttgnnccaatngnaanaagtatgnacattnccccanaaatttnaaaccaaattttgtgtttaggcctnaaacttttntaggacattaattntntantggggaaaaaaaagatggtntnaaanaaanntnaancacngggtnaacntnnnanaan

SEQ ID NO: 103870 - DNA, 650 bp, Triticum aestivum
  unsure (1)..(650): unsure at all n locations
  Clone ID: PAT_TA_103870
aattcgggnccagaggnaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttncacaacaaccactattttnacaacaacaacaacaacaactatttnctnaacaaccatcattttcgcagcaacaaccaccattttggcagcaacaaccaccattttctnagcaacaaccaattctaccacagcaaccaccattttngcagcaacaacaactagttctaccgcaacaaccaccattttnacagcaacaacaaccagttttacctccacaacaatnacctttttcacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagnagagcagttgccatgtgatgcaacaacaatgttgncagcagttgccgcaaatccncagcaatnccgctatgangcaatccgg

SEQ ID NO: 103871 - DNA, 650 bp, Triticum aestivum
  unsure (1)..(650): unsure at all n locations
  Clone ID: PAT_TA_103871
ttcggnaccagaggnaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggcactgtttcagctcgttcagggtcagggcattattcaacctnaacaaccagctnaattgggnggggatcaaggtcattggtatttgagaactntttcaaccatgtgcaacgtgtatgtnttacc

SEQ ID NO: 103872 - DNA, 458 bp, Triticum aestivum
  Clone ID: PAT_TA_103872
ccggatccggcgagatccgcccctgtcctgctgctgccggccatgggtgcgtccctgctggaaggaaacagagagagatagcagagagatggcgtgagggagagaagaagaagaataaaaagaagataggagaaggggaaggggccgcgggcaggtcctgcctcctgcggcaggcggcgcgtggcgcggagctgcggcgagcgggcggcagggacgaggcgtggtcgggcatgaggcgcacaggccaggagctcgggcggggcagcgctgctgctggctcctgtggccgcggacgaaggcggctgccggcggcgcgggagcacgcttggggaggagcaggggcgcgcggggcctggagcagctgatgcggcctcgggcggctggaggccagaggtggctggctgctcgggatcgagcagagcttggggtgccatgggacagcaggagctcggcgacgg

SEQ ID NO: 103873 - DNA, 536 bp, Triticum aestivum
  Clone ID: PAT_TA_103873
cctcgttgaaacagagagctcccgcaggttcccgtcaccatggcgcccgaggccccagctggcccaagctcttctccaaccagaacccaagagcagcagcagcaccccacgtcgtcgcccagcaccagcacctcgtgcctcctcctcccttgatcgtggacgcgtccggccgcccacagccgtcgtcgtccgcgtccgcaggaaccagcggttgcggccgccgctgccatgttggagctcccctgcttcgccttggacaccgccggcaagccctgcctccgccgcctcgccaagccccgcaccgccatgcccgacctcgcctctgcttcctctactacgaacagcagcaactcgagggaactgacggcgcccccgagctccatccgcgccgatccccatcttcctccttgtcgcgccgttcatcagtcccgccgccgcctgccaagtctgtcccgccgaagttctcgtcgccggagactgctgcagcttcgtccccgccgccgtttgcctcgccggcggcctgctacttgctgccc

SEQ ID NO: 103874 - DNA, 547 bp, Triticum aestivum
  Clone ID: PAT_TA_103874
gataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacctgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaatttgcttcatctatccccactatggatggaagtgatgaatatgtaagaatgaaagatttacctaattaactacttcctaatcgct

SEQ ID NO: 103875 - DNA, 540 bp, Triticum aestivum
  Clone ID: PAT_TA_103875
tttttttttttttttcgacatcggttttcggctcggcgcgcattaacaactcgatgacctgctcgagcgtgcgtccctcgaagaggatggcatgaagcccggccaccagtggcatatacacctgcagttcctgcgccttggccttgagcaccttgagcgtattgacgccctccgcgacctcgcccagccgggtaatggcctcgtcaagactcagaccctgccccagcgcaaagccgacctgataattgcgactcttgggcgatgagcaggtcacgatcaagtcgccgactccggccaggcctagaaaggtcatcgggttggcgccctggctgacggcaaagcgggtcatctccgccagcgcacgagtgatcaacatacttttagtgttttcgcccatgttcagggccaccgccatgccggcaataatggcgtagacattcttcagcgcaccgcccagttccacgccaaagcgatcggtgctggcgtacacgcggaatgtgcggccatgcaaggcagtctggacgtgctgacacaggtctt

SEQ ID NO: 103876 - DNA, 567 bp, Triticum aestivum
  Clone ID: PAT_TA_103876
tttttttttttgcataaaagcttttttagctagggaataagcaatgacattcccattcctaggtatagacctgacttcacatgatgaaagaaaagaagtgtgattaagaaattcagcaagcataggtcttatcctccaatctcctggactctctaaaaggtttcttgctttagccacctggacaagattcctgcaatcagataagaaaatagcagtattccatcctagagctttaaccacctcagccgacagtgataatccaatagcttcagcctgcaaaacagagcaaacattttttgcagcagcttgaacaaatacagtatggtttaaaataacatttctaagaaaaactccaagaccagcttcttcttttgcaatttccggattgtacgcagcatcactgtaacctgcattttggaactgtatattttgaatgtgaaaaggagaaatattattgtttgcagggttgatgtgagccgccgccttctcctccattgttgtgcctcccacgagccaccccgagcccgtcacctgcgtcgtcgagttgtcgctcgtccacgacgacct

SEQ ID NO: 103877 - DNA, 470 bp, Triticum aestivum
  unsure (1)..(470): unsure at all n locations
  Clone ID: PAT_TA_103877
ccgtcccgccgtccgccgcgcctcgtcactccggcgagctccccccctcgccctcgaccccgccctcctctcttgctcgtgtccccgtaccacctccccctcccgaccaagatcgccgccctcgtttgccgacgccctttgccgcgaccggaggtcccttgtcctcaccgtcctcgttcggcgccgccgcgagcgacttaaggggaaaggcggcgatatgaagaacctgaagcttgtgaccagggtcgtgcaggagctccagctccatctcgacggcgagaccctcgtcgtatccgccatcgacgccgagcgccaccgtgccttcttcgtctcctccgccaacttctctattccgttaatcttctcgcctncaccagcaacctctgcaatggagtaaaaccactctagattcaaatgtggaggagggtcttcttgagcctggagatttcataattgccatggattatcta

SEQ ID NO: 103878 - DNA, 388 bp, Triticum aestivum
  Clone ID: PAT_TA_103878
cagagacatgtgcagtgagcataggagaaacagaaagagtgagaagaagagagcgtgtgagtgagagagagacaagacatggaggagttatatggggcgtataggtgctgctggagtgaagaactgagccgtgtgtccggagaatattagtacagtatatgtacggcttttggattatacattgatgggtttatttgctaggagaatattatctccaaggagaaatcttgttatctaagatgcagatgatgtaacttaagtatacccagaagatgtcgtcggagaataggctggaccagtgggtggggaaacgagtagagaatttaatgtattttggctattttgtaaatataaagaaatttgtatagtcaatatatgagcttatgtg

SEQ ID NO: 103879 - DNA, 394 bp, Triticum aestivum
  unsure (1)..(394): unsure at all n locations
  Clone ID: PAT_TA_103879
atgctgcgtgctggagcggctgcgcggtgcagtgtatgggtaggttcagacggtcttgctaatggatcatagcatcggctgcttagaaatcagtaagcagagactctactggtgagtggttgtacgacttggggacttgcatagctagaatcgcatgatctgtttggtgctgtttttggtcctggaaatgccccccttggtgatttagcttagtacactatgatcatgtagtctgtgtaggcttattactctgtgaggttttatcttgccactgcagtgaagatcagggattcaccggtaacagagntagttctgatatttcagttgcaacagntgctatatttctcatgtttgattcctgttctggaagtccaaggtaactttacaaagtacg

SEQ ID NO: 103880 - DNA, 590 bp, Triticum aestivum
  Clone ID: PAT_TA_103880
ctcgtgcttccagcaaccctgtgctgcctgaagataatgagccgaatcaatcaagtgatacaaacactgaaattggtcatcagcaggttactaatgcagaggaaaatgtgaatgcagctccttgccttcagcagaattatgagcctagaatgcatcagcataaggatgagagaagcccaataaatcacaactcagatgagccggggcagccagtcacagaaagtttaagtggcagtgagtctgctggaaggcaacatagtgaaaggtatgggaggatccagacaaaacgaatccgtagccagtcacctatagcaaggaggagctgtagcccttccggagagaacaagcacagtccatcccaaagttcatcacatgaaaggcaaagcaggtcaccacttgctaagcgggctaatcttcatcagagcaaatcagcacaccatgtgagtttgctaccaggacaaccactagttgcaagttcagaaccccagatgcagtttcagccaaatgctatggcaccatcaaatgatttcctgcagaatcagataagaacctatactgcccagatcttcctcatcctagccattggattt

SEQ ID NO: 103881 - DNA, 510 bp, Triticum aestivum
  unsure (1)..(510): unsure at all n locations
  Clone ID: PAT_TA_103881
cagactttgactgtaagnacctatattggtgagacattgtatgccatattcaaggcggcgcttgttctcgttttgtttgcccatctgattgggaatgttcagacgtacctacaatctatcactgcaagggttgaggagtggagagtaaagcaaagagataccgaagagtggatgaaacatcgccaacttcctcctgtactgcgggaaagggtgagaagatttattcactacaagtggcttgcaactcgaggcgtggacgaagcatctatattgaaggccctgcctgcagatcttcgccgtgacatcaaccgtcacctttgcttggatcttgttcgccgggtgccattcttctcacagatggacgaccaactcctcgacgccatctgtgggcgcctcgtctcgtccctgagcaccaagggcacgtacacgggtcgccgaggggcgacccggtgacccgagatgctcttatcattcgcgggaaagctggagagctccaccacccgacggcgg

SEQ ID NO: 103882 - DNA, 515 bp, Triticum aestivum
  Clone ID: PAT_TA_103882
agacaacttattttcagacatttagaattacctttccaagctagaagtggcttgaccatacttactgttcgaacatggcaccagatctcaacggtgtagccaacggcgcgcgatgggactactcaaccccgggatcaagcggatatagcgtcccggacatcgtctacaatgacccctcaacgcgaaagatgagggttttgaccattggtgccgggctgtccggcatacaattggcataccagatacaaaagtacacgcagaatgtagaacatgtaatttacgagaagaatgcacgcattggaggtacatggctcgagaatagatatccagggtgcgcatgcgacattccctcacacgcctacaccctcaactttgcactgaacccggactggccccgcttcttctcctacgctccagacatcctcaagtatctcgagaaagtctgcgatgtattcggtctacgcaaatacatgacgttcaacacagaaatggtccgcgcagagtggcaggacgaa

SEQ ID NO: 103883 - DNA, 611 bp, Triticum aestivum
  Clone ID: PAT_TA_103883
gtgaacaccatctccctcaccaatcaaaacacctctgatgaaaacggataggacaggaggaggaggaggaggacactgaaccagacagacaccaagctctgctcacctgtgagctgctgcttcttcttcttcttcttcttcttcttcttcttcttcttcttcttccccggacatgaattccagccggagcttgctctcgtcgccgctcttccccacctcatctccaaacttcaggggcgccgcctcctccccatccccctcccgcgcatcagttccgatgatacacgacagcaccggcggcagagcatccacggcgtgccactactcgccctcgctcgtggccgaggagcaggcccatggctccgtgtctttgaagggcgagaaggccttgctggagttcctgctggacatggccttggagcagcacacggaagggaagactttcaaagccgaagagggggcagagggcgagttcgagagctatctgcgaggcctgcagcggcaagtcatttaccagcaggcctttggtgaaaaagaacaacttcacctctgcaatcacttcaactttaacgccatccggcaaaaatcaagtttccaacttttggatcttc

SEQ ID NO: 103884 - DNA, 495 bp, Triticum aestivum
  Clone ID: PAT_TA_103884
attgattgcttgctcctcttggacggtgcagaggtcccgggtgaactgcatgagctctctggtggcaatgttgtgtatgtcagcgccactgtgatgaagaagatctccgggatgcagtcagttgattcaaccgaggcgattgctgtcatgcacatgcccaagcatttctgtgacctcggtgatgatgagggtggagctggtcttgatgcgtcgttccagtctccaaagaggatcctagtccttgatgggattcaggatccgggtaaccttggaacgttgataaggtcagcttgtgcgttcaaatgggatggggtatttcttcttccggcttgctgtgatcctttcaatgaaaaggctcttcgtgcagctcgtggagcctctttgcagcttccaattgtctctggcaactggtgtgatctgcatgatttggtaactagatatggcatgaagatgttagcaggccatccagaaagtagcagtgatggatctgaaaga

SEQ ID NO: 103885 - DNA, 493 bp, Triticum aestivum
  Clone ID: PAT_TA_103885
ctttcttcaatacaaactgcatactgtagctctgaaactgtagctgacatggttcagtcttctatttagttttcaatcatataaatgtatctcagatcaacattgagcagttagttttgtagaaccacgtaagcagaatttcttattattttcaacgttgttgctggataagcaatggtcagcacatcactgttttttaattcatgtggttttctatagtcattatttttgtaggagatcatttgtaagccatggtttgtttcatttagtctttttgtccctttagaggatttcaacagttttttaggtcagtcatatagagaagggaaggccgggcaagggtagcactgcaagttccacattgcgggctcgtggtagctaggatagattttttttctgtaggatgatttataagatgggggttcactatatgcgatcaggaggatagttatatctagcaagtgcgccaaggtagcaaatgaggacgctgtgt

SEQ ID NO: 103886 - DNA, 521 bp, Triticum aestivum
  Clone ID: PAT_TA_103886
ccagatcgtagcaaaatcctccaatttgcatgccaccatgctcctcctcctcctcctcctgctcttctccagcctacagctccccacgactgccatcgacaccctcgctctaggccaagcactcccatggaacgagacactggtgtccaagggcggcgaattcgagctcggcctcttctcgcccggcaactccggcaagcactacgtcggcatctggtacaagaagatctccaagcaaacggtcgtctgggtggcgaaccgagagcacccgatcgtcaagccgtcgacctcccgcttcatgctcagcatccacggcgagctgctcctcctcacgatgccgtcggacaccttgctgtggtcgtccaacgcgtcctcccggtcgcccccgagcaccaccgtcgccacgctccaggacgacggcaacctcgtggtgcggcggagcaacgcgacgtcgtcgtctgctacgtggtgtggcagagcttcgaccaccccaccgacacctggcttcccggggccaggct

SEQ ID NO: 103887 - DNA, 570 bp, Triticum aestivum
  Clone ID: PAT_TA_103887
tttttttttttttaaatgaaaatgaaaactatcaatctccatctggactctgttttgatgttcatgtttgctgttgccgtcaactttcttctgtttgaccagacaatgtgcagagtgtctttggtactggtacagcctacaccactacactggcccgtgaatcgtgactatctatacagttcgacagtttacgcaaacttcttgccatcgtcgcccgcgaccgtgccgtcgttgccggcgagcttcatgtacttgtccttcctggtgagcgtcgtgcaccggtacccgagctccttgccgatcaccgcctgcacgtggttggccacgtccacggcgctcctcccgccgccgccgcacgttttctcgggccgcagcgccggcaggaacgtcaccttgtagcccggccgcgggttcatgtagaagaaccacgggtccatggccttccaccccctcgccgttgacccgtagtaggtcgactgcgccgcgtccagcgccaccggcacgatccggtccgtcagctccgcgaacagcgccgagaaccgcagcaggcacgggttccggcacgtcgtc

SEQ ID NO: 103888 - DNA, 576 bp, Triticum aestivum
  Clone ID: PAT_TA_103888
ctcactcgcccgtcgctgaaattgctccccccgtcccccgcacgagaacctgatttcttccgccgcctcgcccccttccctccgccgccgccgtccctccactcttcggtgcccgtcctcgatccggggtctccaaattcggacgatattggcaggatccgccacatctcccgcgaaacccatccgcgagctgctcgtcggccatgcggggagcatggacgagctgctcgtcgacgtccatcccacacccccgtcgacgacggtgcccagcctcctcgatagcgcgcctcctacttgccgcacgccagattttatagtaggggaaggatggatactgcagggctttcatatgtttttttgatttttgcggatagggctttcttatattctggcaagagtcaagctagcaaccgtgaagatgcagaattcatgcaacctccaaccctcagcaaagggaagaagcctcagttggtagctatggaggggagtgatccttcgttggatgaaaaattggtgtaaaaattggttctcctcccccgtgtcgctgcaccatcgatgccgcaaggtatgtatgct

SEQ ID NO: 103889 - DNA, 445 bp, Triticum aestivum
  unsure (1)..(445): unsure at all n locations
  Clone ID: PAT_TA_103889
catatatgcatcatgcaccggtgactggtgagtatttagttatatatattttgcggtatatattcaataggatgtggggatatgagttttgcctatattgttgattctgcagatctgcatacattctacagcaggacagtttgccgtcatctattttggaacggagtgagtacaaatttgtgaataattgtgtcgtgtcgcatgattgcaccacattaatatagtatagtatccctatcaagcattcaggtataatattttgctgtgaataattgttgaagntttccttgttaatttcctaccatttttttattccttttgntaagcggaactttttccttcatctaatctcttctctcttcaaaccagattgtgcatggtaatcaatcatgtgcaggacattttatttcattcttgttacaagcatatggaagagcagttcctg

SEQ ID NO: 103890 - DNA, 498 bp, Triticum aestivum
  Clone ID: PAT_TA_103890
ctgcgccgcgacgtcgacgacctcctcgagggccgcctcccggcctcgggccgcgcccgcgcccgcgcctggcgccgcgaccggctccacccgctccacctccgccaccaccagttccccgtccaccgccgcggccacgcggaccgcgaccacgccgactccctcctccacccgctcccgcgcgaggagctcctcctcgaccccgccctccgccgcgcgctccgctcctggcaccgcctccgccgctacgaccccgccgtgctccgcgacctccccgccgtgctcgccctccccgcccgcatcccctcctgcgccgtcgtcggcaacagcggcatcctcctccgccacgcccacggcgccctcatcgactcccaccacgccgtcttccgcctcaacaacgcccgcgtcgtcggctacaccgcgcacgtcggcgccaagacaacctctcctttatcaacagcaacatactccacctctgcgcgcgccgcccggctgctt

SEQ ID NO: 103891 - DNA, 500 bp, Triticum aestivum
  Clone ID: PAT_TA_103891
ttttttttttttttagacaaaaatattaacatatacaataagaaatcaacaccattagattcattatcaaatgtacttccacatagtataaatttcttatggtaaatatttatattttcttctataaacttggtcaaactttagtgctaatatgcgaagtaaataaaaacggagggagtactagagaacatatctacatgcccttgcagaacaccttcccatcttcctacttccaaactgcatcacagaaacctcttcagattttgtgcacagtgaacactggcacccccttgcaatgtcggagagaaaagacacagatttcccgttctttcagcttcgctctttccacgaagcggctccagttatgtgttatagcagccctcttatcaacccctttcatcagttgaacataggttaaacaacgcccagatgaaagcttaatccgcattcgatcaaccggctggagagaaacttcatgaggggcttctcagtgaacaaag

SEQ ID NO: 103892 - DNA, 436 bp, Triticum aestivum
  unsure (1)..(436): unsure at all n locations
  Clone ID: PAT_TA_103892
ggaggatggaaatctcattaagtaattttccattattacactttatgacttccaagccaatgtatattgattgtataaagggaaatgtgtcagaacattcgagaaaggagcaactagaagcacaaaacattttgaattaattcacaatgacatttgtttaacttttcctgtgaaatatgtggatggatttgacgctttgtcagtttcatggatgacttcatacatttatcccatccatgattctgaagaacccggaaaaattgatatattaaaggcttaggttaggatcagatccctaacctttacaattaacattttaaaccagaaccttccccatagcactgtcctaaatttaggaccttttcatggcacagttccagnctttccttcttttttggaggcgggaatcagctgtaaaatagttatggtattacca

SEQ ID NO: 103893 - DNA, 549 bp, Triticum aestivum
  Clone ID: PAT_TA_103893
cgcagatatttctcctccctctctctctcacacgctcgctccttctccacctcgcccgaacgcccaccgtcgccatggacgcacctgaccgcgcgccctccgtcgaccccgtcgcctaggaccgcaccgggagctccgccttcgacctccactacgcctacgaccgctacctcgagctcggggccgctccaccgtcgccctcgaccacttcttccccgacgcagaccgcccggatcaccgtcgtccgccctcgaactggccgcctctgctgctcctaatcagtcacggggcctccttgtgcctatgcgacctcgagaccgctgctgatgcccctgtgatggactacgtcaccgacgacccctccttctcgccagagcaaccagatgtcggggcccaggagtcagatgccatcgtcgatgcctactactacgtgaagaccgccgacgaccaggagtagttaggaggctccgaggcaggaggccttgccttttcgatcgtagatgcttttgtgctagccttggtaaggcaaacttggttaactcatgtctg

SEQ ID NO: 103894 - DNA, 507 bp, Triticum aestivum
  Clone ID: PAT_TA_103894
ggttcgccgggggcacccggtcgggcggcgccatgcccaagccgcccgccggcttcgtcctcgacgaccagggccggtgcatcgccgccgcctccaagcgcatcgtcaccatcattgatgacgcgaacaatcgcccgttggagtgcataatcaggagggtgttcagcagcacacaggaccacgagtgcttgcttctctgcccggtcgacatgcctgtgcaggtgctcaagagcacaaacttcagcggctggattgccgtatgtctctagttccctacattttcatcgattgagcgctcgattcatttctagttcaagcatgatttcagttgatgctacacatattcatgtctttagatatggtttgtaatgaggcaaatgatgtgtgtttttccgttctgttgtaggttgacgatgaccagattaagcagatcattccgtcggttgcgtacgcccttgctagagtgcacatgcactttgtcgaaagcggattctgctacacaagcac

SEQ ID NO: 103895 - DNA, 434 bp, Triticum aestivum
  Clone ID: PAT_TA_103895
ggaaggaggggagcccccgtcggctagggtttgcgatcccgcccaagcgggggcgacgcggggggagcggacgcgagtttctgtctggttgtggtaagacaaattcaccaaatatgcacaatttttatccatgaagcacccgcttattgtccaaacagttgctagaacctctgattacattttcaagctccacgggcttcctgcagtcagataaatcttcactagctcccttaaaaaaaaatcttcacaagctctccccagcagaaactttctgaatccctgtgagtcaagctccatctctgtagttcaaccatccataaactgatggtcatgcagaaagagtaaatcagtgcttggagaactacttgagatgcatggcattccagcaacccaagacatggcgttcctgcctagctttagcagtttagctgagt

SEQ ID NO: 103896 - DNA, 483 bp, Triticum aestivum
  Clone ID: PAT_TA_103896
ctcatacatagatggttctgataaccatgtcaagctcttcgtcctgccttcttccactcgatgaggagcctcccctccccctcatgttaaatgcaacttctgcaaatgggaggacaactacatcaatgtcatacgcgccaagtggccaaggctcttcactgtcccatctcgcgaagaccgcaagttccaccgctgcatcatctctcttctgttactcattcagtttccagtgatgttcatctgctgcaaggtcgcttgaaactgcccaagcatgtcgtagttatctaggttcctccttcgtcttgcagataatctatcgactaatcatttagtcataatttcaattcgatcatgtcctttgtttcttcgttaaagcagtgtctgcccccgtgagatggacttccaattaccatgtaatatttttttaatattttatgtaccaaatcgactcgtttgcaatattaatatcatttccactttatc

SEQ ID NO: 103897 - DNA, 498 bp, Triticum aestivum
  unsure (1)..(498): unsure at all n locations
  Clone ID: PAT_TA_103897
tgcttgatttgttagattctgatgatcctagagaaagggattgcttgaagacagtattgcntaggatatacggaaaattcatgggtaatcggcccttcatccgcaaggctgtgagcaatatcttctataggtttgtatccgacgctgatcgtcacaatgggattgctgaactcttggaggtgttcgggagtgtgattagtgggtttgcgaaaccactgaaggaggagcataagttatttctgtggaaggcattgattcctcttcataaaccgaagacagtgggcatgtatctgccgcagttgacatactgcattacacagtttattgacaaggaaccaaagctctcagggactgtgatcagaggcctgttgaagtactggccagtgacgaacagtcagaaagagatgatgttcttgggggagttcggaggaggtgctggaatttgacagaaatgcccgagttccagaagtgcatgggtccccattgtttccgagggct

SEQ ID NO: 103898 - DNA, 555 bp, Triticum aestivum
  Clone ID: PAT_TA_103898
ccccctgcagtctccggtccagtctagccgagtggcgagtccacgaacgaaaccagagaaagcggggagatcgccgggaattctccgatgaccggcggcagcggaggcaccacccggcgtccatccgccgcctccaggagccgcggggacccctcctcctctgccccggatccggacgcgcgccgcgccgccgccgccgccgcagcgcggcgcagtggccgcggcgaccatggcccgctgcgcgtcatggccgtgagcgcccgaaccctgcttctcctagggattgcttccgtcgccctcctgtccttcgccttcctcgcgtataccggcgggtggtggcaggctgaggcggagtccgagggcgcccgcggcgctgcgcaagatggcgcgcttcgtcacgccgcttgatgcgccccggatgatggatctggctcaattccaaagtggtcacaaagaaagcttgtattggggtacctacaggcaaatgtatatcttggaattcgtgctaaaactccggtggctctaattgctgggttgatgtggaattggcgtgaa

SEQ ID NO: 103899 - DNA, 542 bp, Triticum aestivum
  Clone ID: PAT_TA_103899
cggagactttacaaaaatgttcccatttccaaaaattgtttgcatttttcgaattgttgagtttttacaaattttgttctcaatttctagaagtgttcgctgtttcatacaaccttcatgttttttttctcaaaaatagggtttctcaaaaatgttcgcacttccaaatttgtttggaatttttcaaaattgttctctattttaaagtatgttctcaagaaacaaaaaatgttcgtgctttacaaaattgttcatgcttccaaatttgttcaggatttttcaaaattgttcttcgtttcaaaatttgttctcaaggttcaaaaaatgttcgtgcttcaaaaaataatccgcgcttccaaatttgttctcaagattcaaaaatcgttcatgcttcataaaaatgttcacaaactccaaaaatgtttaatttccgaaaaatgtttgggaaattcaaacttttcggttttcataaaatttggtcacatgttcaaaaaatgttcatgtttccaaatttgtttacaaattcaaaaaattgtccacat

SEQ ID NO: 103900 - DNA, 591 bp, Triticum aestivum
  Clone ID: PAT_TA_103900
gtcattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctcttcaagaacttcatgaccctgccaacatcaagatcccactcatcttgggtatctggggaggcaagggtcaaggaaaatcattccagtgcgagcttgtcttcgcaagatgggcat

SEQ ID NO: 103901 - DNA, 609 bp, Triticum aestivum
  Clone ID: PAT_TA_103901
ccgcaggcgacgttgccgagcttgcgatcacctcgcttcccctagagacgcggttcccgccgttccgtctgaggaggtatggtgggttctggctggtggagaagttcctcaaggatgttccagccgtccactcggtcttcaagacaaggccgtcgtatgtcctcctcggcagcttccccaagtgcggcaccacctggctcaaggctctcgtctttgccacgcgcaaccgggctgaccactcgccccatgacctccaccacccgcgccgccgttgcaacccccacgacgtggttcggacatggagctggagtttgggcggtcactggaagacggtagagcaggcggcgcgcgtgttggcggcgctcccttcaccgcgcttactcgccacacacctgccctactctctcctaccacggcgcatcacggcggaggagtccggctgctggatcgtgtacatctgccggacccaaaggacgcattcatttcctcgtgggtcttcaccaagaaggaggcggcggccacggctgcttcgagcacaagcccggcgagtacacggacaagcagcagaacggcgccgccgcggcacacattcgaggaggcattcgagct

SEQ ID NO: 103902 - DNA, 600 bp, Triticum aestivum
  Clone ID: PAT_TA_103902
ccgtcgccatcgcacctccaagtgggctcacacatcggcggcggtggtcagaggaggattgggcgggatctcgccagtcggagcctatggagggtcgccgggtgcgtgggtgctctggatccgccgggtgccgcccctcacgtcgctccatccggcagcccctcctccgacgaccacgctctcagcgcctctcccctttctccccccaggttccagaggagcaacaacaaggcgatcgccttaaacgccacctcagcggaggtgctccccgttgtggaatccctcctcccaccccaagccaccgctcgcagtccacgccgtcgaggatggagccgtgcacgcatgggtcgctgaagatcccttgctcagtgaaggctgggtcgcagccagattgctggttatcgccctggacctcctctgtgttaggctaccaccagcacctcgacctacccctacccgtccaaaaggaggtgcaaagcagactatggtcaagtgatgccatttcgtgcttctgccaactacctgaagctatcagattaaacacctttggcgtccgctggtagccctctgaacaagccattcttcagcacgctgcttcgc

SEQ ID NO: 103903 - DNA, 586 bp, Triticum aestivum
  Clone ID: PAT_TA_103903
ctcagctatctgaatctcatcccatttctcctacctctcctctgtacctatctctccctcccgcaaattccttcctgtgtcgccgatctccagcgatcggtcgtcacacgctgtcccaagctcgtcggcaccgcccaatcctatcctcgccaccgcacgcgtttgctgccgcgccgcgacatcggcagccacgtcgccgggactttgcctggtcaactctggttgggaggtggtggcgcgtccgtaccacggggaggtggtggtgggggcgtagccatgtgcgagcagcaggagtggtcatggtggacagggccgcgtcgtggccggggagaagagcgccgcactgaggaggcgccggcatcgacggtagggagcggaggcacacctcgattgaggagacgcgcgcgcaggaggcaaggttgtcgcttgtctggcgagacccgacgcacgcggcggcgacgagcgcgttgtcggccgcgtctgggacgggatgccccttccccttccgctcgctcgagtcacaagcgcgtcgagctcgaaatggtcgcgagcttgctggctaaacaaggggcttgagtgcacccta

SEQ ID NO: 103904 - DNA, 611 bp, Triticum aestivum
  Clone ID: PAT_TA_103904
cgaacacaagctactagccagtacttggagaaaccaacaatggcgccgctcgcagcccggaggccagcctgcctcctggccctcctctccgtcgccgcggccttattcctgaccccgacggccttggcggcggggggaaagaccggccaggtgacggtgttctggggacggaacaaggccgagggctccctgcgtgaggcctgcgactccggtatgtctagtctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttcagtttggaacaagagtccactattaaaagaacgtggact

SEQ ID NO: 103905 - DNA, 589 bp, Triticum aestivum
  Clone ID: PAT_TA_103905
cagtagtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgtgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatat

SEQ ID NO: 103906 - DNA, 562 bp, Triticum aestivum
  Clone ID: PAT_TA_103906
gttcacctgaaatcggaaagcttaagtaagtttggcgaatccacaatacaagaaagtgccacctgttcatgcaacaaaccacagctgcttcacatgccctgcactcatgtcattgccgtctgttgtcagattggggttagcactgctacatacatgtctccatactacagcctggcctacctaggtaggatctggagtggaaattttgatgaatataggatctcacgcggctacagaaatatcacgccatttgaatgcaatacaacaacttggatcccagacaaaagattggagtgtggtcttcctgtttttgtaacatcggactgcctagaaactgttgcggacgagtcagagcaacaatgcaacactggaaatggatctactgaagacaatcaaggagcgacaacatgcactgaagaacctaatgagatttaaacttctgttatcacgtatcaagctattaatattctgggccctaaataggcagtagtcactgtcgagcttatcctatgtaaactctgaacctctggtattatttgcagtgcgtgaaaactgaatttta

SEQ ID NO: 103907 - DNA, 503 bp, Triticum aestivum
  unsure (1)..(503): unsure at all n locations
  Clone ID: PAT_TA_103907
caccacaccacgctgctgcgctgncatcatccatccagatagccaccctaccaatcgcggttgctttccctcgccccaaccactccaacaccgcacggagccgagccgatccaatccaatccggccccattaaccccctccgcgcccgattccaatcgcgcctccgccagctccgacctcctcccggccgaacccgtcggcggcgatcgagcagatccgggcgccgtcccgtctacctctccctgtgatgcgcggatccgggcggtgaccggcggcgggagcgggcgagccatgccgagcgtcggcgtgaagatctacagcgtcttcttcaagctgctgctgcgccaccgcctccagtcgctcgccgccgccgccggcgccgccgccgacggcgacggcgacgcggccgccttcggtgtctcctgccgcgccgacgaggccacggcgccggccaacccggccttctccgcggccgacggggtcgccttcaaggacctccacat

SEQ ID NO: 103908 - DNA, 529 bp, Triticum aestivum
  Clone ID: PAT_TA_103908
tttgctttcccgtttggacaccatactctcttggcttcttctcctctcctctagtctctgtggtttcgttggtgattggtcgttggtgattggttgttgctgctgctgctcgggatcaatgggtactcctagtcctaccccgtaccacctccagtctccacggaccatcatcaccaagatcatcagcatgaagcagcaggagccggcgacgcccgatccaccgcctccgtccaagatcatcctgcagccgcggcgccggaccaccccggctatgtggtgcgccgccatcgcgggcttcgccttcagcgtcctcctcatcctcgccggcctcgtcatcctcatcgtctacctctcggtgaagccgaggacgccgtcctttgacgtcgccaacgccgccctcaacaccgtctacgtcggctccccctcctcctactacaacggcgacatgacgctggtggccaacatctccaaccccaaccacaagatgggcgtcgtcatccagtccggcgctgtcgagctcttcttccgg

SEQ ID NO: 103909 - DNA, 506 bp, Triticum aestivum
  Clone ID: PAT_TA_103909
ccggatcttgctgcaccggcaatggatcaggccgcctcctattccgcctccaccacgcccctgctgctcctcctcggctccgtcacgcttgcggtctcgctgttcgtgctgatgggtcgcagcagacatggacgcgggaaggcggggctcccgcccggcccgccggcgctgctcttcctcgccaagttcctcgcgctccgccggtccatattcgacctgggcccgctgctcgtcgacctccacgcgcgccacgggcccgtcttctccgtgcgcctcttccgcacgctcgtcttcgtcgccgaccgcaagctggcccaccgcgcgctcgtccagggcggcgccaccttcgccgacaggccgccgccggtcgaccccacccgcttgttcacgtccgggggacgtgacatcaagctcctcctcctacgggccctactggcgcctcctccgccggaacctcgccggggaggcgctcagcccggcccgtgttggtctcttcgcgccggcga

SEQ ID NO: 103910 - DNA, 541 bp, Triticum aestivum
  Clone ID: PAT_TA_103910
gttcatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcattctcgccatctgggcggtgcaggtggtgctcatg

SEQ ID NO: 103911 - DNA, 590 bp, Triticum aestivum
  Clone ID: PAT_TA_103911
cgcacggacgcgccgcaagccgccaagcgcccaagccggagagcgaagcacatgctgggccttctccgccgccgcgccgcatcctcgccggcggcgagcctccagctattccagtgctgttaccatcgaagcagtgagagactattgccttgccgagaccaggaagtctcatatggtctcaattgggctattgctgcgagaggtgttgtcgtaaaagataaggtcttctacaacttggagccgtctgagcttcagaaaagtggcactgcttacgcagagcgtttgtctggtactccacttcatgtcaaaggaaatgttatcggtgggttccctgaaatttcaggagctcaatttgcaaagcttctgaaacaggtgacctttcacctttcatccatctcaagtctttatgtccaagatggtgccattggttcatctgcagaatgtgatgcaaaggtccgtgttataagtgacaacccctctgccatcatgtcactctccaatatccttcagaaaataccagatcgtgcgatttcccacgacacatgccctttaactatatatgttgccagttccatcagtaccaacgtcag

SEQ ID NO: 103912 - DNA, 542 bp, Triticum aestivum
  Clone ID: PAT_TA_103912
ctttattggtaagtagtaatatttttgtaataattttatgatatctaattagtatgtattcaaatttcagagatcaggtcgcataaacctatggttttatatcagtcagaagaatttttcttagggaaatgaatcagaattttctttctttcttttgacacctcaattccaggagtttacctcataaattgtagtgaaacatactaggggttgtagagttttgtgcaagcttttgtgatgttgcttaatggcccatttagatctcagagcgcccccatggatatatagaatccctagatatatttgttgctttcttcttatggacatgcgacacaaaataggggtgtaaaactgatccttcatttcctaaattattgcatatttgccatgtagttgttatacacttgcacacagcaggacatgtgttggatgattcatttttttttcaaaaggagatcttttaagctgttgtgttctttcaaactgtggataacattttgatctaagtgatctggttctttcaattggtgcatagcatgttc

SEQ ID NO: 103913 - DNA, 505 bp, Triticum aestivum
  Clone ID: PAT_TA_103913
tttttttttttttttgatccaaacattcatgtttcaatcagccaatttttgtggcagcgtgcaaagtatcatctagtaaggtagtatatatatatatacacacacacagtactagaagacacgtatgtacggctagctcatccatgcagcgcggcacatctcaatctcaaatggagatgctgtacgggatgcccagccccatcaccgtcttctcgtcctcgggatgaccatttgacggcctgagcaacacatacggcaccacaccagggccgttacggttttttagcttggggtccatgttagccttgtcgatctgtgccgcgatatctaccattttggatttgaacctgtcaaaagcctctttgatcttctcttcctttctccaaacaagctcttggtacgtgcccatgtattcctcgtctgacgagtgtgaagacaggaggttcaatatcagcatgacaatgacgctctggtactgggacggaaaggtgtccagcagcaccct

SEQ ID NO: 103914 - DNA, 542 bp, Triticum aestivum
  Clone ID: PAT_TA_103914
gctgctaccactaccaccaccgctgctgctaaagccggtcccgtcagaatctctaagtggtaccccactgaatccaccagagtcagaagaaaccccaccaaggcccctaaggctcacactctcagaagaaacatcgtccctggtaccgtcttgattctcttggtcggtagattcaagggcaagagagtcgtcttcatcagacaactcaagtctggcctcctcttggtcactggtcccttcaagcttaacggtgttcccctcagaagagtcaaccaatccactgtcatccccacctccactaaggtcgatatctctggtgttaaggctgatgccatcaacgacgaaaccttcaacagaattaaggttaagaagactaagaagtccgaagaagccttcttcgccgctggtaccgttgaaaagactcaagctgaaaaggaccaaatcactgctagaagaaaggcccaaactgaagtcgatggcccatcctcgctgccgttaaaaagactgaactcctcagacaataccttaaatctagattcacc

SEQ ID NO: 103915 - DNA, 483 bp, Triticum aestivum
  Clone ID: PAT_TA_103915
cagctcacgcatctctctcggctccggcaagcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgaagccggccaaggagaccaaggccaaggcggccaaggccaagaagccctccgccccgaggaagccccgcgccacccccgcccacccgacctacgccgagatggtgtcggaggccatcaccgccctgaaggagcggacggggtcgagccagtacgccatcgccaagttcgtcgaggacaagcacaaggcgcacctcccggccaacttccgcaagattctgtcggtgcagctcaagaagctggtcgcctccggcaagctgaccaaggtcaaggcctcgtacaagctgtcggccgccgcggccaagcccaagccg

SEQ ID NO: 103916 - DNA, 515 bp, Triticum aestivum
  Clone ID: PAT_TA_103916
gacgagccggaggcagtggtggcgccccatggtttgtcattttctgctcatggcgatttccgaaacggcgacgccggcgagcggcgtagaatctgggtcgacgtcggcggccagagatctaggagcgcgcttgggggcgtccatctcgggcggcggcgtcgccgcggcggccgcctcggtcgtaggctccctggatacagtcatgcgagcgttctctcctgacatccgtccgctggatcaggggggcgcgcagcggggggaagtgaggggttctcctgatgtagagttctccggcgggtcctgcacactttcagctctggggaggcgttgtggcatccaggagcgccgctgggtcggcgccgtccgtcgtctcatgcggctcggtacagtcctcccccaatgtgcccgagcagccgcaagcaccaccatcagagttggctggaacacagggaaagagggccacaaaggaccagacgagcggtccggtaatagttgatcgtgtgcccggcactaga

SEQ ID NO: 103917 - DNA, 512 bp, Triticum aestivum
  Clone ID: PAT_TA_103917
ccacatcgaaggtttcccgatctctcccggcgacgccgcaggcaggctctggcacacagcaaggctttgaatcaaatcgatgggcggagaagttcatcaagaacggggcaaccagcaagacacatgctttgaatcaactccggtcatcatgaacagaaagagaatgcagcacggagaaccagcaatccagacgggatcatcaagcaggtccggcacatctcagggtggacacggtccgggccggtccggtcccggtccgagccgtcgtttggaccggccgccggcggtccggaccggaccggactgagcatcacgacggtcctgatttctgggaccggaccggcagcggccaagcccgggccggaccgagcggaccggccaagcccgggccggaccgagcgacttgcacgggtgcagcggcgaggtgtgcgacgtgcgctggtgcggtgacaaggtgggcttcatgcgaaagcgccggcggcaaggtgggccaagtgtgcgcttggcggcgc

SEQ ID NO: 103918 - DNA, 497 bp, Triticum aestivum
  Clone ID: PAT_TA_103918
ccggaaggagcggagccgccgagccgggaagagccaccatcccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctttggctcac

SEQ ID NO: 103919 - DNA, 506 bp, Triticum aestivum
  Clone ID: PAT_TA_103919
atcttccccacgaaacagattcaacttcctcttcgtcttctccaaccttcatcaaatcccactgtgttatttttttgcaaccgaaacagatagggtgtggcagtgagcgatggtgaaaggagttcctcctcggcgatgaggtaccccgacggccgtccctgccctatctccggcattcctatcgtaggtgcgccagccatggaagaacagcgccttgcggaggatgctgtcgcgctgggatcggccccagccaccctcggcgagtacctcgcggtctcctcatgcatatggccagactctcctcgaagcgccctcatgtccttgctctgctccggaccgtcctagcgctggccgcctctgatgcatcagacacggtcatccccggcgcggcccagttccagcgtgatccaaagggggagctccctcatgtcgttgctgtgcgccctcattgtggcggcggcctcggacgcgcctgatgcggcaatcaccatcgcgcctgatgtgac

SEQ ID NO: 103920 - DNA, 496 bp, Triticum aestivum
  Clone ID: PAT_TA_103920
ccagtttcagaagatgtagacatggctagtgttgagcttctgaaggccccacctgttccaaagaagcggatttttcttcttgttggtgttttctctactggaaacaacttcaagcgccggatggctttgagacgaacatggatgcaatatgagtctgtccgctcaggcgaagtagctgtgcggtttttcactggccttatcttctttttccttggttttgttttattcatggcaatcgtgaagcttaaattagcactgggtaatcaagcataagaatgagcaggtcaatatggaattatggagagaagctcagctgtatggtgatatccagtttatgccatttgttgactactataccttgatcactctaaagactgttgcaatttgtatgtttgggaccaaaattatgcctgcaaagtacatcatgaaaacagatgacgatgcttttgttaggattgatgaagtaatctctagcctgaagaagccaacccccatg

SEQ ID NO: 103921 - DNA, 430 bp, Triticum aestivum
  Clone ID: PAT_TA_103921
catcgacccagcgaggacgccaaaactagcagcatgggcggagcggttcagggtcgcggagccggtcaaggcgctgctgcctggggtcgacaagctggaggagtacatcactacggtgctttatccaaaatggaacgtcgcggtcaccggtaactaattaaatatcgtgttgttccaccatggcaaaaaaaaaaaaatgatcgtgtcgctccattaccggcggaggatcgtgtcgatccaataattcctctgccttttgagtaactgttttcactccaatagttgaactgttactacttggtcggggttctttttgcgatggttagtgggtcgtcgtcatgaataatgcacaggcgtgcactctcttcgatctgagttgtgatgtgctgtttcgtgaataaattgaagcgtcgtcgatcttgcatcttgc

SEQ ID NO: 103922 - DNA, 495 bp, Triticum aestivum
  Clone ID: PAT_TA_103922
ccatggcgccagacctcgagccgctcctcccccgtgccggccaccgccccgtcaccggcggctggaggtcggctctgttcataatctgggtggaggtggcggagcggttcgcgtactacggcatctcggccaacctcatcagctacctcaccggcccgctcggggagagcacggcggcggcggcggcggccgtcaacgcgtggtcgggcgcggcgtcgatgctgccgctgctcggcgccgccgtcgccgactcgtggctggggcggtaccgcaccatcgtcgcctcctccgtgctctacatcacgggcctcgggatgctggcgctctcgtccatgttctcctcaccgagcgaacaatgcaagctcaccgcggacggccggcaagcatgcccgcgttcctccctgcagacggccttcttctacgtctcgctctacctggtggccattgcgcagagcggccacaagccctgcgtgcaggcctttggcgccgaccagt

SEQ ID NO: 103923 - DNA, 485 bp, Triticum aestivum
  unsure (1)..(485): unsure at all n locations
  Clone ID: PAT_TA_103923
cgcttctctgctgcctcgccgccgcccgcggctcggtcgacttccgagctgacctcaaccacccctacgccggcagctcgctctctacggaccatgtcatcggccatgccgcccgcgccagcaaggcccgtgcggaaaggatcaacgcgagggtcgcacgcgccatcggcaaaggcggagacatctcagcagctcacgtgccgctcgccccgctcggcgacgagggccactcgctgaccgtgggcatcggcacgccgccgcagccgcgcacgctcatcgtcgacacgggcagcgacctcatctggacgcagtgcgagctgccgcgcggccgcgcggcgaggcagcgcgagccgccctctacgatccccgcaagtcctcctcttctcttcctcccgtgcggcaacaggctgtgccaggagggccagtttcagcttcaagaacttgaccgggagcangtgcatgtacgacgagctgtacggcagcgc

SEQ ID NO: 103924 - DNA, 519 bp, Triticum aestivum
  Clone ID: PAT_TA_103924
ctcccgtgtcgctcccgcgggcggcccgggagtaaaaacccaagccgccgccagttcctcacctccggccactctcccctcgccgccgccagcatgggtcgccgggcaaagcccgcgcggcctggcggcggtgggccctctccacctccgcttccgggcttcgcggcgcgggccgctggcctctgctggagttcttggggacgcatcgctcgaggcagcacggcaagacagcggggcggcaagtcgacggcgcggcgcagggtggctctggcgcgcaggtcgcggtgcgggatggttctggcgcccaggtcgcggtgcggtcgcatgcggatctggcgcctggagggtacgcggtgggcgaggcgtctgcacctggagggcgcgctacggcgcagctcggctgcgcacggaggtgcagcgcgggcgctcgggaggtcgggcggcccagatctagcgagcgcagcggcaacgacttgggcggcgcgaccccctctcccttcccctttgacgggatctcat

SEQ ID NO: 103925 - DNA, 523 bp, Triticum aestivum
  Clone ID: PAT_TA_103925
cacaaacaatggccaccgagtgcgaggtgaacaaatctcgccgcttcgatcgcggcatgtcgaggcggacacgaaaaccagtgagcctcgtcgcttgttatgaagatcggtatgtgccgcccctggcacggcagctgctccacgaggccaagctgaagagattgctccggtgcgaagatacaaaagagctgcaggcacctcagcaacgtgaagatgcagagcagcagctggagattccacaggcaccacaggagtgtgaaggtgttgagaagaaggcaccagagcaatatcaagatgagaaagagaagaaaccgcagcaatatgaagatgaagagcaggagaagaaaccacatctgcaccaagatgaggagcagaacataccaaagcaatatcaagatgaggaggagacaggacaacaacagcaagatgatgatgcgccagagcaatgcctagacgaagatccaaaaacaccggagcaataccaagataaggagttggaggaagaggaggaggaggaggagca

SEQ ID NO: 103926 - DNA, 431 bp, Triticum aestivum
  Clone ID: PAT_TA_103926
gtggagcaggaaggacttgcgccgagctccgagatcaacatgagggacgtgctgtgcccagacttggaggtgcacagctggctcacctttcagttctacgacatggacttcggcacgggcaccccaacgtacgtcatgccgtcctacatcccggcggaagggcttatcttccttgcgccgtcctacatcggggacggcagcatcgacgccttcgtgcctgtcttccaagacaacctcgaggccttcaagcagtgtctctactccatcgatcaccatgacaaagagtagcgagagcgagccagggacgcatgcaggacatgaataaatgatgcatcctcggataaaacagcccatccaagatggtttccttgtgtgtgtgtttttttctttttgcctgagaatttcttaagaataaaccgagtttaatctct

SEQ ID NO: 103927 - DNA, 457 bp, Triticum aestivum
  Clone ID: PAT_TA_103927
aactcgctggggagattccacaggaactcacaaatctcacctctctggccaccctgaacttgtccgacaaccggttggtggggaagataccgcagtcaggccagttcctcacatttgacatcaattcattcgaagggaatttggggttgtgtggaccgccattctccaagccttgtggcgtatcacttgctcctccaagccctgcccgtgtggagaagtcttctaatgtggatgtcatcctgtttctctttgtcgggctgggcttcggtgttggatttgcagctgccattctgatgagatggggtcgaatcagaaaatggtttgttaaatctgcaagagctttgtggacttgatctgatctgggagactattccctggtgcaagcatgttgtcctggaagagagcttattcctctgcagcagtcgttgcttttgaagaagtactggaagtataggct

SEQ ID NO: 103928 - DNA, 497 bp, Triticum aestivum
  Clone ID: PAT_TA_103928
cttttgcaaggggcgcactgcaacatggggccagctgcgagggttgggggtcgccgttcgcagctgctgccatggagcatctggaagcaccgtcgagagtcatcggcgctgcgaggcaacactcgccggagccagccggtggcgatgcagcattcaagccaccgcaaaattatagggggcgcgacgcgcagggcataggtgctgtggtgcaacctcgtcgacgcgctgacgctgagatgcagcctcatcggcgctgctggtgctgcaagtcgccggcggtgaagctgcaatggagcgctcgccggcagcaaccccgtgctccgatgcagcactcacttggggcggctccccgtgcagcagcgtagcgcttgccggcggctctcgaagctgggtgcttcaatggagctttacgcggcgggtcctgtgctccgatgcaacgctcgtcgccggtgctacaacgcataccaaggaggagacaagaggcggcggcactcact

SEQ ID NO: 103929 - DNA, 487 bp, Triticum aestivum
  Clone ID: PAT_TA_103929
cagaagaggaggacgagcacggcaacgacgccaacgccgtcgtctctccctgttcataataggtgtgccgacacccctctccatctccggctgcgcgggcatgacgcagctcgcacggtgttgagcggcgcctatgcagcagcccttaaacagcggcggctcggcacgggcggcgacaggctacagggccgcggcgctggcgctcgtgcggcacatggcgtggctctaacaggcaggcagctgggagcgtcgacgcgtgcatcacggccgcgccagcggggcaacgacgtatgcggatctcgagattcactgggtgtgctgcggcagcaacagaggctcgccgctaggggcaacgacgtgtgcagctgttcgttttcctcatgggacaatcgaagtttgccggtctttggccgcccttgctggtcattcacatatatacaagtcgaaagtctttggtctttctcttaagcccgatgatgtcctttga

SEQ ID NO: 103930 - DNA, 550 bp, Triticum aestivum
  Clone ID: PAT_TA_103930
tccgaacaagcaccgccgctcccgcatctcgagtagtttccagttcgccggagaaggagaaagatggccggaaggaagggcggcgacaggaagaaggcggtgacccgctccgtcaaggccgggctccagttccccgtcggccgcatcgggcgctacctgaagaagggccgctacgcacagcgcgtcggctccggcgcccccgtctacctcgccgccgtcctcgagtacctcgccgccgaggtcctggagcttgcaggcaacgctgccaaggacaacaagaagacgcgcatcatcccgcgccacctgcttcttgccgtccgcaacgaccaggagctcggcaggctgctcgccggcgtgaccatcgcccacggcggcgtgatccccaacatcaactccgtgctgctccccaagaagtccgccgccgccgagaaggaggccaagtcgcccaagaagaagccgccaccaagtcccccaagaagaaggccgccgccgccaaggagtaggcgccccatagcctagctccacaatcagggagaagatgacgagactt

SEQ ID NO: 103931 - DNA, 557 bp, Triticum aestivum
  Clone ID: PAT_TA_103931
cacactcgtacgcgcaccgctatagctagtctctctcacctcatcttctacacgcgtccacggtatagctaggcaggtagcaggacctggggaacagctaggtagcaccggggcggcggcgggccctgaagaataatatcggtaattcgggagagatgccgacggtgcggcggcggaacccggacgtgcacgtgaaggcgctggagggcatcgtgtcggccaacaccttcctcacggtggccgtcttcatcggcatcacggggaccatcacggcctcctccaccgtcccgcggaactgcgtcgccggggacgacatcgcccgcaacttcttcctcttcgagatcctctccttcggcttctacctgctgtccagcctggtggcgcagggcatgaagctctccgtcacgctgctggccgccggcgacgacttctacggcgacggcgagcagaagccggtcatgacggacgactgcgaggagatgccggcgtggcgcgcccgcgggcccccgggagcggcgcccgcgccgtgcttgcggtaccgcgcgggccatgatgct

SEQ ID NO: 103932 - DNA, 584 bp, Triticum aestivum
  Clone ID: PAT_TA_103932
atcaaagacgacggctcccgctgatgggatcccaccgcatcactctcccgccaatgggatcccaccgcatcactctcccgccttccaccccaccgcatcgctctcccaccgtccacccacactggccgtttcgctctcgctcgcacctaatccagatcccgatccgcagcgacgtcgccaacatctcggggccctccgatcccacccctcccttctgaccccgaggcagccggccaaggtctacggcagcgagggcagcgcctactacgagtggagccccgcggagctgctcatgctcggtgtcgcctccatcggatgccatggcagacgcggctgggcatcacgctggactgcgctcgcccatcgccagcagcaccacccgtcctctccctcccattgacccacctaccagcgccggcgatccagatcgtctcagtttaaggacattctgtggaatgaaggaagtgaaagaagtcgtagtggtgcgcgatccatctacgaaaatgtatttgaaggagttctaggctgaagacattcgaagaagctctaagccccagtcagcaacttgctttatatgttactga

SEQ ID NO: 103933 - DNA, 549 bp, Triticum aestivum
  Clone ID: PAT_TA_103933
ttttcatgtaaggtgttcggcacacatccttaatatcttagctcaagatggagcaagatatgtgcacaagcccatagaaaaaattcgtgaacttttaaggcatatcgcttcttcgccattaagaattcaatccttcaatgtgattgccacaaatttggatcttcctgaaaaggctggtggcataaatcttgatattccaaaccgttggaactctacatatctaatgattgaagaagctctggaatacaagggagccctcaataattatgcaagtggaaatggtgaaatagcaccggacgatgtggagtggactaatgctgatgtaatgtgcacatttctaaaagcttttgaagaagcgacaaagttagtatcagccgatagaacactaacaacccatctttttttgcacatggtgttgtgcatccgcgacgcgctaagggaccctcagtggagcactagtggcactatgtcaaaccttgtctatgctatgggccaaaagtttgataaatactggaaagagtcaaaactgatgttgcagttgtcatcgca

SEQ ID NO: 103934 - DNA, 571 bp, Triticum aestivum
  Clone ID: PAT_TA_103934
tgacaagcttgcttttttcaggttcacgatcttccccttcatcctcgaacaaactagtcgaggcatcgctattatttttatggacgtacttgtcacataggacaccattccattagcaaagaaagaaaatcctccattttttcattacaaacctacatccaaaaaaatagaagataaattatattcattaaacaagagagagcacttatacaagataacaaagttgaagatgcactaagacatacctctgtgcttggatggttatacttaaagctcttgcatgcattggtattaagatctacaacccatcgctacaaatatcaacaaattgttctctatcagccaattgaagagctatctgttttgaaagtgcccaatgaatcgagagattttcatcaataccaagaacccaaggcttaggcttttttggttgaaggaggagattgctgcaattgagagaacataagccaacatcaagttgtggtacgcgatgtcgatgaggagtggagaaaagacttaagttggactagtgaccgtcgccttgcagcagcgcatattggtcgatagtggc

SEQ ID NO: 103935 - DNA, 360 bp, Triticum aestivum
  Clone ID: PAT_TA_103935
cacccccaccggcggcgcacagcccgacgacccgagcgatcctgcggaggcggcagccatggtgcacgtcaacttctaccgcaactatggaaagaccttcaagaagccaaggcgtccgtatgagaaggagcgtcttgacgctgagctgaagctggttggggagtacggtctgcgggccaagcgtgagctctatcgtgtgcagtatgccctcagccgcatccgaaatgctgccagggagctgctcactctggatgagaagaacccccgccgtatctttgagggtgcggctctccttcgccgcatgaaccgctacggtcttctcactgaggaacagaacaagcttgattacgtgcttgccct

SEQ ID NO: 103936 - DNA, 425 bp, Triticum aestivum
  Clone ID: PAT_TA_103936
caccaaggcactgcctattgtttcacgattcctgcaactcaacgccgctatctcctgatttgattgtaggcatcatcctttccgtcgaaggaatgatcatgcggccacctccatgcacccgaatcagcatgtgtgcacgccattcgtctgctctgggccctcctcgcatcggcgacctcggacgcgatgctccgctccgctccgaaccttcctcgcgctggcgtcatcggacgcaccagatgcggccgtcgccgttgcgaccccgattctagcgggacgctctactccaggcctgccggcggcctcggatgcgtcggccatccccgcgcagcccaatgagcctgtgcgcacgagttgctctgctccgggatctcctcgcgctgatggcctcagatgcaccagacgcggccattcccgccgcggcc

SEQ ID NO: 103937 - DNA, 565 bp, Triticum aestivum
  Clone ID: PAT_TA_103937
cctcaaggagtcgcctgcccatggtagctgcgggttgtgccggcaagggcaaggcggccgccgcgacagcttctggtgctacagctacctcgatggtcaccgagagcttgcatacacgcacgtggcgtgcatgatggaagcttgctacaaacgctctcaggtcgctcaagtgagcgcgcaggcgacatgggcggtgggaacgccgacgacatgggaggtgggcatgccgcagagcgcgccgacgacatgggaggtgggcacgccgcagagcgtgccaacgacgtgggacagcgggttgtcatccagcatcagcaaggtctcgcttttctgcaaggttgcggtggccgtcgccagggtcgcctccgcggtctccactggcacggggggtgacccgttgtggatcgacacaacggccgcggaacccaccgaataaagcatctcgatcggctacgatatcaattactacaagcgttgtctggtttgtatcgcagttgtctggtttgtattcgtttttcaatgggtggctatcgggtatttggttggctattttgtgtgataatataga

SEQ ID NO: 103938 - DNA, 628 bp, Triticum aestivum
  unsure (1)..(628): unsure at all n locations
  Clone ID: PAT_TA_103938
ttttttttttttttttggaanaatgcagggctatntttnttgaacacctcacacgacgacacaatcagatcatggcgcggntgaatgaatcacaaaacaacacacacaaaaatgctaatcaataaacaggtcaaagaaatagcaatatgatcccaatacgggccaggacctgttcacattttggcgaaggaggcggaggacccggatcggtcgtagtagtactcggggagggcctgggggcggganagcatgagggggcgatccttggcctcctcagggtcgtagtcatcctcgtcgtccatggngtggatgtgaatgcagganaaccgttccatggagatgaanaatgccgggaccacgctcgcgcccatccanatcctgtccccttncaagatcccgccgccgccgtttgtcgttgccgtcgttgccgctgtccatggttgccgtccgacgaaacccgaaggaaagaggggaatggggtggaatcagcggctagttcttgcattgctttgaatttttctgggattgttttggctgngtgccaaaattgggangggcgggaggganggaattntaggaaaanacnaaccgtcctgatcaaacgtttttatagcaacagattgccatg

SEQ ID NO: 103939 - DNA, 586 bp, Triticum aestivum
  unsure (1)..(586): unsure at all n locations
  Clone ID: PAT_TA_103939
tcaggttccaagaaaatgcttattggatttgcatttgcaatggtgttacagaacatgtacattttgccagtcaaganccacgggctanattacattgnaggggccggntgnnttccaaaaaaaacntcggaaaacccagnaagnaaaggggggaaaaanttcctttggggcctgaacagggcgcatnactcgctggtggatcatttgngancgntaaaccaaacacacncccccccccccccccggntatatgctgntagnatcttacaaacaattcgggttattggcccggcccaaaagatataagttcgtagccattgatcgagccatgtttaccttnacttttggnaccaatgtgggngtccgaatccatgcgtgcgccngngcaacaactacatntggcgtngacctcnccgtgtcgaanttnttagcgtactgacggagtngtcctgagtctggccncgaacccccacggnngccttcggccaaganggggcacttgggcgtgcttnaaaaaatcccaaagtgcccggaangacccaaaaggggctttctttttttttnggccccccaagggggttccggg

SEQ ID NO: 103940 - DNA, 558 bp, Triticum aestivum
  unsure (1)..(558): unsure at all n locations
  Clone ID: PAT_TA_103940
ttttttttttttttttttttnggcaatagaggnacagttcatacattgaattgtttacaaggntaagcataaacncaaacaggggataaagaaccatngagggngagctncatgcgagcactactgntnattnatgggagataaccacaccaatggcncgggcgaggaccggttgtcccctgcaaatttacctgnggtnggacacaagcgatgaaaacataaatcggaagngagatcacaaacccatgtggaaatgcncccccaaaaaagcncaaagatcacacncatnattntgaactntgaccttttttntgcacatnatgngatcttntcccttgcctgatggggaccttcattcctatgttcatgcgggtagcgagcaccagcagcacataggtntttgcaggcacaaacttttgagcaaaatagtgagaaaaaagcagcaaacaactaaacacctgaacatnaaacaaaaggagcagccggcaatttnttnttnttttntaaacggcttttgtactgagaattgaaagngcccaatgaangtaacacgttctc

SEQ ID NO: 103941 - DNA, 557 bp, Triticum aestivum
  unsure (1)..(557): unsure at all n locations
  Clone ID: PAT_TA_103941
acacaaaaataagtttaactatacgcagcaacacgtacgtactcagtgacagcacgacaccatatatatgcagcctaatccgtactactatatgctcggcacggcagtatatgcattcacgagacgaggggcagtaggtatctgaagtcggcgtcgtaaggctcgatctccaccatcttctccggcgtcggcggcctgccgcggtggaggagttccctgatggccctcttgagctcgggcgccctggtggcgcgcgggagctggctgtggacccactccagcagcgactccacgtcgtcggcgaagcaccgcatgtgccagtgcagcagcttgggcagcacgatcgtcgccgccgccgccgcggccttcgacttcgccttcttcctcctcgcgccggccacgcggacgcaccgctccaggtactccaccttggccgcctccagctcgctcgacacctcctccgccgtgtacacccggaccggtggcgaagagcggctgccctgcaagaagcgcgaaaacaacgttgggttaagggaccttancccgaanaaaagttg

SEQ ID NO: 103942 - DNA, 558 bp, Triticum aestivum
  unsure (1)..(558): unsure at all n locations
  Clone ID: PAT_TA_103942
cattggcaaaagaagtcatggccacttgcaagcaaaaccagctcctggtctagtcacatcatgtttcagtgtacacttactacagactggacaactctgacgacacacgcgccctgtaagtttgatgaagattgtcgcactcacaatcctgataattctactcgtcatgctccgagcaatctgccacttgtcaacacgtgattggccgtctgaccctgtgcgcgcgcgctcaccggaaacagaggaaggcagcggcggcctcgggcgtgggcggcggagcttctccggcgggtctccggcgagggtgaggtgatggacggaggcggcttcgtcgcggtggtgagtgcgtcaggcatgacggggcgatgtggctggggacgaatcagtcgctggtgatttgcttcaggtgagctcggcttccgcgttgtggtactccgcgctcatggagatgaaatcgacgacggacggatcttcagcggggcactctggcgagctggtgccgaattcctgcagccccgggggatccacttagttctagagcggccgccaccgngggga

SEQ ID NO: 103943 - DNA, 557 bp, Triticum aestivum
  unsure (1)..(557): unsure at all n locations
  Clone ID: PAT_TA_103943
tttttacggataattcatagcggagttcatctcattcaaacggnaagatagcagcagacacaggaagataaccaaggccgccggacgcagatccagcggcccaaagagtccacctaaaaccctcntaaaccaaccacggnnatntnntnggncggnccaggggaanacncnacncacnatttttttntttagatcgacgacacgacacgggacacacggggcgatgacgacgacggcgaccggcgggcgggcggatctagagctggccgcagtcggcgatgacgacctgcttggagcaggtgccgctgcgggagcccaccttntcgatgttcttgacgacgtccatgccctcgacgacctngccgaaaaccacgtgcttgccgtcgagccaattgcaggggacggtgcagatgaanaactgggagcccgttggtgttgggcccggcgttngccattgaaaggatcccggcttggtgtgcttgtggacgaacttntcgtcggcgaacttntcgccgtagatggactcgccttcggtgccgntgcccctggtgaantcc

SEQ ID NO: 103944 - DNA, 1382 bp, Triticum aestivum
  unsure (1)..(1382): unsure at all n locations
  Clone ID: PAT_TA_103944
atttatcctcnctcttaatacattggagaacacatttgatnctgattctgctggctatttaaatgaacaaaagtctgctccatgttctgcattgcgagccgtgcagcaaaagcantggaatgtcagcatgcaagcctacccgatgcatactagaatagctatacatgcttgcctgtgatctgcagcgatagtttacgtagactgctggcccttgtgtgcctgtgaaccanaacttgggagctcctggacgtgaattgttgtgtcactctagggaagaagccccagcttatcatgtgtttgcccatctgtgactgcctgtgatganngctctgttgcttgctccctgtcgcaccctgaatcgcggatctaccgctgctgaagtgcttgctttgcatncatcccttttgtgccctcctgtgaaaactcagataangcatattctgtgtctggacttgtcaccccgtggtacaaaccctagacacaactgtcatttcttggtcgtcagcttgtctcatcgcaactgtgcgtgtgatngttacagtcggtgatgttatcctgtgctntcacccgacagttttgagtacaacctgctgctgtgnttgaaccgtgatctatgcttgtgtgaccatcatgagatattgagtgcgaatagatgtgnggaacaggcgctatggtcccatgcctctgncctctgaggttgtggtagtgccctagtgaagggtaatcgtggcagcatgtgnttgaccngtggtctgtgttgacgcngatcagtcggagtaacggcccatcgntccgctcgaggggactgaagcccggagaagggtaagggagaaggtagtcggaccgagcgtgncanngtccgaacacataccgcccggggntcctgaacgtaacatcngangtttgnacctttcaccccgcggcccattggcggtcacactgtggcnangggggaaaatggnaagacaatgaaggtggcaaagcccggtgtgggtccacatgcgnccnagcggtcacgaaccgcngatggtgccccaggtaaccaaaccagaatcatcgacttnaaattcagngagcnctaacagttanggcccactacagtcaacccacactaaaagccagcccctaaactcgtagantntgacccagantntcgcgtaatngtactagttaactaagtctgtcgttntnanttagctgtttcaacacacanctcaaagaccannaacgnacgnagacacacaccaacaacacaagtcaancaacaaccacaacatacaacaacaaacaaacagcaacaacatncacaaaacacaanaagacaaccnaaccgcaanacaacgaacaccanaccaaagacaacacaanaaaacacaacaaca

SEQ ID NO: 103945 - DNA, 1399 bp, Triticum aestivum
  unsure (1)..(1399): unsure at all n locations
  Clone ID: PAT_TA_103945
tttgtttggcagaggactaggggtgcattcatntacaacacaagaaatagtccgagtagcaatggatacattgcaaaatatagcgactatagtaatagtacancaatgttaactacatgggtacaactaatctcagcatagtaacagataggtactacnaagaaanattcccctggnaaaatgaccaaattatattcggcacactactngcgtacggtgctgactatctcttcgataagtgcatagtcgagagcagtagtgagtgacgaagactgggagtacgcacaggtcacgacggaaacgaaaggcttaacaagcacctgccnttatctgaatgccttcncccgatgcnatttcgcctctggagngtacttcccgtccgagtgggggccacgttgatcatggtgtgcgctagggtaatcctgatgcgggagtgctcgtgtagtctgcgaattttgaactcccactccnaattgtcctacaattctngggcacgacatcgcagttgacctaacggattgaagctcgaaccaaaactcggtcnaggggagtccacgttttagttcacccggtcacatggccgtaccccatatagtcttgcagtgggatntacggtgagatgcgatacaatccangcaagcgcgctgtacggtgaaaggtaacgatttccatgttgtccttaaggctccggtccgcgaggcagggatggcatagttggaccttcatgcatttccctgtgaattaaatccggccaggggggtttatcccgtatgggagcaccagcgcgctcggagtaggtgaaattcatagtgagaatgtccagggcgtacagtgccagtggctagagtgcacttgccngggcaaaangaaagcggggtctctagtccttgcggaattccccacgcggaacccangagtcgntagtcattccaagttaaatcgcgacgtaccaaaccnaatcgaatctgaacgggggtnagcgaacgctggtgcacaatctacagcacgaggcccacggaagttccagagggacgcccggggcngttgccgcggctcgaggatnacgctggtaatcctggaaacgggtggacaagcnngaggggaangggngtataacccgggaagggtaggggaactcgtcaccaagtgtacnnggtntcgcngtatgcactttactttcccggccgtgccgggggngaccgtcacagccnggcgcacgnggcctngtgcaccaattaacggggggcccgacacacgggttcgaggcacggcattgtcntcaccagtgtggngcatcacaccacacatatcaacgggttaacagatgcagcggtgccacaccagtgcccaccacgaaataagataaaccccctgatatggggggtggatcgacaacacc

SEQ ID NO: 103946 - DNA, 903 bp, Triticum aestivum
  unsure (1)..(903): unsure at all n locations
  Clone ID: PAT_TA_103946
tgatacaacttnatntttnaatnatnatgncagaattataagacaacatagatnntgggtcgggtgcacncgtgacatggtgtgacacttnatgttgtcaccgcatgacatacgacatatccatcgantaaagcaacggtgaaccatnattatatatnactagaagtatcttncctgtatcagatagggcaccaaactccggtgccaaacgccnaaaatggacacaactagcgtggctggcttctgtacagagcggccacatatangcacgtgngagcatcgtgtgggcnggtatacgggagacggcantgggagaggtcatgtcacctcaacggtcgagctatttaggtgtgggctcgacaagaaagggtgaccgctagtaggcgcaacttcgtatggttcgttttgcaagggttgttcgtcccgagcttcgtctcgactcgtcgcaactcgactgttgggggttcgggaaacaacatgggtccnaaantggttcggngcggggtctgctctcgcctagactcgagcattttccgtgagttgcggaaccccctaggagaccccgtcgtttgggtatgggtctcatatcgtctacgtgcagttgcacttggggaagttgaggaagttgacttatgccaatcgggtgagttaaggcgctctaatgatgccgtgngaatggggcatggggtgtgatgtctatgccggggcaaattcggctctgggaagccatctctgtctatgtctctggcatgcaaattatggggctaaacttgtttgctnagctttgggagacatatttcgggtggaccctnaaaggcaggaccgtttgggttgggaggatttgggcccactaaggggctttgggagttggnttaaggtggnggaggggaataaacctttggg

SEQ ID NO: 103947 - DNA, 892 bp, Triticum aestivum
  unsure (1)..(892): unsure at all n locations
  Clone ID: PAT_TA_103947
ttggttgggcaaagcaagaactttgtttgtcttttattcccaagcttgaactagtcactggccggtgtcacacatgatggtggcactccactttatttgtcatcgttacatcgattggtgcatcagcctaagcaacgatgatccagtctacctagttagtatagcctcgttcaggtatttgtcaattggccaccaatggcccgacgactaatgcgtgggcaaagtggtgcccgtcagtgagtggagcatctcgtggtgggacactacgatcgatatagtctaaccantggggaatggtacaaggaagttctattgctatatcaacccacaatagaatgcgtgnagtaccgactcctgcgcaaaatatgacgccttgggatttagtattgctagggatatggagattaggaatggcgcacntagtgacgctgtggggacttaggnaggaacctgtgtatcgcgcgaacccatgggtatggctctgacgcgtgaggtaatacagggtagaggccaggtgtagaagggatctaagttggcagtgtggcccatgtggggtcgtgagtatgatagtcgcgtgtgcgtttgcttgaggcgtggcgtggcggtggcacatgaaatgaatgggaacctgcaccagcacgtgctatctgagggatgggcgtggcggcgactctgagagagcccgtgcgttgngacgggacaatcttaggggtctaaggatttgngtttggagagcagagagccgaaatttcgctctgnggccgcgaattcaaacgttttgggggcaaagtngggacatattgggggggcgcaaggaagtttgagtttgggagcaccaaggannggggggagtngaacgcaacctaaagataggaaccgggcaaagggggtt

SEQ ID NO: 103948 - DNA, 437 bp, Triticum aestivum
  Clone ID: PAT_TA_103948
taaaggaattctggattctttcccattgaaagcgagctgttcaaataagtgtcacgccttaggcccatgtcacgtctgcgggcaagggaagaccgtgaaccaataaaagtcaaatacaccttagggaaaggcatggtaacatgcaatttaggcgcccctttgatagacgcgaataagaggggcgagattccgatatatgttttatggggttcagtaagcgaattaagttgctaatgggccatttaggacaaatccttacaaatactaagcttgagtttatttatctttggtggatcccatgtcacccggtgagaagtgtcatttcttttcttttctgaattcagctagtagtaatacttcatgctgggtagggtggatgatgaggagattcacatgagcagctcagccttcttgaccttgagacgctctcgaggaca

SEQ ID NO: 103949 - DNA, 546 bp, Triticum aestivum
  unsure (1)..(546): unsure at all n locations
  Clone ID: PAT_TA_103949
ttttttttttttttttttttttttttttttttggtcacaaaggagaagcacgngcatccactcaatggcgactggagagttccacaagcaaatgccagctgcttataccgctaagaaactacgagagcggagtgcacgtggagaaaagtcaggaaacaaagatcagtgagcgccagctcactagcagcgtgcgtgcattagagcagccaaaagcggcgccggccgagaatatgtgaccacgtgtgtgacaacatcatgtggtctcagccattcaaaaccttccttatccgtggcaggcggtgtgcgccaatcaaactctcgccaaaattgtgcaatcgtgggagtgcaagaacacatagcacacccgggtgggtagaattataccgtggccctaaaatataaccaatcccgtggccagaaaacggtntgagtgctacaattccagcaagaaggtgccctcaacacgtgacgtggcaccttcgtggtacctctggggaacaatcttaaagtgtgtggtcactagggtaaggtgggttcttccatagt

SEQ ID NO: 103950 - DNA, 1050 bp, Triticum aestivum
  unsure (1)..(1050): unsure at all n locations
  Clone ID: PAT_TA_103950
ttttaatctagcaagcanantttctgcattcaaccttcgtacttatagatcatggtggtcacaaacgaaaccaggtgcatgcatgcatgcgacacgcttcatcagacagtgcgtacgtatcagtgcacggtgcagatcagttnctagaatcatcgtcggatcggttcagagtacagaggaagacctaggcagtactttactaggcccgaggtcacgagatagtatggttgggtcggaaagtgccacaagagacgtggtgtgtgtgacgggaggttactgagtntgaggnttgtgacggcngaggttctcgagggggcgcctttgtacccgtgctcgtacaccgaaatcgaggcacttcgactagacggaaaggcgaaaacggcccgtatacgcatttcgtgtacgtaacccaattcgtgacggaaagagtcgaggtcgcgatcctcccgtgtgaagtacttcccttgatacnaacacatttgnaagaacatacnctganagacaagtgcacattcgtgagaggttcaaatccggggcgaagtgtgccgcatggggatggtgtcagacaagggcntaagcgcagncccagcgcgagtataatggaagacgcgagttccagaaccgtaatcgcatcacgtacgccgattatngacgtggngacctggcccgggtcgcacggcgggggganggctcncatcgagacgtggcgacccattgnagcatcggagactgggcacagggtcncagantgggccaanggggaatgcctacgtcagcntgtccgatgtgaagcggaaagcgtcatcgggagggtatgagcncccagaggggttcaggttccccgaagagggctccggggaccataacggctgaagatggaaatcctggagggtaagaccccgcgacccttttggaaaacactaatcaacnggggatcctttcctggccactngcaaaaccttttggcaaccaggcccaggattaggncgcgtgggctctgaaagccaaagagtnccnggagggggacaaggaaacggcacaatacccgaa

SEQ ID NO: 103951 - DNA, 1133 bp, Triticum aestivum
  unsure (1)..(1133): unsure at all n locations
  Clone ID: PAT_TA_103951
ttttactgatagccggggatttcaaatcaagagcgcaaatctgatgcaaacatccagacaagaccatgaagcnacaggacatgcagcactgttctcagtaacagagacattatgattattaattaacttgtaagtatgcactgctctcagtataaaacgcagggngaccaccctcaatctgcatgagaccgtttccaattatgacagaatagatagtagtcgtatatgtgtccgaggtgtgcgtacttctgatacaatactttcatcgtcgaatataattctttaggcctcatagtaattagntggcacacagtctcgtgcttcaatctaacggctgtgaaccgttgcgtatgatacacgtccacgtacagacggcgatcaagcatacggtaaaactattcacgggggcaagtcctactccgtgttccctttcaagctctatggccctaagcgtgacgggatttcgcatactcgttcgtatgcacatggggctttccctttacccaatgcaatgatactactggtggaaaggccacttttgatcccatgatcatacgcctattatggacctcnggtggctcaaagggctcntccttccggcgtaggaattgatgcattcgggacccaaggagttcatgaaacaggtttcagcagggactacactggtgatctgcgcgatgacatgtgatatacccnagaacctgtataactcatcgtgggaatccaattggnccaataccaggatagccaggcaccaatgcttgttacacaatggtggattagactgccctttgtgctttcaaaacccgaagctaagcacacgggccaagtgggcagccatggcgaagtggggtcaaaatccgcaggtggggaatgagagtcatcacgnggtgggacccctgcctgggcaatgggtgcacctgtggttccangcgccgttggcagcatggcccagnngccaggtacctttctcccccgggacacgaactncccaagttctgacgggacagggggaagagcgagttcgcgtggtttgcgacaaaaccgggaacaccctctgncgcgccggggcggggacccaacacagacaccgggggtnccaagacaaagccctaacacagctccgggggaac

SEQ ID NO: 103952 - DNA, 1183 bp, Triticum aestivum
  unsure (1)..(1183): unsure at all n locations
  Clone ID: PAT_TA_103952
gcacatcgaagtnntctttccctctatananaaagatttttaaggcaaaagacaatatatctgtgcactgacatcaaatctgaataacacaaanaaaacntacaccccccctccnattcctgacgatacatatttaaataaacttgaacatgacgcatatacataccgccagccacaacacactantactggtaacgttacacattgctgaccacaccgtcacccttattaccaccacatggacaccaccgncancgcacacgacctggccacaacaacttggccaccacaaccacanctggcctgaacacctgcgacctggaacatttgacccaancatatcacccaaaacntngataaccttggtggaacacctggcgtttgagtnctggaacatcaacagttnaacnctgggnatacactatcaccaaccctgnanaaaatttaatcaaacaccancgccaacaacaancgcagccgattctggtgctaaccaaaccgcttnatcaacgtactcgaccacgcccatcaaagancctagggctccaacaactctgggtgtctggaaccaattggcatccttctctnggaacacgcttcaccaaccccangacagngcatttcatanctcaaccnaaatcagatttactattcaagcgaacngcagttgcnttccaagaaanacgcattctttataacgccctgcaaacacaacgacatcaaacaagccactcaacagctcgtcnaaggtcatgccaanccagatgtatgccggcccnccatgtcaaagccggtaaacataaaagccntaggtgttacgattatatccctntattcnagtccgtgcatatatttatttcaaancatnngatntgcatcgtcaagcattcgtattcccnnaccgtcttctaaanaccctctcttaacccccacgggtgatgggngtcgccaaaccggggnatgggtgtgtcaaaanaatttcaaaagatttcaaaagngaatttgggtggctatgcccgcccgcaggcaaattacaaagcccagagcccgacaatcaccanaggattgaggatttccagtcccgtgctaaacgaaagcatangtccgtgccaatcatagcccgnacgttcaaaggggtggggagtcaaccccacacaaaccaaaacgcnggancaagctcaca

SEQ ID NO: 103953 - DNA, 990 bp, Triticum aestivum
  unsure (1)..(990): unsure at all n locations
  Clone ID: PAT_TA_103953
tttttttttttttttttttttttttttttttttttttttttttttttttttttttttttttttttttttttttttttttttttttttttttttttttttggggacaaaacaaaaatctctgtnnngttctttaatccccaatgctggaacaaccacggggtcgggggtcacacatggatgggtgccacncgccacttaatttggtcatctgttaacatcagatggggtggcatctggctaagtaacgagatagatccatctatctattagtataaatctggtgctttttacacatgtgggcacaacacaatcccccggcagatctatggtcggggcaaaatgggtggcctctggatgagatggagaggcatctcncaggtgtggngagaacataacacctgtgggcacacagtgggtgtgtggagaaaaanatagtttggcaacacacacaaaatgagactctgaggatccgtctctccaccaaatntgagagantctaatgtgtggnctgtagaggtgtgtggagagtgagattgtgcgcnccgggtctcttgggggacngcagaaaggaatgtgatctcttngacccaccaactgcggtgtggtgtgtgtcatgagaaaataatgtggggaccagccagagagaatatggccttggcctctaggatgntgtgtgagtatgtgtaagtgtantgtatggtatgtagttagtgtatgtgttatgcgctgcgcntggtcnttggtcgttagatgagacctagaatnaggatggagaatgtggcnangagaactggcttatattggagatgttgagnttgggtcgctnttggggagaattctttggtttagatagagaaatttcttgngtggtaaaatatcttcttggggaggcacacgcaatttggntgacgggtatcggtattaacnctgtgggggcaaatcncggtttatgggggggggccaaaatttattcgancccaatgagtgggg

SEQ ID NO: 103954 - DNA, 1038 bp, Triticum aestivum
  unsure (1)..(1038): unsure at all n locations
  Clone ID: PAT_TA_103954
tttacattctgaatcagggtgtcaacaattgtgtgcactctgtcacagcaaactgtagctgtcctgtaaatcatgcatggcaataatggggatgctagaagaccttcatacatactgggagatagccatgcgaaagaggagcatgcatcgtngaatgttgcggcgtgtactgggagtagtgagnacgagaagatttacataacagagagtcggaaggatctcaatttgacttcnacaatacnatccaatnagggcaggcgacgctagcccatatccgaaatgtgggatattacgcgcaggcatgcagtaggcccaagcaagccctgtcntcactacgcangcacgtacgcgtaccggggatgccaggtcgtgcgtatgtcggatacgtgtactttccctgcagananacatcatcgnatcggggggaggaacccgtgtagcaagcggaatatgggtaccatgtgcaaccaacacacacatatgtgacgtnnggacatggngngtacaagcgcagctctagcgattagacgtagcatacgcatgaggtctaggacgcgatgtatgcgcaacgcgctatcgaacgccagatgcagtgaggaatcgctcatggaaaatcacgatanagtggtttcccccgtcgtaggtggggaggttgctcatcaagtacaccccggagatcgtacatggggcattggttggatcccangaaaggcctggcgatcgttgtggctacgacacgcaggatgaaangccatccttggggangtagaggcttgcacgtacaggcgtcttggtgganttgggaattagggccanggattctccaacggagcgttgcactagggaaccgacgnttgtgcgacacatcttggataactttcgcctcacattggtagggtcccggtatccaggtacacctcttgggaaaacccacattggtatacagcggggaaaaccatggcttntcatctnccacattggtgcgtagggttcttcttcacacaaggtaggtggncggttgggggttcaaaccactgt

SEQ ID NO: 103955 - DNA, 1262 bp, Triticum aestivum
  unsure (1)..(1262): unsure at all n locations
  Clone ID: PAT_TA_103955
ttttatcgaatatatntgggtttctcccgtttccgatatggcaaantgatacaacatatgaccattactatctcgagtgcgaggggtagctacatcatgggcacgcaacaatgcaagaagggcatccaacatgatgacttattatatcggaacaagagtacatggaaactacacgagcaccactaaccaccagggtatgtacgaccatgtggtagtggatacatcctcgagngggcagtcccaactcttcgattggacacgagaggtgcanacaccagccgagccgtggcgccgtgctgangatcgtctagcacgccantggcattcacgggcattcgatctaacggcctactcgagggatgntgtagggcgccacgancagtcaagtcgcttgnctccacggacacatgtggagctaccacatgacactccaccgcaacgaacgtgggtctccccaccaggtacgcatgcttatacaactcctgcgatatccagtgcaggtgcaagacagaacgtgcggtntggaacccagtggctaagatgcaccgaatagaggcaacgtaccgtaatcnatccctcgaaagctaggggcaagctaaacctcgcgagtggcgtggtcgtggtgtntcactcatgaagaatgtggacctcanacgggaaccaatatataagggcggaagcctcctgtagggnctagcctataggggccgacgtcgctgcgagctatctcaaccaaccgtgaccccagacccgttttggcgccaatacaccttttctggagaccaccaacggggtcgtcnggcagaggggtttgtacccaaggtttccaccttcccatagggggtggctcatgtgccngacaaaactcaagtggcgttcagtacttggagcaccctgattccccaggaatccccaggcaccccagtaatgagtaacaccaacacccaatcacanatcccggtgggaaggggcccctnggggtaccccagggggggggagggcaannctggaaanaaaaaaagagcacttaacaaacggaaaacncagcagacacnccagcagagctagacagcaacacacaagagaccaaggagcgncagatgcaaacccgaaacgaaccaccaagaccactgcacacagancaggaagccaanaacacaaagacngacanactgcaactaacacaactaaatccgaggagaccaagtagcnaccacaaaccacgagccttcccgcggacgcgcagttcagcacgacgagag

SEQ ID NO: 103956 - DNA, 689 bp, Triticum aestivum
  unsure (1)..(689): unsure at all n locations
  Clone ID: PAT_TA_103956
ttttcaaatgaaatattcctatccataaaccccaatacaatccacctatgtgattacaaaattttgattagacattttaatttgatcagatgaaagataaataaacatgaataattaaatagctttatggtgtttcagctgaaacactacagagcagngctatctagacgacattatttggacgatttgcagccgacgattgaatccagccgtgcaatctggttcacggcagagcaacggccggtggattctttaatcgtgcacagatcgtccaaaagtttatcgtgtgtgaagcagtttcgaacaccacacatggtgggcagcctgaccggaactgacactcactataccaatgcccaattccattcacgttccgttcctgctctgtgcagnggtctccaaccctagcgagcttgctgccatagtcatcgctctccaagtttaatctttttttccggcctacagnggggtcctgaacttctgattatcacggctgcagtacagacggcagagaagcttacacttaattagatttagaaattagaaccaatggcattagtcccccgtgcgttgtagtaccatggtaccttgaaggtatatgacaaaataatgtcttactctaaagtctcgatgaactaattaagattttgtcggcttttgagtaccaagaggactgaccattggagggt

SEQ ID NO: 103957 - DNA, 1063 bp, Triticum aestivum
  unsure (1)..(1063): unsure at all n locations
  Clone ID: PAT_TA_103957
cccccccgcgcggggggggagcgattatttttttttttttttttaataaccccgccagaccatactcanatgatacgacttgggactcncgaaaacgggncgcgactnntcagtcgtgagatagaatagagacgcccccccccccccctgtngtacaatgtaagntggaaagggggggtttttattttttantatatttaaaaagaaggggcctanccttngctaccgacgcgcaccagancangctaccaatacctccaccagggaggactggatgtacaccaaacgccaaaagntctccagaagtcatggnccgcatccntacacccataagaactaataccaaatcactggggtgaagnggntggtgacnccccccacacccactctccaacagcnggaggcggacaccttatncntctttgtttttttcatcctanctactgncgtacgaagattctttgaatgtcanccacntacaatcattgggggggnacaacttagnngnggcannaanactggcgatctatagacaagtatcatacatatctaaacaaaaatgtgtggtagtacacctacctccaccccactccccaccccgacantcaaaatccatcccctcanaccaacnacgggggcgatgcccagttcaatataaancgtntaangtgtttgccttcctgtaaccagttcctaanataatgtnactacantcatntcgtacatanacaaagtttgaataagtaattccncttcaatcagcatcactactctgtcctatgattaantcgtgccnntaccccancaaccaactaancntcaanatggggggggnggaccaatcnatgggggngcagcataactctcaccnagccacnnccccaaacgactaaattggatccgtnaatncaacatgtcntacanttcgtccaccnccgataggagntttnnaccccctgaatacaaaataatagttttcgnnctcgcgcaaaangaaagtcacngtgacanatgcgcagtgtttnnagccntacgngaccaattcgggggggccaccttcaat

SEQ ID NO: 103958 - DNA, 1360 bp, Triticum aestivum
  unsure (1)..(1360): unsure at all n locations
  Clone ID: PAT_TA_103958
ttttattttgatatatatcggcnttttatnatganntcgcatgtgatctagtggagaacgtgcaatgatatgaaaatatgaactatctgaacactgtttactacnaattnactataacgtgcgaggcaatgctatggctacgcagacatcagtacgacaatgagtctatcacgagcgangccttggcngtcaagataatatgtacttttactacttgtggacaaagcaaattgtgtcccctatcgtgcttgccatantggacacatttgtngtgtncnctgaccacttgatcactggggactcgcacatagtgtggctactgtgttgtnccctgtttangntgtgtgtgtcatacctcgatcagtgctcgccaatgatagctacactattacataacctgaatgctntgancagacacgtccgaacgcacacagagaacccagaaactgtgacgncgcttggttgtaattgaccgtcctatacnttatattcacncctataacaagcttaatggacttgaggttgtgactggcgctatgttgtgtgtgngactgttgcattatttgtaacggacttagganagaggagtcctcgtgtgtgaacangggcaatctggtctgtttggaatgtngnggtcgtctgaacggtgtcaagttactggaactccaactagngtggttggccgcgcatgagcgacagcgggcaccctgtacntattgacacgccaagtagtcacctgantgtggacagcctggtgnggctgacgttgcgcatgcactgggaccttgactgtcgaagtgtgatcagtcgacnnccctgcacgaacatactttgctcagtacacaagaagtggacacctcctggcgntaataccaacttggggcgactgtccctcagttttgagngngnttacagcccccattctccaaatgacgatctctgggcccggaactggggtgtggacatggcgtnctnggcccaccttggaccggtctaccagggcccccagatgtgagccaacaaagggtantcgaagaaccggctggcgggtgacccaaacccggaccaccantccgcagaggagaagggtaacctatcgcctttcccntgggacagaccccccgtcccccaacaaattgngacgttctagaaccgcaccccgagacggagnaaggagcggagcaagaaaacggnnccnaaagagccaacggcgtaatagagnagacagagaggagcaaagggggggggagaaanaaccagaaaaagnnttggaaccaaagaaagaaaagantacagtggaggagcagcgataggaacaaaaaacgaggacnaaggaggacgcngcccagnggggttatgg

SEQ ID NO: 103959 - DNA, 1033 bp, Triticum aestivum
  unsure (1)..(1033): unsure at all n locations
  Clone ID: PAT_TA_103959
tgattgtgttatccacaccngaactaatatgtacgagttaaacatcnatgttattcattacagagtgaggtaactctcgacgcttatgagtgataccaaggcacggtttgtacangagtcatccaggagagcagtaatgcgagagcacaaaggtattggtgtcgtcacactgggtggagaatttggcgtggtgccccttttagcaaaaatatagtattgagaccataagccgaatagcgaccccttgctctcttgaagcgagtgggagtctcgaggtgcccgagagcagcccctgagggggcgataacgacggtcttctgcgaacgcaggctcaggaagcgcgatcgaaagggcactccatggatctctcgcgctcagtaaggcataaggtacagatcagctcgcggctgattcgttaagtggagtcgtagacacgaacgctgacagagccgcgcggtttcgttccgtcttcgtgcctctccttgtgtgcacaactccttcccacgttcgttcgcatagtnttgggtngtaggttatcgattagggtgaatcatnacttgctttgggcacaggaggtaagcaattgatcattcgcacgggcagaatggctcttgattttctagataggggttctgtgtaacagttggccggaaggtaccataacaggcaagtcggcgatggcttcaaaagtctccttgtggtgaagcatgtagagtcgttaaggttcttgtcaaaacatgagtcgccgttcctnggcgntaatcgatcgttgcgngatggagnccaccacataacacgcaatgccttgtaatggggttactcgaaatggaacattccaaccgtcgatgatgncaattatttcgtgttgaccccggttctgggaaggacccacgtgaattatcctcccaagantncgccgccagggcaggttgntcctttgggttntggncctttaagtattttctcgaaggggtgtaggaaanaactcccagggggggnggggaggggncaacngttacacggggaaatttcc

SEQ ID NO: 103960 - DNA, 702 bp, Triticum aestivum
  unsure (1)..(702): unsure at all n locations
  Clone ID: PAT_TA_103960
tttagaaaccgaacacaaactttatgcatcctgagcaacagagattaaattctacacagctcacatcctgggcattctggtaacaacacaaggggtgcaaattctccaagagtaatgagatcctgacaactctggtgtgttgatcatgtggtacaaattcaactcataatagcatctctgcagcatngctatcttcttgacgtacaaaattatagtatctaatagtacgaacccagtgtgcatccacgcgcgcgcgcacacacacacacgcaaaaaagaagacgacgagcttaagcagagattagaagttgcaatctcgaccagacgcaacacgggacagaagactttagctggcctcaaacgctggcaagcgagataactgacagcgccaacaaaaacaagccatcggtgtcttcatgccagttgactaatgactaatgccagcgccaacacagcatataaaatggaagaacctacagcaaaaaaatccatttctgcatctgccaccagagtgtaattccagacaccgtgcgtaaccagtaaatcacaatagcatatctaattggacaagaatctcaggtgttgtgcaaaagaacagcttcaggaccaccaattcctctttctgtagtatagacactttcgaatgagtgatagtgagacctggattggttcccaagactttctcatacggggtgactcagc

SEQ ID NO: 103961 - DNA, 1437 bp, Triticum aestivum
  unsure (1)..(1437): unsure at all n locations
  Clone ID: PAT_TA_103961
ttttatcacgaaacctcgacttttgaagtgatgaccgccnnggcaactaatggtngnagactggactactgatgaacacagtaacctgagcacaaaaggccatcacatcagctcanaatgcgccntccagcgagagctgcctggaaaatntgtngtgcagccgagaagttccatctcggctacgcctctgtctttgttgttgaatgcgccngatccagcttctgtgagtctattnggaaangttgngcctcccgatttaaattgtcatttgtgtctcactgtccccaacgcttgatctgccggctgaatccgcccgggtgctatatggtgctgctcccgaccttccaccagctaccccctcaggctgacacacagaagaccacgatacgcgatctcctatggttccgccagcttgtggctgttgcaaactcctacgctgatccaccggaccgctgggcacgatgttaacnggcaggcngaacaagcaagctgcngccgcggtctgtgtacggtgatagccttgtgatccgcacgctctacgaattccgcgtccgtacacgctagcccgacgtggccttgtggcagggccctgcgactgaatggctgacccgcctttgtgaacccaaccggggagngctgcgaagcgcgctgtgcccgtttgtgttccgactggaacggcagagcctngcncttgactggacggtgtgcgtacgtgtactaggttgacttgactnggttgaaacccgcgaccgcgcatnnctgtgcaatccgagcatacgccacggtggtgccctgtggtcnatnttcatctcgaagccagacaccccctgtgtggctggctagtttggaacatntgtgccatcgatgtcccagcacgnttcgtacanagttggttggtcatatgntggtcggaaacatntggnatatagggaagccaaaatagaacttngactaggggagggggtnttaaggcccaatcagngcaattgaagtggagnatctggatggaggcggnctgtnccntggaggaacccgtcccgtgtncatcccgaaaaggaacgtgaagccaccaatcgnttgtggcccgagaaacgantgaaaagtagaatgaacgaaccagtaaaccacaggcaccgcacggaggggtaacagacacanccgggacgcgaaacaacacaaggcgntacatgcatgacccagtggacagcacacaggaacccagcacatgaangtaaccagagggnatgccagccaganaaagctagtacagacctgacngaacacagagagtagtgtgatttnatatcntcgttttntntcnttttatanataactacaaaaaacacacaaacagcaaaaacaacaaacaaataacaanacacaacacaaacaaaaaaaacaaacaaaacaaaaaacaaagaacaaacaagaaaaaaa

SEQ ID NO: 103962 - DNA, 1118 bp, Triticum aestivum
  unsure (1)..(1118): unsure at all n locations
  Clone ID: PAT_TA_103962
tttttgagaagtgtgagacaataacttcaacgtaatntcggtgcattatatgatggatgtttcggaaatctagagcagatgcacgtcggtagtagatcaacggtagagatacactatcgngctcagcccaagcgagatatcgcaattcgatctcatggtcgtctactgaaacatgccatagaccacgaacgcaagttttactttaattcgatcatgggtctccttgagacctgcaaaaaactcgactgattctgaacttgngcacatacgccatgactctgtgctacctagtaaggnccagagctacggctcgatagccacagccaggacgccttagccttcgacggactctttgcgtcgtaacgctggcacggggaatgagcgccacagatcgtcgagatgaccctccccagaggactttaaaacaaattggggtgaatacggagtagaacgtggaggagcgtatctgtggcatcgtaggggtagggttgcngttgatccataggagccatgggaagcgagtggggggtacaccctttgtgcttggagggcaggggttaccatagatgtgacaaggngatctctggcgtgggggatagtgagtggggagaggnatcgaaatcttcgcgcactgaantgatgggtagtttcgtccccatttcgattccctcgcgcatttgccagggaaaatctgagcctttgcttggtcccggattagtcttctcaggatacantcggcttggtttggccactctgtttccccctcgggtttgactgcgcagacagatacccgtcgatcgtcactaccaagtatggctctatatgcccattggaactggggggtgacntgcaacatatcagccgtgngcccgggangnaatggacgaaggcgctaaggcnaacgctccctatgtgtgntggaccagattgggnacgcctnatgcggcgggaacacgctccccatcggaaaaagcccgggaaaacgatcgtttccatttcgtccggccacgggggacccgataggggcctccgggaaaaacaataanagggccaggcccccaacgggcatagggcacccntgcgnggggcctggggaaacgggctcggacaaagggcaa

SEQ ID NO: 103963 - DNA, 1152 bp, Triticum aestivum
  unsure (1)..(1152): unsure at all n locations
  Clone ID: PAT_TA_103963
tttttttttttttttttttttttttttttctncttcttttgtaagtntgcnatgtccaagtcgcatgctatatcaaacanctgcaaataagtgtgcgaggcatacagggcaattcaatcatcaaagacatgtcgaataaaacctcatgaaaaaagcgagaggcaatcgtctaatctgtcgaagggttagtcgagccgttttacttggagagacgcgggaatgaacgaagccnacctaacggggaatgctgtgaangtgcntagcacttggagtctccaaccaaaagtgaatcacgaacaggtagngacaatacttgtccctcctatgggacacgctcgtgtattttccagcggctcaggtnacttngaggttcatgagacccnacaccagtcacttattcgtccaccntacgtgtcaactatgcatctcgttgagggcactgcgttaccgttctactccacaattacaatacttcattggcgctgttgctaataggtagaccatgcaagtccaagttagttgcagtgcgaatgtcacacgtctgttagacccaaaaatttcgcttatccactttcctacagaaacccacaatatggggccangggtcataacactattgaggcgatacatggggcgngttagtacgcacaatcccaggaaacacctgacggngccacgatgccatactgtactcacggttccannggcactagacngcaataccccatgagaggttaattacgacacaaactgacgctggtntnggaagngcacacacgcatacatcatggttaccntcacgcgttgcccaagggggggtcctnacacgccccagggganatcttcgcggagcattccgcnactgcncaaattggctagaaagattcccncctaggaaagacttttngcaccgacctcggagacggggactgatgagaggccatagtgacgacaactgtgtggacgaagaaaaggccatggtggtccngtcgcccaatgatcacgggnacntggatttcnccgtccnnaagttatatgcaccnaggantctgtgacgagcaggggggcccaaggangcgggggcaccctccgccanaacaaagggncggtcaagataacactaaatncacccgaggtggttcagnggcaact

SEQ ID NO: 103964 - DNA, 1078 bp, Triticum aestivum
  unsure (1)..(1078): unsure at all n locations
  Clone ID: PAT_TA_103964
ttgaaancagaaaagtaactaccggtgtatatattggccggatcggctcggaccggccatatctgaagtaacaagaaaagaacacttggctaaggatcctcgcatttatattgtatgatcacggattgattagagttgcccnagaaacccaatccagcactgcacactcgatacgcaacgaaaagcagaacagtgtggacatggaacagataagccaaggaaaggaagtaataaaccacaagaaaaggagncgtgtatctgccatatatgcatccatctggaaaggggacaccnnaggatctaanacgacggtatgctagagcaaagggtgagcttcaactagccaacggtttccaacgccattacttgactccacctgaaccatgcttgtaatagttaagaaactggagatcaaccaaccacctaataatcggaaacccccctacttcgggcacggaacacgacgatcgcgaatggccaacggaacagaacagaactgcaaacggctacgagtatgaggaaccgtccactttatggggttgttgaagccttcggctattccaggtcggccgggcctgtcagagagttggttcggntagagtccatccccccataaccgaagagggagcgaggttcgnacgcatcccatcgatagcataggcctaggcagctcagcgnccccccggttggatccgatacgtgagcgggggagcggctaaaccgtccggacagcccgccgggnggagaactactccngacagcgggacaggccgggaaaggtcgccggactcgcggggccggcgggacaggcgccaaaggcccggtgngggcaccgccggtggcgggggcagcctgaaataggcccaggaaggcccgcggggccaggaaacagaagcccgccgtatccatcggcgaanccggtaaagataccgtggaattgggacggctgcggataccaaaggcaggccccggggngtgggcacggggaatggttgggaaagaaggcacaaccccgaaaccccggaaagacgggcggggggggggccccaagcaacangaaacacaaggcaaacccggg

SEQ ID NO: 103965 - DNA, 1386 bp, Triticum aestivum
  unsure (1)..(1386): unsure at all n locations
  Clone ID: PAT_TA_103965
ctgtcttttgtagnctactacnacttaatttcatttctacttctactacaatcatcgttgtttgcngttgcatntattatgcagatgttccanaacgaaaaanaggactgcacatacgtgtagatcacgtgattcagttcaactgtgtgtgtgtgcattgactacacatacgnnatnctgacatgagangaactgagtgttatacataaattcgntttgatgnagtcnactactaaacgtgcatttgccctgtgggctgncatcngggaattgacgatagcacgacatccatctgccccgtgtgnaacagaaggctaatagatgtcgaanaaaaacaatcaataactggtatcngaattactacacacggtattgaatgagaagagncacaganngcagtgagacatacccacagganatntganagcagcttctgtgttgagcggcnaaccccttgtcaccattgtgccgtataccagtgtggaaactgttgtggatcgagtggcttcgcagataccattcgtttggggctcaaagacatggactcacacagcagtctttgtggaccattctcngagcctgaatctgccacaccngccgtnttcctatcaccatacccngtcccctctagattgcctcttgcggggtcgcatttggtgcgcatgtgatactnatcccgttgctggtttcgtatcattccccaagcngtngnatatgagttgcaggccgttgctacttcaggtgcncaaagtcgttttcccatcgttcgaattcggtctactatgaatcccaatgggctgggaacggcgtatggtcgagacactttggattcctgctcgatacacccatgagnctgaattggactagaacacagccgtcctgtccnncgtgcatttgaaagccaggggcgtcacggnagggatcgtactggggagcaagtcgtaccagaggcggatcgttggccagcagaccggaaaggcntatgggntgcttccaacgtacgcttagattgtacgtgtnaccnttgggcatcgacccaccangcgggccggggccgagttcgganagggaacgaacgaacaaggggtagngannncnaccgtccnnaccgttccggtgatagccggcanncaccatcntggaacatacatggtccaagagggagggacacattatcggtanacatggccgaganaaaagatgaacgcacatnngangcaaccgtcgacatgacngtacatgtagggtcacaaaaacgaccctgcactattcgcggagagacaaaaccaaattngtcacctaanccacgtcatatgggaacacatgtantcatcgtgtgnttttcctctgtttcttttttttttttntcntttcaacgaaanaaaa

SEQ ID NO: 103966 - DNA, 1341 bp, Triticum aestivum
  unsure (1)..(1341): unsure at all n locations
  Clone ID: PAT_TA_103966
ttttacaaagcatcatattacaagccagtgtgcctcaaggtgctcgaatacaagagctccatcatagacnantcagctgtgaagcaacaatatattgagtatagacataatgtataagacaagttgtgccctttcacactgacactgtgccactgtcacaacatcattgtgtgattatcgaaaattccgagaaaatatgtggcggcaattggacttcccctgacccttgggaaaatgcgcatccctaaacnagctacctatgtagttctgtctgncacgtctgtgtggcttgacnctggtangctatcatacgtgtagggcttccccgcacggtaanaaggtagtacggttcgtctgacaaangactggcactgtatatatggggngtcccccttgttnaagtgtccctcaccccacgtncagttgtgggtcntgcccacgtcaaaaaagacacagnggcggtagtacagaacacacaaggggtgggngagaaacagctgtggtgtgaaagcacacacgggcncagaccccccggctgacaagactcaanttctantctccacacgacctgtaacatnctcgcccactaanagaccaacagtggagaggccgcttacccgcactaaaccaaacaaagntaaatggtgcacctttggggttcngntgcaaacaacccgcggcacncagggagggtgcacgtccganctnacanagatcggtgaaagtngganacntggcgacgggtaatggaccgggacagtcaaacngaaagaggaaaggcananaatngcaataagggtaccccctaggtcctaacngcaagccataaagggcacttaccttggngcacaacaacantacacaccaaccactatggcacggccaactgggtacaaccacgcaagcacgagaaacgcaacacggggacanagcatgtcnagcaccgacacagcancaacaccaccccctcgttggcacggcccnataaagatcagcatanaaacacccgaccaatnancatacagaccaccccgtcctgtcngaacaccctagangacaaggagagagagctnaacccaaccgggggcttggtcacttcccttggggcancgnaaggggccanaggaggtggtgggatgagnaagtcagcaacgagcaacnccccgggcgcgcccaaacactgggccaacaccagggtcagngacgggaaagagcacgcccaccacccgcaccgtgcgtacccagncaanaacacaaggggagcagtcccggaacacaacacgacaacacaccccccngccaggggtnggccctccatatacccanacancncgaccgaaa

SEQ ID NO: 103967 - DNA, 866 bp, Triticum aestivum
  unsure (1)..(866): unsure at all n locations
  Clone ID: PAT_TA_103967
ttttttaaaacatgtcctcactcaaggacggtacacggataaatagataaaactttcccggcatgatactgttatgacttcatttgaatgaagataacagggtacaggaacaggttcaggctcaggactcaggttgccaacacaccacacctagtgatgataggtaacaagggttaaatgtcggccgactacaattctctcgttcgtagcaacggcctaatctcacagcgcggcgaaaccaaaccgagatgcgggtaaaacatcagggctgttagtaaacacaattggtgaacccggcagaagcttcatcttaggagatgttcgagctgttgaggactgggaccgacagacatgattcatttgccccttgcggcgtgtacctactacttaggtttatctgcaaggctgacgagggatctcacgatgcccgggctgatttgtccgcaagggcgcctttctcggagatcgcaaacgatttctccttgacaaagcttgcagcttctggtgtcgtagtccagatgctcttgatcttgtccagaacagtgtgcgctacatgaaatggaacacgagcaaaaatatctgagcctggaaacattagccaggtatgttctttgggggtcgtgattcccggcaaagttgaaggcataattctcctttacatactggttggganaaagtttcttccatctcctttcattacgatcttccaaggggatgggccggggttagggctggggcctaccgggaggggtaggctcccggntagaagtctcaattctatggttccaccaacgtgnctgccaaaaangtcgggcggtcntgtaacacaacaccgtaaagcggtcgnacncgacgggggacatcac

SEQ ID NO: 103968 - DNA, 1066 bp, Triticum aestivum
  unsure (1)..(1066): unsure at all n locations
  Clone ID: PAT_TA_103968
tttttcctattatattttttgtttgtgcacatgcgggcaacgcatttcatttcattttgattatgttcacaannntgcatcatcaagtnnttgctagcctngcgttgcgtgngtgtagagacaggattaaggagantgcatacccatacagactgggaggntataggcatacacagacttcaccactngatgttnnagantagntgctntggcttgtgcgaattgccctaccaactgcagaaacctgtctcgncttctntgntnngctgtctccgttgacatatccaaaccatagtagcanctagctgggtgtgggnggaccggctgcacacatccatacgatacacccttcaganccgttagccagaccccatctaggctgccttagcacacatacagcacagcntccccctgttgatgccgccagctgaacttgctgttcgttgcactgaccagcgggtggnnaacactgtggtggtggtgatctgacgatcgaaacncttgtnnatgacccctacccttgattanacaacccattccggttcngtgccaccactnggccaacagaatggcgtactgcccactggtcccgattagagcggttaccgnataaatggtgctggtaaactctgttgcngttactnccaacggatggcacacgnnntggcagctngttacctccgactgctgnatgcctggccaactgtgaccancccagtgcaactgacaagacngccggataatggtgttgcaaacacctttcagccnctngttngatgacatgcacgcangtgntccatcctcctntcttggttcctgnaagnaggataattgggttcacacgttggtganngaccaaatccaactngatggntgccagacnangtgggctgctcgancgaacttccaacccattcgacccttcactccgngcnggatattcggacctactncaanccggggcgtgtccccatntanngatgtncaatgtnacgntgctncaatacgattccccacaattctgccccagtccgnggaataccnccacattantctcacaccctcc

SEQ ID NO: 103969 - DNA, 1211 bp, Triticum aestivum
  unsure (1)..(1211): unsure at all n locations
  Clone ID: PAT_TA_103969
gtcataatgcttacacattgcgangtnacagtangtnaccatacgacgctgtacatcagacagnctaagtacncctctttttacacatgactcaatcatcnacangtaggtntttgtgatgaacaaaaaaagtcacaaccgtgtgtatgccagacantaaaanntaacnctagtatagagttccgtnaattaatcattncaatntnttgtgcataaatcatgaaatcggaggacacgtggttctcacgtacacagacacactgagtgtgtgctatcagtcaatcancatctgacatgaccgcgtgtcaaagtctccatgacactaggagaatgtcgtacnngccaaaatgccatgccatgaagtcaaacactgtagggggatacccctggtcggttancccgttcctgcattatgccagagggattnanatgatgctaaagcggttatacatcactatgtagtggcggaangcgtgatggccaaaagtcatactcattcctgagcgcgtgaaggcttgtaccgctcgcaatnggggcttgctccgntcgtctctcctatctgtaccttcncgcctcatattatccacccatattaacaaaacctaaccctgcaagccttacctccaagggctncttgtcttgnngtccantgcgncttggcgcacttctgctnatggggcgtacgcattgcagatcccgtggcgtactgtcgacctatgaaaattagatcgccntatgaggganaaaagtgcgtggcatgtgggcgtataacgcagtcataggagttcagtngcacacgacantggacaccccttcggataacaggtggccnaccgaccgtatttacaggggcattggaagatttcacccacattgcttgtgcatttaacagaactgtaacacggtgaccggggaaccattcacgaactggagcagcttagagtgccgttgttacacggagaagaacgtcgtagtacggatcgcgggcccccaagtagggtagcgaacatccccattcggtggtctctttatgggccactctggnccgcaagttntgnnaaattccggtctaggnttaagaggcagcaaccaactcagaaccgaggtgtcctggacgtgccatgccaancgggccggggcaaggcggggggttggggnggcctgggagaaaacccngggaatttgcgcacccgtaggcaaaggcggttgaa

SEQ ID NO: 103970 - DNA, 1267 bp, Triticum aestivum
  unsure (1)..(1267): unsure at all n locations
  Clone ID: PAT_TA_103970
ttatagtatgtatatgtccactagatcaagtatcttatttaatttgatctgaaaagacagagaattggagagtaaccaaatatcnntcaatcnagatgactttccagcacaaacaatgatcaacannagtgtgtnctcaatagaccaatgaccactaattcaacataggtcccgtgttggtccaggtgcaatccaaaatcgncaacntgtatatctcataacgccatattgatattcccaatcgagtatatggatatcgcttctcattagaatgaatcgtgatatagtctgccatcacangaaaatcacgagacagcgccatggtctcantctggagtggtcccatcaattattaactatccataaactatacgagggcacgtgngcagtactagcaatagtgcagtnatctctactcgctggagcggaagcccgtctgtttctctagtcgcctgtggtatgtggctcggacctcctacagtatcccagttcctcangagcatggtgtatgggggntgggtgtcccagtcaagcgtcacctacgcgaggacgtgcgtgtccagtggtatcggcctaggggaagangggggtgtnaatagtctatctaagttaggagtgatgatggtccagcccaattcacgtgcaatgcagaagtgaggtaanacgngtgtcccccgtgaccggtnctcgtgatctncctctgtgttcacaatagcgatgnaaatgtacgcctctcaggggaatggctcttgggactgtgctcggagtgtnatcacgacganccagggggttgcgggccttnggnccatcggggacagctgcatttgaacacgggccccaccgaacnngcgaggtgggcngtnaggtggggtgggagtttgccccnggggatggtgctgaagcccaggttgtccacaaggcgcgtnaacanacacctgcggccgggttggnactgacaagtgggtcacccngagaccaacgcgccgtngggtgcctgcctncgggggagccagtgcggagaagaggacacctgcacaggccccgatgggggagggagaagaatgtcacccgggcctaaaaagnnacccgatgtcagaggcccggccgaggngagggcgacccggnagacaccnaaaagaggggcccggggaccccgaaaggggcancgagacacaccgcngaaagagcctggggggagncgccccngcatcggctaccagagagcaggcagcaccagaccaagagtgatcgcaagggcagcagcaac

SEQ ID NO: 103971 - DNA, 651 bp, Triticum aestivum
  Clone ID: PAT_TA_103971
ttttggacttaaaaataaattcataattttggcccgtgaaaggcaagccggtgcttgcgcactgcatgtccaacccccgcagcactgtacctgtgcacccatgggactacaaccaaaaaatgaaatacgcaaaaatgtcagttgtgagcaaaacacacagaaatcaaacatcttcgcggactgcacacacatggtcgccgcactgcacgctgttgctgcctggagtgcacactgctgctgctccctgtagtgcacgccattggtgcctgcagtgcatgctgctgctgcctgcagtgcatgccaccgttgcctgcagtgcacgctgctgttgcctgcagtgcacgccgggaaaggtaggtggaagaggggtcaccaccctctgtcggatcttctgtcgctgctctgcaaaaacaaagagaactgcacatgcacgaactgggagccgatgaacaatagcgaacttcacatgcatgaagaaagaacttggagccacggatcagcgagcaggtgggcgaggcaaggcatggccgcaatggatcatgtcgttggaggttggatccggccgcggcaccggcaggaggtcgtcggatgtagccgacgcacctcttttttgcagcagagaaggtagaatacggggcggatctaatagga

SEQ ID NO: 103972 - DNA, 1234 bp, Triticum aestivum
  unsure (1)..(1234): unsure at all n locations
  Clone ID: PAT_TA_103972
tttccaaatggagacaatgattccctttnattgtgtatccatgagtctagtatgcgcataagctanccacacgatcgattgcatgcggcgccgagtagctcagtccgtatnttgcactatnattgcactgtcacatagtagtaatgggtcgcnacgatggctatatgnaatgtcgctgacgcagatgatgcacattgntgtacgtaggctcgatcttgtatgtagctccgtctcatgtatgtcgtagggcacatagcgcgcaaaaatgtgttgctaacatacgtgtcnatcaaagtgtagcacatgatataccncgaggggtatgaanggacgttactctcatcaccgacatgggtctcaatcttgtgacccttccctagcggccattccgggggacgtgttccatgganggccggctctgactcccggagcgccagcacttttcccgcgtcctccccattgcatacgctcagcctgccagtccgtccctgtgcctattccgtgctacctcgagttgcccgcgtanatcgtccttttgccacacgtctgccncccacagacaactggcatgcttggagcgaagggttcacgggttgaccccagaggggcagtttgtgccgcatgcggaccataggcttggttagttngcccactatagctacgaatggaagaaggntttgggagtggagatgatcgagagcatnctcatccgatggtggtgcaatctgtactatcgccgatgagcnggtaactggtggcacaacgcagggaaggactaggacggccggccaatagggcagaactgccaggttgggacatgtgggcacggccagataagggcagaggaggggccaganccggtcgggttggacaaaaaacagacccnccaaaagcacaaaggggtccggcngatcaccgnggaangagcacgacaacaacgggaagacagaacgacgttccgacgtggtaaagtcgagngttggacataacganagcgccccacgcgtnagggtgaagtaccaggggccacccacgctgggataccgacccaggggacagtgaggggcgtgacaggcgtgaacacaggaacgtacaggagccctngcngctgctcnccgccntcttccgctccccttctctnancnttccattacaagcagataaaaagaganaaaaaaaaaaaagacaaganacaaaacaaagcacaaacaaaaaaacagcaaaaaaaaaacaa

SEQ ID NO: 103973 - DNA, 434 bp, Triticum aestivum
  unsure (1)..(434): unsure at all n locations
  Clone ID: PAT_TA_103973
tacaaaaaggtctggtgtatacagacggacgacaaccaactcacaaatcagctagcacgacaacgcctaagtacagcgacaaatnccgnacgcacggttcagcatgagcgacccacggnacgacgatgcgngccccccctcgagagccgctggggggganaaaaattntnaaatggcgtcgtaccactcacgccacatagtacaaacgcnagnacnaccgaggcgacacccnacgacaacnaagcgcgaacancacaccaacacgacagaacaccaacagnccccagcaaccggaacaacccagccncccagnccnacaagacaaaccggacanaacaatcanaaagaacaaaaaacacnncacacganacaanacncgcagacncaanaaaagaaangnagaanaaanacaagaaagacaaaagaaaanagcc

SEQ ID NO: 103974 - DNA, 1051 bp, Triticum aestivum
  unsure (1)..(1051): unsure at all n locations
  Clone ID: PAT_TA_103974
aatagcnacaaaatgaagcttcgcatacacttaaagggatacttctattagttgatcgtacanaaggggagacgctccattacatcagactgtgtatcaaagttgggtnggcacggatgcgtcgcaacagtctctacgctatatcacggaaggatattatagtggtctttggagatgatcgtgaaaataccgcggaagaggaagggacatcgtgatggaccatcgagaatcatcttgctggcccggtnagtacggggccactgganttggttgcccaggattgagagagagaacaaacagctngaanatcctcttaccttggcctcctgnagganttgtgtcccccctggatcagattctgtgtggagaatatctctcgcatacctatacaacacattcactacgtgtnggcaacgaggttcttgcgccttgaggtctttttgctacaagggatacttcagtactctaggtctccaatacactctganacactgggtacannagggaaaatatctatacgtcagcgtttccagtacgtcaccggacgtgatcaaccaacaccagaggtanaaaatattnattggcntntgggttgattcacaccaggttgagcncgttgactttctcatgacatttttggaagaagtacggatctcgaaactgggttcaatgtgnatcaggccctnatggttccggtcttccccacttcgatcctgtatatggtagggnaatctctgnnctcanaattctatccggcccaggnagntgcgggcgccattctgnggangggctctcgggacccgccgagaagtgggggatccgcttggtancaaagggcgnttcggaaagccagncagtgcngcgtcgcgggangnggcggaccattgcgttcggcgcatgtgaatctcaatcgaagactgccctggggcaatctngggtcaacatgtcggggcccagagcctataccggtgggtttcccgcccccagagaaaagtgctcatctcncgtaacaaagaaccacacgccantgaacccacccatatgggggggc

SEQ ID NO: 103975 - DNA, 434 bp, Triticum aestivum
  unsure (1)..(434): unsure at all n locations
  Clone ID: PAT_TA_103975
cctttgtgtggatccttttntgtggccccacgacacccatttgaaactgattacaagtgatcacccnnanatgacanataatgaatagctgttggactagcnancagaangttgtgagacacnaaccatactgggctacgantcgcgacctaaactcncatgaactactgttgacnaaancaagncacagtaaattngacacattatnaacatcaaccancngcnaccacaatattatcagcacaccgccacaccgccatcgaccanccactttgacgcnacnaaccaagatatgaacgagncaanggctacgccctacantcccgctggacgncctncggcgctcttggacngacgcttttgaccaancctggnanacgntccgtccacgcgcaacaancacnattggagtacatncntctggntnctgtgng

SEQ ID NO: 103976 - DNA, 434 bp, Triticum aestivum
  unsure (1)..(434): unsure at all n locations
  Clone ID: PAT_TA_103976
ttttgttgtggcccccaccccacaaattctgnaaatggantattatcatantatncnataataatatacatatataatcatnaatataattatatatatataataacttacntaatcatatacntttatactcatcatcatatataaaatactatataatattactattcttctttacatcattcttgatgcttctcgtnttctgatattgattttcatgatatattaattactntatcttcattattattnattatanatgatacttgcttagtcntcatacttcttactcntcatcctcattgcttcttncttctcgctcattngtttggttcgttgttnatgcttgttgtttnanaatanncaaataaggntgntgttgttgntgnncccnccccccacgnggtcggcgccccattttagtagnngatggc

SEQ ID NO: 103977 - DNA, 741 bp, Triticum aestivum
  unsure (1)..(741): unsure at all n locations
  Clone ID: PAT_TA_103977
tttttttttttttaaaacgctcatgagtttatatccggtctccctttacaattttcttaaataatacggngcaaagggagctacaaattcaagcagacaaaacacagtcacgagatttcacctatatgaaagcacattttattggctctgatcgatcaaatataaatctggggctaaagaacatgtcaatcacgcaaaatcccgggggtgctaccgtactcgacaacgtcgtcgaatatctcacctaggctctcgtgcttgaagataaacccttctccaacgagcttctgatacgacatgcacactctcggttccgtagggcatccaacaaatcgttcggcattcacattgtaacgcgggaatttctctgccaggagacgggagatctgcacgacagtggtattgtagctacagcagatgtacctccctcacaaggactcgttcaccgccacgaacacctcggcgcgacagacatcctccacgtggactatcgacatagaaccggtgactaactgacgccttccaggatggccagctgctcctcgtcacctgaaatatgtatgggcactgtgccatgtgtcaccgatcaccagagttataatggttaatagactggccaagtgataacaaaaatagcatatgataagtccatcatatgtggtaacaaccggagtttgtaatctaggtttcggccttttaattggccggtcactcnttttcnacttaatnactgaacgggca

SEQ ID NO: 103978 - DNA, 494 bp, Triticum aestivum
  unsure (1)..(494): unsure at all n locations
  Clone ID: PAT_TA_103978
aacatcaacttttttttagagtaaagttgcaacatgaatgttttctttttgacaacccactcactacacacaacaatcgattttttttaagcacaacacagaaatcaaacaatgaaccctctggtttcagcaaacttaaggcccaggatgtaaattacgcagcccagcccagcacaatcatacgtacgtacaccttccagtaggttggtctctctggaatctggatatgcattgcatccagcctattatcaggcgagaacaaagatggaggtgagcagccccgacacgacgacggcgaagacaaccgccgggtgcctcccttcaccggacaccgcatcggtgtgcttgccgccggcggtcccggcggtggcgttcttgccctcgtgaatcgcgtactgcttgaagatctccgcctccttggagtccggcgagatgtgaagaagcttggggcagctggtgccgaattcctgcagcccgggcnggatccatagttc

SEQ ID NO: 103979 - DNA, 434 bp, Triticum aestivum
  unsure (1)..(434): unsure at all n locations
  Clone ID: PAT_TA_103979
acccnancccatctgttgngggctaggccccctcttttggttggatttctctctttntcgtggggcccccccccaccacatttcngaaanaggnttattanataatatatcaaatctataanactactnctactaatctgtgatcttgtcctactgctatntcntacattataactacataataatgcattgatcgacncgncataattactacaataaacctactgncatatgnaactcataactaatgantacnttctcngctnaatnttcatcatactcatcatacttctgcgtcnattgtcntcattnatatcacccgtgcncacacgtggtgggannanaccgacttcttnaatcattctcccccaccancgtcttgtngtngtgcnaactccacaccacanncttatctnancatcttcatcacnnca

SEQ ID NO: 103980 - DNA, 434 bp, Triticum aestivum
  unsure (1)..(434): unsure at all n locations
  Clone ID: PAT_TA_103980
ataccnaccccaaacccaaccccaaccacccccacccccccaacttcacacnccntccacctcaccacnccaaatcaaananaanctacccccccanaancacccccanctacacctcacncnacncnacacnaaaaccnccacatttncaccaccactttcactcctatcancagtcaatnagtgngatgggaccctgtgctggctcatttttcattgccacccacccccctctgcaagnctaannagtacccctgcantcctgtanttgttnnaaaacccatgcacacccactgcncacccacatggcttgcacnttgcttgcaataatatacatatctccactncttgcttcatcatnccacagatacanatgtgccatgncatagccacacatggtggtacaacgcncggntgacttcaccactacaacc

SEQ ID NO: 103981 - DNA, 434 bp, Triticum aestivum
  unsure (1)..(434): unsure at all n locations
  Clone ID: PAT_TA_103981
tgtgtggtccnttttgnggcccccgcctcgacaggattataaatagaccctattactnnattataanacattaccactgtggcatacanacaatcccataatgcatataaaataggtacgcacattgtggacacttgcacacaactgcttgattgtggcacattgcacgctcacnnttgtcctacctgatgtacgcactggctgtgttttgaccttgctggcccacactggatatatatactacttaccaccgttctantcccttgacccaactggactgtgctgtgnctgactgctttgtgtgataccacattgtggtacggtcacanacactgacgctatcacaactgacatacccactactgtgcttgttggctgtgactggccccaccgtgtgacctgtgtgtgnctggttgtgtgtgttgtgtgtggtg

SEQ ID NO: 103982 - DNA, 768 bp, Triticum aestivum
  unsure (1)..(768): unsure at all n locations
  Clone ID: PAT_TA_103982
ggaaaagaaagtgcacacacaaaatagtacttatatggaatgcaagcaaatgaactgcaagattcagcgacagggccaagcgctcaagcaagttcatttctcttcctgccagttctaatcttgcctacggagatcaaacgacagacggcagttaacagctgagaagattaaccccaagtntactgttagctagggcatgttaattgctacaagttcgcatcacatttaccaggggcctgatatatacaaggttaattcctacaagttcacatcaaaggccccatgcgcagcatacagaatggaagaaccgacatcaaatagtctatttctgcatcccagacaacgagaaatgtaactctgggtacctgctgagtcaatacatcaagatagcatgcctatcccaacaaatcacattatgcccgcgtctgcagtatagacagcttcaaantggataatagtgaaaccagcggtaaaagcggtaggattcgagaagtttcttagactgcaatgattcaaaanggactttgaagacaccgataaatgtccacagtaacaccacatgtgtcctcagaaacccagagtatcctgggctctgaagcctcctctggattcagggaacagagctggctaagtgcanaggtcctcccagaacggttgcggaatcggagccggggaccacnnagtcaaaggggcgcacggggancccacataggcctcaagngggcaccacngggaccaggcanncgcgggaaggagcccgcaaccaaa

SEQ ID NO: 103983 - DNA, 1197 bp, Triticum aestivum
  unsure (1)..(1197): unsure at all n locations
  Clone ID: PAT_TA_103983
ttaatttttttgacccttaaactgtaaaacgtaatgaatatgaactgtgcatgctaatgttattgtgtatgtacacaacatgcctgaacctgaatacctgatgcaaactgccaatattgacacacgcctacagcgaaccgttganactgacacacaccctgtgagtacatacttgccctgggcgcttacaagccctgacgctgtgatgcgtacactggagtanattgcgtaaagcgttggcacacacnacaacactgtggtttcattacattacnccccgttcggtgaattcattacagcgtatacagcccgccacccgtatgttagaaacanggagtattctntgtgacgccagtggtatnatgctggtggcgccntcggaacaaccaggcattnaaccactggtggaacgacccttacccaccatttttgttggtgtggcaacgctaggagttacccnccctgttaagtttgtcgtggcaacctggagngttattctctaacgatggggaccacatgttctggagttaccaacagacaatagctagtgtgtagcaccccacgattaactngggcaaatcgttnccacctcnccaaacgtacgggcgatgcattcatggaaaaaacagccaaacacatnattngttaggactaccctgagcattaacactatggatgggaacgttggaacatgaggctccccttcacgtattggtaacagcaacgcatcggcaacacacaacactaggtgatnttcaagcaggcgtnggttngggtntgggacttctagcgactgagnaatacgantcanccacttaatatgtggagacccacncactgtggaagcgctagcncgaccccttatcatcacccagttaccacccnattaatntagggcacaaaccacaccccctgcttattggggngcgtgcccttttacgnggcccaactggctacaaccggagtccaaaaaatgggaccgacatcggcgcaaaacgcaggccnaaaacagctttgggggacttttccaaaccagngcccactcacgaaaacggatangtttccctctcccactactttatggggccgcgcacanacccnacatcttgaggtcagggggcancgactnngggcaccgctccccatctgtgaccaccccaaacactttaatctncgcanccaccacctctaaatttg

SEQ ID NO: 103984 - DNA, 434 bp, Triticum aestivum
  unsure (1)..(434): unsure at all n locations
  Clone ID: PAT_TA_103984
gtttnncccttaganttatcaacnaccaacacctggcatctgcatcactgatctgcatccatcagtggttgcacacntgcancanatgntagaaaaaacanccaatcacacanagcattgcnagctcacagccatgcantgccagcccagcccactgtgtgtgtgctgtgctgcatgagttgtgcanctgcagcacttgctgtctgcatctgctgtctgctctgcttgcactgantgacctgcacacttgtgtgctgtctgaacnattgtgcccctgnaccacangcacatanattcattataatggcnccctggctgtccactgctgaaccccccatactgntngccttgcacatnccgttgcccntgccctgtgtgtgtgcatnccactacaagatanactcaaacatgcatgtgncngcnaccaccctgca

SEQ ID NO: 103985 - DNA, 1047 bp, Triticum aestivum
  unsure (1)..(1047): unsure at all n locations
  Clone ID: PAT_TA_103985
tttttttacttgaaaaatgaggcgcaatgcccttgtgtttatttattgtttgtgtgcatgcatgccttgtgtgtgaatgtgtaggtatgtgcaaacttacatcatcgtacttgctgagccctgagccacaacttatttatgctactccctgctgtacttactgaactacatacaccacacaatgtccagctctcaaactggctgctggtgctccagctcacattcacttgacatgctgaccttgcctgcctcagagctgctgtgctgtgtttgccattctcatgtgaatgtgcctccactgtgttctgatcatgcactgctgtgccgnatgtgtcaccactgtgctgtgctgtgtcccctgctgctcactgcatccatganttgacatctggtgtcctgtgctgactgaaatgccctcgtcacatgacattgatcactttgtgctgctggaaccaccatccttgcacactcccccattgtgactgtgatgccaattgacacctgaaaactggttgatgcatcacttgctgctgtgagtgtttgtccaaaagacttgacacagaattcacaatgtttggtatccatcacactgtggctgaagccaacacacctcatcagtaacaccatcntctgtngctgtatgaatcatcagaaaagcacaaaccaaaccctggcganaacaggtgttnnngacatttggctctgacccaggcttgatgtagncaactgaatgagctggatactcacaaactgaaacccngcngcgattgagccccttgtggagtgtcgtngccaccccaacagaaacctgacccagaacngacctgatgacggaaacacnctgacgcctggctggggaaaccntttcctcnggataaaccctctggcatttggaattcactcttggactccactncactcaccggaaacctcgggaaaagccgggaagactcggcgagtncanggacgattcggcatttggcacgacatgnggcacagncccaacacactctncccatccgaactcaccgcccatggacccanatg

SEQ ID NO: 103986 - DNA, 640 bp, Triticum aestivum
  unsure (1)..(640): unsure at all n locations
  Clone ID: PAT_TA_103986
tttatggcaaagtgaacctcatggctatcgagtgtttcgttttacaaaaaatgcactttcatgtgagcgcaagtgaacaacatcacttttaaaagtaaaccacatcctaggaccaaacacactacaagtgatcatgtagtcgactgaattttgagacacacgaaacaaatgcacttcataaagagtggtaatgggctgctacacaaatggactggactacattttttgtgtctctctgctaacaaatttgttcaagacactgcaagcaccctcaccgggtggactgcacacccagccgcagcacagcgacgacccatgcggactgcagggtngcgcccaaatgaacggctcgtgatgcgcccgaggtgctcacgtcgagcaacggtcgtagatctggcagcagagagagcggccgcacgtgcagcatcgctgcaactgaaccgcattaggagcccaagagtactgcatgatacaagtaaccccacagtgtactgcacgcggagtcgcgatgcactgcaccagcacggaccgtgctgctccagctgcggaggtgggcagagggccggctcaccggtggggggttgaggatcccgcaanaattccttggggggaggcctatctggaatcncggnggagcngt

SEQ ID NO: 103987 - DNA, 434 bp, Triticum aestivum
  unsure (1)..(434): unsure at all n locations
  Clone ID: PAT_TA_103987
aancaaaaacaacanaaaaagactgcaattgntaacntgcaccatcatagtgggctgcacctctggtgtcttttgngcccccccgatcgcatgggctntantctatcccctattgctcctgtgntatnttcaatnagactcaccacagtctcaccacacaatcacgcatgcaccacccactggtgtcanttttgcaatccnacaccttggctcatgtcatcacacaatgtgtcacancntcatcacaccacacccgacacatgtgtgcatctgtggcacacttgcngcacgctatggcaagcgcactgtcacacacattgcacatgcttatgtgcacatgcnccacaacccacccaccacacaccatccacatggcannngccgtgtgcatcccanantgccacacgacatatncacacacacacaccatttaa

SEQ ID NO: 103988 - DNA, 586 bp, Triticum aestivum
  Clone ID: PAT_TA_103988
ttttttttttttttttttttggaaacaacgggaaacggctacctgggctaagaagtggccttggttatacataaggttaactcctatagcatcccggttatctttacatcagactcgaatttctttacgagtacacttccccggttttctcccgggcaaaatggtctagcagggggggtgggacggtctgaacaatctaaatctaggccctatgaagtgtgaacaaatagctaggagtcagaactcaatattttacagaaccgtggttggctttgggtgcttggccgaaaatggcctctatatcaccagcgaacagagaaagcgtggtttcgctaaagcaaaaccgcaatacataccatccacagcagcacttactatgcccccgggcgtagccagcaccttccccgatgggatatagccctgggcagggacgtgctctcgtatgtctcctggtgtcgtgaaattggcaagggggagctcgttctagtctctacaccatgaagtaaggcctcactagaaataaagccgggcatctcttggtcaatcatcattatggatggtggcaaagcttcagttaagtaaggag

SEQ ID NO: 103989 - DNA, 434 bp, Triticum aestivum
  unsure (1)..(434): unsure at all n locations
  Clone ID: PAT_TA_103989
ntgaccttgggggtactttagggancactcccacttcgaaggtttanaaaaagncctatananatnaatagtgtaaaanacatacaagancaaacagtaaangcagacatactatcccatngcacctatctccncatatntnnnngcacaagtccattttgttcaccacacatccaatggttgtttgcgaacaccaccaacattgtggtggttggtctnataaatgaatagcacacanantgtcngttcacacanaacgtagcaaacacaacganatatgtgtaggcattttgcctcanacagaacaccatggtgatcatggttgtttgcaagtctacncanacagcatagcatgnncatggttgcaacatatggggaccggtggactctcnctccctctccctntaactttantncaccngggaccgctcgan

SEQ ID NO: 103990 - DNA, 434 bp, Triticum aestivum
  unsure (1)..(434): unsure at all n locations
  Clone ID: PAT_TA_103990
cagcncancncgcancangccgnngtcccggcnnnacgcttgtccctccantgcnacncaacaactagaggggcagcaccccctaggggtgtactttttnaggcccccgctcgccgctgacaggtntgtntcgtgccctgtatgtcgnctgctcttgtcgngagaagcaccatcacgctaggttcattagcccgcaatcagtcncaggttgtcagttatncgttcatggccacccgcccaggnnccgcaccgcagggagtcntcgacagcanggtcccggtgtngtccacaggttccccgtnagtcatgatcntattcgcacggcgatcgaatctnccaggngtgggcaacgcacagcagcncccaccaccaagccgtgtcaagtcacgcaacgcagggttggacaacaaccnttcgctaccantnaccaatna

SEQ ID NO: 103991 - DNA, 500 bp, Triticum aestivum
  unsure (1)..(500): unsure at all n locations
  Clone ID: PAT_TA_103991
aagcataaaagaaagaaanaaagggcaaacgtggtgtaanagcaccaatcatagtgtggcgaacttgggggtatctgggggcccccccattcgaacggnttatatataatannattagtatatatagattttaatgttatttatatnnntaagtaatagtacatataataaanagananatcntagnatacgactaatcatagtaaataaaaaaggagagngagacgnccangacacaaggngantcancatnctcgacgagggnatggtggcaacacancatcacaacgtcctgtaggggtgatccggcaaatcacnncatgatcatntcatgtcctgatcagagacacccagcatcactcatgtgcggtgtgcaacaacanatcccactctgctcctcagcgtggtctaatccccacagcagctcccccaagggctctccccacatttcactccagctcgtgggacactccgcaccggcgacaacacagggtgcttta

SEQ ID NO: 103992 - DNA, 1088 bp, Triticum aestivum
  unsure (1)..(1088): unsure at all n locations
  Clone ID: PAT_TA_103992
aacaaaaagtagaccgaccggcaatcaatccacatcatatantgttngacaaacataataataataatctgcncangagcntgcgccaccagngcatcagatccacttattgacatgataccantcagcananacntgtgtgcaagtganatagaacccgtnanacgagcatggtgcttantnaagantgatccacatcnnanncagagnagtcacatcgtgtcccatcncatcatanctcncataactccatatcataacttctgtntgtncatcagctctgtcaacacaccagtaacagtcnntgggacagttcctcccantgtgaagtcagccancagcggttgctgcttgactaggtctctccatagatcncatnnccaggtgattcattgcaactgcnacgccantggtncagtcagcctgtccttntcntccatttgttcngtgtnatntnnttattccatgtngccctttgtaccacacatagggtaccgtactaactnccncgctaaagggccggacctctggccctggaataccaattctcttgattantacctggnccggaggatctggggggactacttgccccgaangttcccacatagngacttgtagcgtaaaactgcgaagttaccaatccctcaanngtancngacggactnctctgggctcccctagacaggcgtgaccagnaggccgtacaanccngntgctanctgtacacngctgtagcccgacgctannggacgtnggtnganaaactngagctctgtgcntggctcacctcnttggngtactatgnagctgnngggcggatnnaantgaangngtaactaaagnaaacnaacctacngcactagacgtggtgacgcttggcagactattagcanccgaatagaccntnggaacacaagatggcccccanaatantactntactacnnggcnggcnaatcttnnnctnaggcccaacccttggacnacatncctagnagaagcncatangactaggattcgagcngtnagccanaccctantgnacnnccgntggtatggncaccaaccggttaaaanggganagag

SEQ ID NO: 103993 - DNA, 1282 bp, Triticum aestivum
  unsure (1)..(1282): unsure at all n locations
  Clone ID: PAT_TA_103993
ttntttgtttttttattttttttttttttnttttantttttatttgtnttttattatttgtatttatttttttttttatatggtttttttttttttttttttttttttnggctcacacaacggttctccccgcgangttttaaacaacaggtgtgacatanacttccccgtgactccgnggcaatcccatttgtttgctgtggatacctcatanagtgacacaataacacggtacttgttgactacacaacgctatatacctggaggctgtactatngcacaactatcacatacacacaagcgctgatacaacttgttgttgtgttgcttctactagacgatacggacactctactaccagttaggccaggccacagtgtgacccacaatacttctcatactctactctgctagcaggctgtgnacgctggcgcatagtcgcatntcgcatattttaccatctcgtgggggctctgtgngtagtggtgggaccatacagtatagatttcttgtccccatctcgcttctcaaactatacctccccatcaangcatctcgttgaggagagngacccgccaataagagcctcgcatcaaggggggtgtgttggcccaagccgggtgacacatgtggttttganaacgagatntgtgacgcctcngtgaaatcacaangagtcngtngacnagacagaggtgagtcggccgnagtaagcacagacgataacagattttcaatcatgcccaaaattcccattagggtgaccagattaataacataaacacgccttgtgtctccaagntgtaactttttccaanaatctctccccatttaagagtgttnttggaagggtgaatcaatnattcgacccggtttattgaacgaagacccattgggtttgctaggggtaccccaagccctgttggggaaagctcagggacatgtgcnttaacaacgaacggctatgtggangggccagaaagcccacangtttccagctgttcccgtttaaaatttcaaaaanccaaagaggtgtcgaacaaatagggatcatggtgtacaatgttaaacagtaagtactanngtctgtggttattntcctgtgtccgttttccgttcgnnttgctnngtttttttngtangattgaaaataaatgaacaaaaagagagagagaagaaaagagagacaacaatgacgagcagacgaaagtgaaaaagaagaaaagaagacaanacgaacagaaaaagaaaaaaaaagagaanaaaaaaataagagagaaga

SEQ ID NO: 103994 - DNA, 1093 bp, Triticum aestivum
  unsure (1)..(1093): unsure at all n locations
  Clone ID: PAT_TA_103994
tttgagaacttccaaaccaacacaatctacatatatgtgtatgaccagaacctggggttggctntttaattccccaggtttggaacnatagtattatagttcacaggttcctacactgtaatatagtggactgtgtctcctttaattttttcacacggctatccanggaacccaaaaccccaagggacctataggaaaaaacggggtggtattctaaatanatatatctctatcactatactataagagttccttcctctcttcctctcgagttagagtatcaccngaagagaaatgtgcccaaaaatggggagacccacatggggtgtggcaataaatgtgagagggnctattatcaccacattggggcaccatatggcagaggtctgacggggtctctgtgtatgacgcgctagaggttcccccttcactatgggccctctcaaacactgggggggggcagagttgagtatgtcagagcgctgtggacacagacgagacgccccctgtgggggccctgtgtgagggtatatatgacgactgtganacacagtggttgggggacagacaagaggcccctggtggcccctgtgaatagttgggaatanataatgagtgtgtggcttgtcgagcagggctgtgtctggggacaagaggggagaagaccactttggggggctctcaacaggggttgggttgtgttgtagtactgaggtactgaggtatggtatgagtattgagttgagttgaggtgtagggttgtgggtgngagtgtgtatggtatgggaactagttggccggaaactactaacatntacagccctatttgaaaaccaccacaccactacttggggngggcgctactgcgggctctggggaggcaccaccgcgcgcgaaaatcggaggatcgcgaggggggatatctccgggccccccaacagcgtctggggttcggagaacccacacccccacaaacttggtggttggggcccacccccagaagctctgggtggtaacacggattatanctctttttctctgggcccaaaaaactcttggttgnggaagctctttcccccnctaggtggacgcg

SEQ ID NO: 103995 - DNA, 1415 bp, Triticum aestivum
  unsure (1)..(1415): unsure at all n locations
  Clone ID: PAT_TA_103995
acccccatcgcagtaaatnanaccntagatatatttaactngtgtaacaaccatccagtccagaagcttccacatgcatcaagntttgtccatccatcaaaaaccatataggtatcngtgcaagccccacanntgcactcagtgntatnatagtntcccacatacacatccatttgttgcacacanacctccagtggattgcncacattcccatcctcacaagttgtgtccaatttccgcattttcccnatcccggtgtgtcgtgggcacgccgtgcaacgcggtatcggnagcgatancagcgncaccacagnttggcacnaccnccgcatggacacacgcatggcacaatatgccgccgcncacnaatatgggcnaatttgtcccccgccncaanaacaacatggtggcatctcaatttggcacaatgttgncacaattgtggctacacacagngcttggcactntggcctnggcaacacacaggtacactggccacttgncaatngacacagtnccgagtatacctggtggcatncatgacaaccacaatntgtggtggtccaacgatggccgcaatacgactatgggtgcccaaggatgcncctngtgtggcagacaacgtttccccacnaacacgtagcgncaaccaatggcgntactgatacctgctcttncccatggcagcacacccatggaatgngttgggacaaagnaaatggnagtttnnaaccagacaaccatgactncccttgggaccacccagatttccatggagatgggagatcnatgcaaaccatcgttgggcagcacctaccaaagttccgccgagttgattagatacccttgtttggntgggcacaaccagtgttgnctgtttggcgnacccaatatggattgggagtgtaatgtattgggccacccagttgggttggtagtggctacttcccccncgcgnttcactcnccccccgatatgggatggggnccaaccgaacctacaacaatcaagccaactagggcctgcattccgtccaaaatggggacaacctnntttggttgcaatctagtccgaccagcttgctgtagtacccagcacctccaaagttttcttgcccaaacctttttggcctagcacttttttggtttgggtagggnccaccaaaaatcaggcagtttccagcnaaagtttgtnnggcccgaaacttcggncccctctcaaattacgggttcggctcttncccagccgaaagactctaatagattggntgttagcaaaaacatgagagcgttccctaacccgnatntgnctttttggcaaagcttgtgccccagcccccaggtagcaacnagaaccaaatattccccaccaatattncccgcccgacatatggatngggactgtttggaggcctc

SEQ ID NO: 103996 - DNA, 771 bp, Triticum aestivum
  unsure (1)..(771): unsure at all n locations
  Clone ID: PAT_TA_103996
ttttttttttttttntttttttttttttttttgttttttttttttttttttttttttttttttttattaagacagatcgagtgattaaattattaaacgaaacaaaaatatccatagcaangtcacataggcataatttggtacactagagcgcagtaaagccaaggctcaagctgagccaangcgctcacaaaaacatagcatgcataactacacctgatttcttctatacctggcgtgcaaagggtggaagcnacgtcnngtcggatacatctcatctcagtgcccagcgggggatagcatcctcaagtgatcaaccgtgagccttcggctcaacacatcaagctcatcaatcctcgtggcgccctccatcgccgtggcgagttcgctttccgtgggcatntgccaccgggaggactattccaatcggccttggccgactctcaaacactcctcaaatacnngccagcacggcgctgtgccatgcgatgctcgctgctacgcggcagcaatacattgcagttaccgttctgaccggtacctccatggttcatagcatttgggggataacctccatgcgttgaccagcatttgggggagctagcagatcgtgngccaacaaatccatgtgtcaccgacatcggtgagaacagcatagtctcaanctggtccaggcgcaacccgtccaggtaatccatcaaggttgccgcggcaacaaagggggacctcgcaaaacacggggggncgccctggcaaaacattcacatcccg

SEQ ID NO: 103997 - DNA, 620 bp, Triticum aestivum
  unsure (1)..(620): unsure at all n locations
  Clone ID: PAT_TA_103997
tttnattttttttttgatgcaaaatcgtgtgtagtacatgtgcatacgcaggcgtgtcatgtgcaaatcatgcagcagctgtcatctactccctccgttcggaattagatgtcgcgacggtgtacattatgcatttggnaaacatgtccttatactttngaatcatttgaaaaaacgcccccgtctccttcctcactactccaccgtcgctcacgcgtcgccggctccggccactatcccccggtcttcctcccccggttctcctcagcacccagagagagtctccggcgcgtcgcaggacccaggacccagccgccgtggtgcaggagacgacctgcgtcgtcgcggaggagacgcgcaggaccttcacggaggcgccttgcgccgccgcccagctgcgtagccgccatgggtgtgccctcgcctacctgagcagcgggatngctcctaaagttcttcctcttcgtcacctccctctgaatcgtgccaagaagcagtaaatcgacgactaggtcctcgattgtggtccgcctgtggccgccgtcgccgcggacaatttgggacgccgtcgctggtgccgaattcctggcaagccgggggatccactagttctanagcgg

SEQ ID NO: 103998 - DNA, 1302 bp, Triticum aestivum
  unsure (1)..(1302): unsure at all n locations
  Clone ID: PAT_TA_103998
ttttttttttttttttttttttttttttttattttttttttatatttgttttttttgatatttnattatnatttttttatttatttgttttatanaccacacggggacaagagggggtctacaagagaagccagaagagagaccaaatatatcatagtcggccccaacancccccaaantcaggaagacacgcgcacatagaaatatgagtgtgaggagaaaagaaaaccaatgagagaatctttccttacaactattgtnatcttcnccaatgtatggggggtatcctantattcacctcaccaccccccgatatgtaacaaatcgatgtctccatccttccaatgggttcaacgagacgtatcaaggggtatatgctcatctctacaagacacncggncaagcccataacccacatcnctctacatgtagacatacacaacngggtttgcgagcataacatagagacttcatactttctgngagcaaacagccacaagccacacanacagagantacatacccacagggtcagncagcacgtcgttgggggatctaatacactccccggtccaggaggccgtctacagaagcccactaatactcttggggtcctagattagggcgagatacgagcggtggaaggtcattgcgtctataagttcacgccangacagangtgttatacacctcccatgtgcatgaggacagtgctgtatcacaccgtggtaangtactaccctccaaaggttgtggatatataccgggaggcgaacatgtggtgcccccaacagtgggttncaggcacaaggggattcacataaaccaccttcccacagatttganaatcaccacgggtttcgcatgtgggnaccaacggtcaaaacggcatgtgttcaccccagtaatactctcaagaagggccttcnaaaaaccaagtgggganagagggcgcttttttcaacaatttggnggcccttggnagcaagggaggnttaaatcccacagaagganngtcccaccaaatngttcgttgattcaaaggggggaacaacaatnccagtggggaaagggtgtccgggccaaaaaaatgcatgtctcggttgctncanctattgngttaggacgatcccaccatggccggctcacccagaggttaggaaccacttctaganttgaatccgcatgggaccggtttgccttcccgtcgtgtnctcggntccgtcgccggngcgggntcaacacaaaaacacacaagcatacaaacaaaaaacacaacacacagcacaacacaaaaaacac

SEQ ID NO: 103999 - DNA, 418 bp, Triticum aestivum
  unsure (1)..(418): unsure at all n locations
  Clone ID: PAT_TA_103999
tnnaaatttnaactaaaaaaatgcatgaatgatagattgtgtagtgtaaaaacacatttacttacacagtggcctacacgtctcactggtacactttgtgccatagantgtcattaccacatcacactagggtgngaattgtgacatcaactggtacacacactttgtgacaacatgtgtagtgttgtgacagancctctgttgacgngatgggacaccatantttgattgacttccctcccactttgtcataacattagacatcaacatcctcacatcagcattagccgcantggtgacctcttctgatgtctacacacttccaccaccaacatacacactacagcaacacacaccctctacagcactgctntggtngtgctggtggttatcnnctnacgccgcccctancccacct

SEQ ID NO: 104000 - DNA, 1193 bp, Triticum aestivum
  unsure (1)..(1193): unsure at all n locations
  Clone ID: PAT_TA_104000
tttatttctcaattgccacttgtcgatgaatttgatctagatgtacagncactgatgtgatttgttagagtatatctcgnnncgggaaagcagtatcagggcanaaccggggccaataacaaccaacaaccaaactctcgtactccccctcggaaaatactgttgtgtttggaacgtctgcacattgaccaacaacatgtntccccctcctctaccctgatnttggctgactaggcaacgattgactgcatcatgagtcgtcggtcctatcaaagtgactcagtggttggacgaccgagtgtacagacattgacgctctctccggtcggccgaccggtggctcggtaactgtcgccngtggtatggttccttctcgtgtgtctgtgcgtatgagtatgtactcgtgcggancgacagatctctggtctgtagccgttnacttggctgccccatcatacagacgaccgttccttcccctgcctaagtgatgttgacacgacaggtaccantggtgttagtgtgtgtagaccctcgtggnancagctcaacagacatctggctgtgggaaccggtcaagttntgcagtgtagggcagtacataaatattgttggcaaatncaantaaggttactttcttatcagctttgtgacatgtgngttgtgcaaagcgtatgcctngtcgcgcatgtgcattgtgtgttgactcaggcgtttcatcttggcaagtgtcgcggaaaccgagtgtttgcatcatgcaacgtactgattaaagcaaannattgtatatggacagaatttgatataggaaccnccgttcgtgacaatgctgtccatntgcaacacaaccatacgcnttnacagggntccacttggtcgnggcctccccataagggatatggatatctgaantgggtgtcaagtttaggcaatcacagnaactccattaaagagcaatggaagcaagtttgggcagcctatgacatgttcactacagnaaaattttcgaagtcatggntttaaaatgggagaaaatggatgcctggataatttttatatagcaaagtttgggatnggcgtatggtngatacgatgaccatactggaatagatcatgggtatgagacactaaanacanangngnttagnggaacnggcggagaatcaaatgagctggttgagaatataggagtgnag

SEQ ID NO: 104001 - DNA, 699 bp, Triticum aestivum
  unsure (1)..(699): unsure at all n locations
  Clone ID: PAT_TA_104001
gatcaaccagatagcatgcatataaccaaggtgcataacaggttcaaagatacaagggtcttacaacacaacaggttgtaaaacaaacaccacaaagcaaagattcaaacagacagataacagataaagccactcgggcagatcatgggatagcagacagcacgccttgggaaagcaccaggaggcaggctctagtactcgtcgccctcgatcaccgtcctcaccctcgtcgaactcagcaccaacttcttcatagtccttctccagggcagcaagatcctcactggtgcctcagatgaactctaccctcctccatgccctcacccacgtaccagtgtgacgaagtgcactgcttggcgtacatgatgtgtcaaacttgtggtcaatgctgntgatgaagacctcgangacactggtggagtttggagatcatgcacacagccctctggaccttggcaatggtcacctgcctggtgacaacacctggtggctggtagttgataccacacttgaagccagtgtggtgcacccagtcaaccaaactggatagtgcgcttgtgtcttgatgtgtggccacatgctagcgttgacatccttgggaacaaatcacactggtacatgagacatggatggccattgtacttgccngtggacgngtgngtccccactctgggccatcattcgatgaacgggtcaaag

SEQ ID NO: 104002 - DNA, 737 bp, Triticum aestivum
  unsure (1)..(737): unsure at all n locations
  Clone ID: PAT_TA_104002
caccaaccacccttctcccgccgccgccccgcgaagcaaatgcagtgagtgatgcatgtgatgcctggctgtgtgccactgtgtcttgctgtgtctgctgtgactgctgctgacctgttctgctgctgccctggttcctgtgaatgaatgtggttacatccctggctcacccacccataccctgctgcacctacaatgtgtctgtgctgatgtactgtctgaatgtcaacatgtgtgaactgtgcatgcctgatgcaacnacatgtggtgattacattgcccctggcanaacaagtggttacacttaaccccaactgtgacacctgccacctcctggtggaaacncnggcctgttgagttgtgaaacatggattcanaaagacacccataattggcagtgccctgacccaaacttccctgatgacctggattcaccggnaangtgaccacttccgacaacagaccaaacaacnttgggagcccaacatggatggacgtttacgtatgatgacggaaacaagaaccacgcgccagaggaagcaacgacttattaacacnattccaagacgtcggatggtataaccagcagacacanagactnggtggaacatgttaccngaccagaaagagttatggatgtttatccacccgtcgagcttaggacatttatctgatggaaanatatgggaccaatagctttggtgacgtttaggcggcccaacatgtggncgccngcc

SEQ ID NO: 104003 - DNA, 437 bp, Triticum aestivum
  unsure (1)..(437): unsure at all n locations
  Clone ID: PAT_TA_104003
tttccctattanattttttaaatttttgtgtatntttatgtgttgttttattgtatattnntttgttgtttattgtatctcttctttgcttttttctttatgtttgtagtgtgtgtggntgtacacccaanacacacctcctatacgacgcacgtgggggcacacacacacacactnnttacacacacacgnggtgtacactcacacgggtgatacaaacnactatangccacacatataaangagctcaacnncaccacgggcngcacacactactctgctcttcttcnncacaaccacacacaacagngacacagaccaccgtgnggtgttatcngacaacacctgtggagnacctgtgttgaggggtgtccactagcgactctactgggtgtntctttttttgtgggtcaccccgcgaggcctaccaactattt

SEQ ID NO: 104004 - DNA, 433 bp, Triticum aestivum
  unsure (1)..(433): unsure at all n locations
  Clone ID: PAT_TA_104004
acccanaaaaaataangntanacaacatggctgttgtgtccnaatcnccactacttgacaaacaaatcnaaaaatccatataaacaaatagaagtaattgctangtctgcaccgtctgcagacnctgtatancattgcntgagtatccacntgtantgagcaccgataccactctcccangcacaccacacanaggcactgcacatgtttttgcagnaccncacaatatnctgtgcttttcacaccttgcaccagcaaattgtcncancgtcaaantacgcacctgcccctttccaggtctccaccacacgattggcccactggcgtncnnttacntcccccaaggacagcatctcnagnatcntggctccacctacgcanagacacatgggncctggtctgtggccntctgataatgtgcacatctgaantg

SEQ ID NO: 104005 - DNA, 601 bp, Triticum aestivum
  unsure (1)..(601): unsure at all n locations
  Clone ID: PAT_TA_104005
ttttttttttttccagaacaactatctgagcatagcatagctgggaaatttcactaatatagaaaactgngagctacaaatttagatgaagcaaggaaaagaaatacatgaaacatacagggacaagctcggctatagtttcagaattgagcccagcatcaaccagctcttcctcgagtgtcctgcaagtgactccatacatgctcgaccatttgagcatctgttaccagcagcaaatcataggtgcacttggaagaacaaaaatgtagttgggaatcatagtggcaaagctcaatagtgccttgattcagaacattgatgtttattttccctttctgcacaaagtatgagcctggtccctctcgctgctgctgccagggatctgcaactctggggagaggggcgcagctggttccatctaaaaattctgaagatctcgaacgtaacctcctgcaggtggaacgccgaacgagaagggggcaaggctactggatcaaaatctcgacgtcctccgtcatcctctaatcagactactcaactcattttcatagacgtcaacaacacagtgaagtatacggagaaaaggtccgtcgtgcacttg

SEQ ID NO: 104006 - DNA, 583 bp, Triticum aestivum
  unsure (1)..(583): unsure at all n locations
  Clone ID: PAT_TA_104006
tgacaagaacttccgttggtcttttattcccatgtgtggaagctagtataggtcggggttacacattatggtgcacatcacttctattgtatcatgcattgagcattgaacagctcattgagataaacaacgatgagtccatccgtcgtgtgtattacaggtcttcatttcagtnggccatcgagtgctctggtaagactacatcccatgatggtgtcgtctggtatgtggactagtggtatgttgacggttggtgtggttgctgggggaatggttgttggggttgctgggaaatggtntgttctagttgctgggataagttgttgttggggctgcaggaaatggttggttgtggttgcaggatgactcgtggccaatgcctggcngcgccgggggatccactagtgtctagagcggctcgcaggcgcgggggagctcacagcgtatatggtctccgcgttgtagtagagggttgagaatattgggaggcgtatggacgtaagtcgagtggtacgatagcatgtgtcctgggtgaaatngtgatcgcggtcactanattccagagaaaatacggagccggang

SEQ ID NO: 104007 - DNA, 854 bp, Triticum aestivum
  unsure (1)..(854): unsure at all n locations
  Clone ID: PAT_TA_104007
tttttttttttttttttttttttttttttttttttttttttttttttttttttttttccaggttaccagatgcaggcaaagtttattntcaccagcctctgtcaaaccatagagacatgcttgagcgatgttcaacaaattgtacggacaaaactggattcactgaatcctgcaacgacagaaagaaaaaaaaaaactcgagactagttctctctcgtgccgaattcctgcagcccgggggatccactagttctagagcggccgccaccgcggtggagctccagcttttgttccctttantgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagcaggcggngcgntatngggcgctcttccgcttcctcgctcactgactcgctgngcncggcgtncggntgcggcgancggtaatcagtcacncaaagggcgggaatacggtaatccacanngaactccagggggataangcngaacaaacatgttanccaaaggccngaaaaggccngaacgnaaaaaggncggtgcaggcgatnccaaagggcccgccccggnagactatcaaantccgccagncagggggaccccagnaataanaaggtcccnaaaccggcctntcacccgagaaacccccgaggnnaacncaaggagggcca

SEQ ID NO: 104008 - DNA, 1128 bp, Triticum aestivum
  unsure (1)..(1128): unsure at all n locations
  Clone ID: PAT_TA_104008
tntttttttttttttttttttttttttttttttttttttttttttttttttttttttnaaanttaataannacaaaaanngtgtttntattgtgttctcncncaaatacncncagcaaatgtgggaactggatgttccngatgaacatcttgcagtctnctatcngacaanaagctatncaccacacnctnctattgnattcaccangtcacaaataatgttnttttgcccacnactatatntattgggctatatnacactattgtgtaangtncaccacatgttttatattttaatccctccgngggngttattatctctccctgtgtgtgccaccctctcaaaatctcctcacagacaacagccccacgtctngtgtgacaccccncttctgntgntgtgtnagcacacngttggcctnctcancagnagngacagtggcccccacacaattntatattttcnctagtnngacacangacaatnagagacgacaccagaagantaatantctcttcaccacacgagtggtcgcacacacaganngcccccntncaaactccncccnagaacnatccaangngtgntngaantcntataaaaacacttgttgggcanncgntgctccagggacaatcnccatanaatacacaaagtngtgtgagacantgtggggcctccccaananatnataaggagcaatgagccangccngcatanacaaccanaggaggaantccacattctnnccacnnctnngtngggccaatcncncntgggggccntcagngacagtacctcaccccccaannanaggaggccggcccaancngtggacaactccaaacacccgtgtggacggggcnacacagtnggaagccccccccacggggntcataaacngaccancnnnggcccaattanaaccgcnaccanaanncaaaaagcatngggttntgnnggcnaccacaacggtggggnnnaaaaaaagcaaccncngangganccccccacnacccaaaagatcanaannacacncaaatngcgcanaacaaacaccccngggcacagggntcaacaggggaganacaaacccccccacaacacacccggtgntggggngncacc

SEQ ID NO: 104009 - DNA, 1255 bp, Triticum aestivum
  unsure (1)..(1255): unsure at all n locations
  Clone ID: PAT_TA_104009
ttnntattttattttgnacagtacgaccatgacttggtatanacatatatatgaactccaatgtangaanngcagcaactaatcaccatgattcnaaaccgagagtggcatgaanngcaggaatgcaatgcaannagcaanaaatcaaacanagtnnacggatcgncactgtacagtaggcttcctactaacatatcatcantccatgatntgcttggcgagtcaatagtgcgangtgagctgagtgcttgannncgntngnactgangcntganagtacgatcagaactgacccnggncattgaacttggcttgacngaanangatcgcaggctttgagngcgctccngttgtgagtgataagggnncgcgacagatacccccaatnaagagaactcgataacanaagctcacccatagctanacgagcagcaagatngcagttgagagacgacccggaccngctagccctagactgngcccagacnagccccgtctcgattgcaagagnncgcccgctagcgccagcacaaccccacaagccgtcccgcnatngagtactggccccgcgaganaannccccgccaancagctcgcgagcctgcgagatncancctngaacgaaagacagcacgaaaaagctgagcgcccgccngcgacaggannggacgttccagaaccggantcgcctgnnaaaacacgaagtncccnntcgtacncanccgagcnaaaccncgctncgnanggtnangaacanccaacccaanncacaaagagnnggancccctcgcancgaacacacnggnccnggcgcagngagcgagcnggacaaccacggnncccccggccacggncagcccncacaaccaccnnggcaccccctcagaacctnacnngnacccacaganccanncagnnacanccccgagcanagcgatngnnagncanccagnaccgncgnccacggagncccaaggangaggnacacgnnnccagacgannacaccactccacaacacngacagcggnccganccccccaccnnancaacanaccncnaacactnaacngaccnctanttngcnnncccagccncgacgacaaanganaacgagnnacgcccaccancanggngnncacaacnnacccanngccnggananngcgnaancanacnngtgcnnacngacgnngnacnaccaaanatncnacccgnccacacaaccacaaccagagannnccacnacnnacancac

SEQ ID NO: 104010 - DNA, 1255 bp, Triticum aestivum
  unsure (1)..(1255): unsure at all n locations
  Clone ID: PAT_TA_104010
ttnttanttaatttttttatttgattaanatttattnatttaatatntnttattttnatattttnatattttttgnatatagatataattatatattatnttatnataataaaaagaggggagtanaatataaaaaaatnacctncgcggcccacacagtcacannancnngncaaccgagcacacacagacanacacanacccccacagacacacaaangcnngcagcgttgcnggncnaccncncnctcagttaantacactcccctcatcanctntgtcncacncacagagggcacacgagncaaacacacacctaancacacacacacggtgtctacacacaccagngtgtgngtcacaccnacctccccacacacaccagtgcacnccccccgagacaacannntngacaacaccccccacacgngagcaccacacacaacacaggacgantgtganaacnctcttgnggngccacnccagnaagcacagcacacncgcgcagancacacacaatcgngnngttgcgtggacagnacacacacacaccgcacngcaccgctgctcgcgcagnatcgtcaccnncgcngcacacaacgcccnctctatcccaggnccctccacncctcncacgctgngtgtgcggagnaccggcccncccctcannntcgcagcnacgctcctccnncgacttatgaaccacnaagatacttcnnccnccactanccacnttgtctaattgcgcccagacaagactanagtngagcactgatctgntggctgctgtgcccactattcatntgttgcnnttatacccanaaaaaaatttncccttncagcacngatcnaccaacnatgangatncccttctcgncctgtctantacnatcatttcttctcctggaaanacccncgagcaacaagnnacntcttccacacaagaaagtctcccacccccnnananaaatgacccacccccgattaaantgtcgccacgnaaagtcacccgtgtaaaacnaccaanncnccagcgcngngcctgcaagtcgtgtctgaggtntcccngcgtagaccaccacgcatccctgtctggngaaaagcatttgtgaggncnaccgaacccnnnaagtgttgtnggttactgtccgaganagaaccacctggtgtgaannnncgtcacaagcccccataantggtgnccctcggggnttcctcntggnncnncngnaanaaanacannnntngatgcccg

SEQ ID NO: 104011 - DNA, 747 bp, Triticum aestivum
  unsure (1)..(747): unsure at all n locations
  Clone ID: PAT_TA_104011
ccggtaacncgtanacccnccgtgtgtncggtcgntcccactacaccccccncacncnacgtttncacannaacnngtcggtgtnacgtaccacanangtntgttncggttanaccccccnnnncatccaaccnccccccncgctatctcanncgntcaanaccgctngcttagntnaccgntcaaccanntttaaancgcaaaacnnaacagcgcgtggttntnnacaatctngccgtacgattcgatnacnncagtatncggtnggnanagggttntnacgcnntcacccaaccacacnccgcctcgnncgngcgctgncaaacccanttgtgtgaacnatgagncacnnanccgtattaancancgtgtgnaccntcttacncantgntgccanccannagtgtncacactatgaccatcannaccaacaccnnncttttacacccacctnnncaccnctagcgcncnccnactccnccacactnctcntaancctccaccnacncnattncaacnnaaccnnnccannncgnngtctcaccnacccnccgccatntttgtgttagcctccaccnannngcanccataccncnactagancntagacgcntcggcacnncntggngaganacacacggggctggnctcanacacacnactaacttaccacttgncanacnantancaannatnncnctntcaccnaatatggtgctnactgctcatgtggcnatanttagctta

SEQ ID NO: 104012 - DNA, 433 bp, Triticum aestivum
  unsure (1)..(433): unsure at all n locations
  Clone ID: PAT_TA_104012
aagtattatnttgnctanntttgggantgaatgtgtgatatttgtnacttttgaagtnnataaattaantgggccnncgatgggatgcagncnaactatagcgctcatggttgtgccaaggaatcacagngatccacnntnntactcccccggagggagtgccgacggcaaaggactnggcncccnagagnncacctcgtcctcctaatcnntagnntaanaancccanccgaaaagccgctnccccngcngggncnnanagataccancgggnttacgncnccnggtaagnnaanannacnccncaaaccgnantgaaanacgaaggcgagcaggcgtgatacgncaaccctcagcaagggcggnaganaaggnacannggagaatgcnaagccacgaaaaacancnagaaagacagganagataccncgcc

SEQ ID NO: 104013 - DNA, 683 bp, Triticum aestivum
  unsure (1)..(683): unsure at all n locations
  Clone ID: PAT_TA_104013
ttacaacgaaattaatgtgattatgtgattattcgtaacaacgtcaatgagtaccacagcgaaatgtaaggctanggtaaaaattgcttaaaactctgtctaccanaaacaaccacaggcgagctgcaaagtcntgtcatggtaaagtttaattaaatgtgcttgaataatggattgnctactctctgtccccaanctggcagatcttatatgcctgatctatctatctggtactnctggattntgaatatcaaagagatgaatgcccaacgttccatncagtggagcatgccggcgcgccgtactcgcctgatgcanacataatactatcagnggaacacggccggagcataaacatttanacatgggaccaanccggatcgtctacaacgggatattagacatcgcgactggctaagtttcgctaaatacgcancacacacgatggctaaattgtgggatcaccttatagacacaaaggtagaggcaattcgaggtgtntattctgncgatttccnatntcgtttgncacactctcntagagtagatttncgtannccanacaagttgtncanaaattncccganaaagaggagagaccctagtntcacacgttgaccnaaaagaccccttagaaccngtncnataccccnagtcccaanaaatcccccngacncaaaatt

SEQ ID NO: 104014 - DNA, 433 bp, Triticum aestivum
  unsure (1)..(433): unsure at all n locations
  Clone ID: PAT_TA_104014
gacnccaccaatncgntcccacncagcttcaatncgtgtnntacaaccatatcatataaanttntactccaaannnattccnctanntccacaaacttgtcccgcgtcannttnctggttgtacnataaccncnccananntnncnacncncnntanaaacnctggtggtaccanattccagtncacncgctcacnagtnnaccccntnttccccaccaagtnanacctcattcannctaataccaccacaantcgtcgagatattngaccacacacagtcggngcnaaattaaagatcngggngngatccccaannaccacnaaattcaacaatgagacaaatttagatgggnttttangtttgaggttntaaaaaaaaataggncaacaagagtnntanntcaacaatttgttcggngcgaattattatnc

SEQ ID NO: 104015 - DNA, 933 bp, Triticum aestivum
  unsure (1)..(933): unsure at all n locations
  Clone ID: PAT_TA_104015
ttttttttttatntttttttttttttttttttttttttttnttttctctcacacacagtgcaatgtgcgcaacactcccactacagtgctcgncacacacagcttgctcaccccattgntccacgcncagttnagccatttntnnangccacactcccaaacagctccacacgctgtgtgcacannatacnatgtcccactgngcacacangcntcattcgcgcgcnttntcacacacatacacaccactcncacacactacangntgtgcatacgtcgtncactatatcacacgncacacantatactcctgtcgcgtgttggccctctncgcacacacacanatagtgcanaacaagcacacngnngcgtgtgcactctccnacacatttgttgctgcacctagcacacacatatgctctntacanaccaccacanancaacatntatnttgctnntgttgtagcacncccctctnttggcgctctnntctntgttgtgctcacannngctnactatgtnttcnancangacnacgcacaagngtgtgtggcaacaacaccttgttgacgactccnctatgannaacacaaccattgttgacgantcccctttntagaagatgacatatcccccctctntnatccntngtacgaagaaccacagntggtggctctcctcccccctgttgtggtggtttgacnactcnnntgggtggcngacatctccncctcattattcctcagccgcccntctttgccgcaacnnnnaggcacatatttctttactccagnctgaatcaaanagnnggtgtggngggagncaacnttggtggtacnttgtngcaacacanatagcaactactntntccacacaccgttggtcgtcggcnancaaccntagttgttntcnaccacaacctttatntctang

SEQ ID NO: 104016 - DNA, 758 bp, Triticum aestivum
  unsure (1)..(758): unsure at all n locations
  Clone ID: PAT_TA_104016
tttttgactctgctcaaatacattactactgaatataatacacatcgncatatgcgagnaaggaaggcntagcccgaaacgagacccatttctccagtntaccaagattnatgacttgtaattaaagttcaacagancacccaccgttccagaccancganaggacacgccagtaaanccattattgaccattggtgtacgatatgttttaancttgactgactccgggtaagagcaacggaacgcgctcgtgcctccttgcgtccgacacatacactatcctagataacacgcgtacactacccgcgcggctgtgcgtcttcaacaactgtcnngtgnctgcgctgtcgggggcagcccgtcgatnggagtcttgtgtgctgtgtcctgaagcccttcttcggcccttgattgcgtctccatacttgcacatgcgcttgaaatcttnccctggatgcctggtcatcactgtggaatctctcatgntacgacacatattgtgtgcttgatgcctcgnatcgagctgatctccgctctgcaatgactntgttgatgcnaaggtcacatagctgtacagctggctctgtctttgtgcccattgtccttcagttgctctattgtccatcgataacacgtgcttgcattcagagatggaagaccggtagttgtcgccttggtccctcatggatcgagccccgaggatctctcaccgnccaggattacccgggcatgnttccagcctttcaagtntcnaaacc

SEQ ID NO: 104017 - DNA, 492 bp, Triticum aestivum
  unsure (1)..(492): unsure at all n locations
  Clone ID: PAT_TA_104017
tgnngngaggnggnntggntngnntaagnncanntangantanatnttntanctntttgntnttgnatttantcangnntgtagntngtcnnctttcatccgcgnnnntctnncgttgatantacnnnctatanccccnnccgcgccgcntcncnagagnnnangantgnnngggnntgnnncantttcganctgaacttacgtgtantatgtnngattgtgtagctgtngggcgncnanccattcnctctanncgcaacnncgacttccaaccctnnctgatgngngaantngnnanagngnntnnnnntangctcgntctcgtctccgtaanttgtnttncnntttnntttttttnnaatggctgagtgacnaannnnanctnnagntcgnanttnnagacantcnncttgtnntatngtagttcaaganntgtgatngtnntncagnngncttnaccccgnanctaggcnagtttnaagtgtgangtta

SEQ ID NO: 104018 - DNA, 531 bp, Triticum aestivum
  unsure (1)..(531): unsure at all n locations
  Clone ID: PAT_TA_104018
tntnnttnntttttttttattttttntagatgctgctgcaaacaaccaaatataaccntatataactgatactataganaanataaattagtatatatacactagtagtaacnananatagcancattagtatatactagaatatatacccctancnatagtagtaaatagtatagaactaanctagtatatataatatatatatagntataataggtaataatctagtaagtaattaggcatagtaacnnaataatagtaatatnagtagtagcctacctataggtaaaactaacctaggccctaataccncctagtataaggtataaccctantaaggtaataataaggtaataactaaantgtagtaggtaaataacnttagtnaatataaacncccctagtaggtnagtaatataggtaataaataggtaatactaatagtaactatattagtaggaatatagtaaccataaaantntagtaggctagtaggctagtaacttagtaataggntaataatagtagtag

SEQ ID NO: 104019 - DNA, 1636 bp, Triticum aestivum
  unsure (1)..(1636): unsure at all n locations
  Clone ID: PAT_TA_104019
cattgggttcangntcaatcacacacttgcacacacatgcacccctccacacagcacatgtgtcccattgtccnacaccccctcacatngtgcccacacccagcccattgtgcacacccangccccacccacaanacacantcacacacgcacacatgtgtgttgccccacgcacntcacacangtgcactntcacacngcaatctcacacgcactcccacacattgccnaagncnacctgtgtccaccatcacantcncccatngcactacacacnncacccacatctctcatcanacatnccaaatgctgcacacatcacaccncaanacaactccaaacaatgtgcacccccatgtgcccactgttttgtgttgcccangtggttgccncatgncaccanttcccaacaacncagcatcatcnacacntcgncccaactgntctatgncnacacactcaactatccaccanaactgttggtgntgatgttgtgtcaaccaanactggcatacgnggcataccnatnatnctnaacaatncctggctcnctgtnccccatcnccttctangatnccaacnttccaacnttcctacgtgncttgtggnaacaccctttgtggaantnaatggtttntttgataanatttgacatagttgtggccatgatctttcgacaggcccccattatattccnagaacctgaantgtggcntttgtgccacattatacccnttccnttgncattccanctaactggggntccaacggcnctttcctttctggtngnatgcngggttcttttgntanncccccttccatatntggtttnnaacacgttaccctanttggnggcaacctnatngnctggccctatttggcagggctanttntgacnccctttttgatggcccccacnttgnggntttcgggcngnaccttcccccngccacncctgtnngcactttggtgcctnntgcatncttnnaanccacccctttttnncntttggcttacaanagacncnttgcccatanatccnccatgatgattcnattcaacggcgccggntnnaannngacantttgncccccgncttcccnttgggaancttgtntnaanacatnaacacctttgtgcacanancancntcaacngtnttggggcaaancaattacnnctccncgtggtggatatcccncttccatattccntagggtcnntanngnnnnctaaaanccttnnancnttgtctataagcataccaangccacancacaatttgtcccctnccccaataanagcaacgggctncaanctnggncnggngggananaancancaaagnaantcaccgacacgagacaaccntcganccgacntcccnatanactgggaacanaccccnaggcaaacgcccatctncacnccncngccgtcggnnggacaagtgtgtcaggnnccnnacanntcaaaacncccctcaggggaccacccaaancacacnggannnaccaaggcgtcgnccacgancaacacccagcccanaannccnacggcaagaagcccccnncncatggnaacangacccacccggccaaaggagncccaccnaaaangcnggacggagagcnac

SEQ ID NO: 104020 - DNA, 1848 bp, Triticum aestivum
  unsure (1)..(1848): unsure at all n locations
  Clone ID: PAT_TA_104020
tntnntntttttatctttctntntntnttataattntattnnatttcttnatntntattnttatattnattatttatntcacacacacacacacacacacagacnttgtgacacgagagacacacacacacatatcagtgncacacctccacacacagtggngacaccctcacacacacccnagaatatancanntcacaagtgngtcgccgngcncccccaccacacagtgccactcacacagacactctcaatctccacncncacacagtggggntgacacacacacacagtagctcacatcacacacacacccgtgagagngaantatatatccnaccatgncacagntgagagcncagagacacacactccacacacagnaatnnncgtgacagtgagacnncncagngacacacacacacacactacctcacaacagtgnncgtctccncagcaacagcagcgnagaacnancaccacnctgantgnagcagntagaggnagncggnacgtncccnctgcagncgcagcatggnngcaccancagccgcnccccnntnatcctanntncataccacccancagaaccnaancngcccgcctccagccaagnagcaananaganangaaccncttcccccgatnagaaagcacnaccnagcaaaggntnggaagcancaancnacaaggtacgtanccaaccttacaagcaacccancaaccaccngccgnnntggnaagnccaatcccaagcacncccngcatngggtaggacnggnncagcnaacgctaggactagggtaccnnccaaanccaaccaaaccaanggncaagttcaggaaggtaaaccccccccctcanttacngtcccncccacccaaacnaaaccaacccaanncatacaaaccangcnctgcgacaggacacccaaacaacccaananatnccaacacaaacntcccttanatnaccaagngaatgaacaggccccggcatgggacagcncccccgcccagcnccagngnnagnccaanccagacccggtgagaaccannaggccaacacccggatacccncccccccanaccnttnaccnncccaacacttacccggcacccnnncaanggcanaacagtacccangcccaaagcaacccagcncagggtncgggtcagccngggnaacaaanggangggaccgnnanngagtacaggagaagggngagcaangaccgagnaacggtacnacgagctaaccaccagcgntgccggggcgaccacttccaaaatncaccaantccaagccgcggagaaccccgaccccanccccgncccccacnccanaacaanagnacnctaganggncaaagcactaaccnngacccagaaanagaacacccaacngcnccacggagaacatggatacaaaaacaatcnacccaangacntaanaccaancgacccntgacgatggagaaatagggggancnnngcngcagcgcgccacccaaaccccgaccccccgaccacaagcnaacagacnccannnccaccanacaanncnncaatannnannncagaccccnacgctctgtcccntggngaagganncgncanccacacaaacccanaatacnctannacaagacnacgggggagtcggtcncccnagaancaatccanngaagcanantccacccgaccgangagcaccccgnagnannatannaangcaccccgacacaccaagggaatancncnangcanctaacncccagtgnncncgcacntngncnacgnccnacgatangatggggnacacanacaacccaanaggntgtnagcg

SEQ ID NO: 104021 - DNA, 1331 bp, Triticum aestivum
  unsure (1)..(1331): unsure at all n locations
  Clone ID: PAT_TA_104021
ncaaanaacanaataatgcattcccctcacnccaacancaagatgcgaatganntcagtcatnttctaacaactagaatnaattgaatcgcctgnatataaantttcctctgtgtcanataggtgtcangccctagttggtacatanagngctgttcgtcnctccgatgntcaactgaaattcatcttgacccaancgtacatgctgtacttttgcccaaggctaggactcgccacgccaatgctacagtggttttgccgacanncaccttagncanagannntactcatcgaatcgaggcgtccagattgcatncgaggtcgcgatccaatcgacgacgtcgcgacaatttcgccactcgggtactagtnggccatggcaaaatgcaaaccacaactagatccgcacgtgactgctagccaggaatccncttcgacggcccctacntatatctnccaagnnntctgccncntagnnggtttcgttgggggtngatctatacgccaaaacctcgaacccaaagctaggcttcgganatgttgtggcaagngngtgtatctnagtngntcccatgncgtggtcattnnggagataataggtcttngccaaactcaantgtnttgctacacgattgtcnatngtncnccgacctgttgnaccttgcatcccaaaccgagtccngatggattggcacaggtattgnctcannntnngtannancggcatgtctcntatgtangngtgnggtctcanagtgaaatacagacaatttcaaanggaagnttaatgttgcataaaaaatattgtattgaactagaaaatctaactcgaatgttgnnngttatgctatctttgtnagcccngaagttggnttgaataaataccgaattntgaaacgaaacttaaangggntgncngtggcaancatttctaatgtgttgaaccgccccgaaacgantgtggcgcttagtccaaagcnttgngggaaattcaccacatngacccacanctaaagangnttcctaggtgngggcnaaggngacnngagnacacaccaacatggacaaacccgnanaaancacagtnnnctcacaaccntcgancacancccccgngaatgaccgaaaatcccnggnagccggggggcnncccacccanatanatgaaaanagggnccggcacaccgacagatgannaanacaacatagggcaccccatcananggagggngtacacaccgaaccgtggncacacgggcaacccngcgtccggcngaananttntaccgncacaccccanganaaancacgngacanaanngaaccnggnnc

SEQ ID NO: 104022 - DNA, 436 bp, Triticum aestivum
  unsure (1)..(436): unsure at all n locations
  Clone ID: PAT_TA_104022
tctgntgttttnntnngtnngttggnngnngcttgtttntnntattgntanccnttcaatantttnnnngnnnnnctgtnncgntnnangtnaggctntangntnngnntttgncntnnnctnncngncttcnancnnnntnatgngntttgngnnntntgngaagaaaaccannnacgaancaananaananaananannnaggaangnacacnnaagacganctcagaannacaaaatgggananntcanaanctgtganttanacnttgtgccgtgnttgtgnggntntaacccttgtnatggancttttaatgtggancaatanaannnatcaatnggacgagaacanacanagtgacgtcanntnnnangaacaantnnaaaaacnacgatggtngtggaanancaacaangnagaacaagaaantgggag

SEQ ID NO: 104023 - DNA, 1235 bp, Triticum aestivum
  unsure (1)..(1235): unsure at all n locations
  Clone ID: PAT_TA_104023
gaaaaaaatatatattntgtggtagttatagtgtncaaaaatatgtanntactgtttgtganggttnnataatanatgtgtntgtgtagacaaatgtgaatanagtggancnttatatctgantactatcnatgaanataaaatattgagtagatgtctcaactctgaaccttacttagtcacttagtaacgtaaaaattgcgtctctttacatttcantccaaagatcaagtcggcaccacaataccttcctcaaggtttggccctaactcgttgttgagactagctggccagtaagaatgacgttagagctcctgtantgtccttgantanccatatgcgggggaccatctgctttntggagctcgctctganacacccaatacagatgttggaggctaaacgagatcatccgtggaacgtttggcattggtgtgctgatgnttnctatcactancctaacangaatctagtatntataattctaatgaattgttggnattngganntanngatatatatatatgntctgttggctngagatcatantgtgatatgagtgnggtntgtgaagatgcgnnagaatntagcacnncaattagntctcnagtnagattcgantgnaaggngatatttggncnatgtngnancnaagtgaaatatggcaaccttgcttccacttggantgacccctgcaaatagnnatnncgantacacttgagcnngtggatccntttgccactntgtgatagcnctctgatagaagcgatgtagtacccanagacgttcttgtgggggccacttaaanntatggtttatggntagcgnttggtaggcaatnngcgtantggctagataatgatccttgagaaacaaaanatcnccaccgtttggngganttgccctttnncctggnctaatttgaacgggagaattgaactccttcaccanntcancgaaaatgantngngttgtcnttattctaggnccttgcnnacaaacttggtggaaatnttggatttgtnccaaagngagatcnaaagacgtcgaattngaanatttgtgaatgcantggcacacattantgnanacntgnnnnaggggaattgcaanngaatagnggaacnttaattgaacatncatggaaattggccntgaaaannnatttcggttgattccacnaaatcnggngtagggtccncnaaaaagaatttaagcaanaattatgtttaaat

SEQ ID NO: 104024 - DNA, 807 bp, Triticum aestivum
  unsure (1)..(807): unsure at all n locations
  Clone ID: PAT_TA_104024
cgtggaaacctaaatgctttatttattgctaattttttttataagcacatccagcctatgcataactaagatgcacacggccaacagcaacacacaaataaaaaacaccgtgatcgaacaattgctgacacaagctcacacacagtgtcacacacactgcactagtctctcgacacgttcccgtacgtggtgaacgagtcgcacgctctttattcggacgcgcacgcaccgtggttggcgtggacgagacgaagctccgatgtaccatgctcagatggagatgctgttggggatgcccttggcggtgagngccnggcnggcggcgcccttgtgggtcgtggttcatgcccaccaccttgctctcgatctccaccagccgctcgctgaaccgcttgaacacctccagggccttggggtccgaggtccactccggcgtgtcgcgctgccccaggtagagctcgtcagaggagtgtttggacagcacctccaacagcgagatgccgatgatggtctggatctggctggtgatggtgtggatgaaggcccgtccgggtcgcgctccagctccgcgtacgcgtccgtcccgggctccggcatgcggcgcctcgtgccgaatccctgcagccgggggatccactaagttcctagagcggcgnncacgggtggagctccagttttgtnccctttantganggttaattcgaaacntggngntaacatggcaaagnnggnncctgggtgaaattgnntccgccaaantccccaaaaataangagccggaannnnaaannggaanncgggggccaa

SEQ ID NO: 104025 - DNA, 992 bp, Triticum aestivum
  unsure (1)..(992): unsure at all n locations
  Clone ID: PAT_TA_104025
ttttttttttttttttttttttttttttttntttnttttttttttttttntttttttttttttttttnttttttttnttttttttatattntttnccctgcggtgcatctgcntcgtggntcacaanattgtgataatacacaatcataaacacacaaagacaaaaccgatccagccagnaccanagcgccgcatgaaaancaatcggcacaacactacgctacggncatctnnatcaaccttntatccgcaagaccaccangcacaactactagtncacactactgtggtgccaanaaanaatcacgtagtacaggcaacagaaagcataaacccgaacagcgtagcagaaataagntntctcctccacaaagatagctcaccataaactcggtggcgcacatggcccantacancanntcncagataattcacagtggacacaacccagtgccagggactctncagaggatacgtacganagganagcaaganggcgccaaacaccgcgagtcataagagacggangtggtcngccgccagacnncacggagacaaccctgatcgntgccagactactcagcatgggcttggagctagatggntngctnggggtnnagactccaaaaagtgaggngtanggtgcntccagnagggnccgccgnnaanggggctccagccagggacanacacaggcgcgncaagaatcgcnntcagaaggggcagcagccgngagatantgccnnncgcgcacaggcggagnaggagaacggcctcgttgganggcgcaggggttgaaggnccaangggnggaatntgnnaccacantcntngccacaaagggncntccaaaaanggnaggcnacnaccagngngagggggatggaanacncgnggncnngaannnncacgggggaaccncctcctnggggcgggtnaggcccngggcggcccccggcagagcanatnangaggaagcncacnngaaaaag

SEQ ID NO: 104026 - DNA, 434 bp, Triticum aestivum
  unsure (1)..(434): unsure at all n locations
  Clone ID: PAT_TA_104026
cntcctacanatcantcacaacntagggatttcaaaagaaatccgggcaaatgtccaagaacaatngatggcgtaaaggcnacataaacanngcacacgcggaaannaggggcctagnaagaaacaaccagtccaatggnaancnacccaaggnnnaggtgcgntactggccagacangnncagttccccaactacacanctcctagacacaacaccacacnacccanggntgacagancncgcacnnacgtcgcaangtggggaccacgacncaanncagccaccaacactnggcggcaanaacgancagcaaanccgccaaacgnatgcganctgccacnncaaagtgggcanccacaccagccaaacnannaccgganagcccaanantaacntnatancaccccccccatggccccccacagtgggtncc

SEQ ID NO: 104027 - DNA, 568 bp, Triticum aestivum
  unsure (1)..(568): unsure at all n locations
  Clone ID: PAT_TA_104027
aagctcaaacacatntattctcnattgattagatatcgatcagatnaaatcgtgcatcgaatcctagntaaacaaaggnngacaacgacgaagtggacgaggtttgaaaaccacgactggccacggaanaaatncaacagcgaagccngagacgactcagtgccangtcangcacggcggcgcggcgagtctcaaaccnatnngtannaatcnatcnccgagctgngtgnctaagcggtagcgcctgcnctgatggactgacgtcaaatggcatagngacacacacataacnctgtactcatggaaagngactgccaacagagngngnacaaanctcaacgattagtcttactatctatagtagtacgtctcacagaactaagattaagagtggctaacgagtacnntaatanatatatatatttcgaagcttgaggatattgaggatgatacattattgcgagattggattttggtgctgatgtgggaaagagacgggtagtacgcacgacacttgcnnggaggcatgttggcggngttacccatgcttnatgcccagatcccggca

SEQ ID NO: 104028 - DNA, 1262 bp, Triticum aestivum
  unsure (1)..(1262): unsure at all n locations
  Clone ID: PAT_TA_104028
aangctcaacacnattatttnattgatgatactgatcagtaatctgctcgatcctgtaacaaggtgcaatannatggagtgttgaacacatngcangaaaatacaacaacctanacgacatgcataagagcgcgcgcnngaacacgttanacagcncgaggtgtnctannnggtcnccttgtaccgatgcatgatcatgctgcacatacactgtcatctggacaagcgctcgcanacanngngcaggacacgaacanaanactccacaccgatctcagtcgtctcacgtactcgatagntcagtnactntctcaccagaagactnaaacgcaatntnacagagttgggcnntacaccngaagtcccnntnanacctcatcatatantctttcgaaggntatngagtgnatntgtntggaagggaatngtaacctatgatcattgntgaggtgttgggtgttatatngggtnngcntcngnatagtgtgtgganatatgtatgacgnngtanngcacnngcacagacacntnttggntcatgnggggaattgtgtatgcgcttgtgnntgttaacnnncgccatgnnttggattgccncttgnatactcgcttggggcnagananancttatttgcaggacgaccaangnntatatgcnancnggcactgncccctctacccgtggtnctgcagcccctgcggcgattgggcaacagaccccttttgtgcnnggtcannccaaagntggngntgccgtccacatacncgcggncntagtcaagntgcaacnggccacacgccgaaggtgnttagcccngnacggaccttaaccccccggtgctggnggatactggacaattgncaacgggtnggtcngnancgggtcggggcaccgtnccacnngttncanccccgancaaggnacaagccngtccccgggggagctggctagtcttcccgaataagncggcncaggttgccggcagaangcnnatcgggntgacaacacaggggggaccacagttnggncnannnaccgagcccaacngagagtncagcnacgcccacccggatctngcctngggtngggacaaccacggggaagntngggaaccggacgttcaaaaagangacaaagccgcgnagaccacacaatacctggagaggcccgngggngacccnccacacatgncanaanagaggcgggacacccnanncggnaancnnacannngggcccctcaacgcgnagnggnnaacgca

SEQ ID NO: 104029 - DNA, 800 bp, Triticum aestivum
  unsure (1)..(800): unsure at all n locations
  Clone ID: PAT_TA_104029
ctngcacgaggccgaganacattttgctcgacgatntgtttgnnnntaaananaaatcccnnntnanntctagtngtctntctannnnnagctctcnngnggcaactnactcancttcaaactcaagttcnngaacaccaagtccaacntgtcntnanaatctcagacacacagacacanncanaatntncaggtngntgaccagacacacncacacacatgtgatatatacctatacnatatcntctacnnttgctcttcgcacacactgtgtacccttgtgcccacacacncacctngacnttcgacacttgctacattgnngncacncatnctnnnantacntctnntanacctattacaatatcaccccccccttntnncacaatacgcactagcaaccgtcntaccacacccctcacacnacanttgttgtttgacngtccctggtggtacttactgncctntactggactngccacnattcaacacactagaacatccctcntaacnnggnacacatgttgatnaccnccaacaccngcanacgcaacccactggtggatcaaccaggcntgnttgnatgcnccaccngtaactaggtagttgaacnccatggtttattgataacatagntggtggtgntggattcatttagaaccntangaatatggatccttnngatgattttgaccatnttggnnaanctttggtgntagtaggtattgtatgatatgntagggtanatggncaacaacatnaaacntttnntgatntnagttgnntgnaacttntggnat

SEQ ID NO: 104030 - DNA, 1013 bp, Triticum aestivum
  unsure (1)..(1013): unsure at all n locations
  Clone ID: PAT_TA_104030
atcaaangtacgtagtagnttaactgcaaatccaccatgaagaccttactcatcctgacaatccttgctgatgtgcaataaccatctgtgcacctgccaatatccatgngtctgaccccctacgctggccanantgtacaaattgtgctacaaccaaccaacctangtcccccatgctccaaccantgccattaatcccagcaanccaacaancacaancatttccccaacctcaacaaacattcccccantcaaccacaacaancaagttccccagcctcagncaaccacaancaanccatttctccanccccaacaaccattcccccaacaaccacaacaaccattcccccagactcaacaaccacaacaaccatttccccagcaaccacaacaaccatttccccagactcaacaaccccaacaaccatttccccaacaacncancaacaaccattcccccagacgtcanacaagccccaacaaccantttccccaggctccnagcnanccancnaacaacctnnnccccagccccaacaacaattacctgcagccccaacaacctgccaacantcattcccccaacaaccacggtcattcattcaancatctctacaacacacnngnntgaacccatgcangantatcctcttgcaacaattgccancctgngtcataanggatgtcaataccatactggttcaaataatcttggncaaaaagcagattgacaaagtgattgcgngcaaacaatgtgnnaanaaataaanaaagattacctcaaaaaagnccaagangacgcaancnaanncanaaagcgnncaanannancatacccaaaataacncaatgncacaaccacnacncagacaacacaacacacaacacaacngacacnnaagggacnggaaaaacnanncnaccgccancaccaaccagcctnancgcanacctgtnggacnnggggcccancaacnnnncaacggccactcggncccnccacccaaaca

SEQ ID NO: 104031 - DNA, 500 bp, Triticum aestivum
  unsure (1)..(500): unsure at all n locations
  Clone ID: PAT_TA_104031
ccctgctcctgctaaaccctcgcaacaaccccctgtgtgtgctgaccaacccatgcccnatgcctgccccccactcctcaccaaccccctgagcctgtgaagcagangcctgnngaattgtgcctgtgcacctgtgcccaatgctctgcctgctcctgatgtgcctgtgctgtgcctgctgtgtgtgcctgctcccctctgncagcccctcctgctgcctgcctgnnatgacntctgcactatcatgccccacatccatgncctgactgcttcnctgnctgntcnntccacatctgcctgtgcctgcatgcatggangncccctgntacaatttgcntgcattgtgcattcctgccccacatgtggcaatgtgtgcacacctgtgttgcctgtgcttgcacnngncacacgcaagtgcaccacactgccctccncagcaccctcttcattgcacgccanacnccaatcgttgtgcattcaanngtntcccactctgnnnt

SEQ ID NO: 104032 - DNA, 800 bp, Triticum aestivum
  unsure (1)..(800): unsure at all n locations
  Clone ID: PAT_TA_104032
caaccatctacaaaccagcgaaacaaccgaantttccgcnnngcaaccanangcaccaacanaccaaccaacacaccaaccacacaacaaccaaccacacnacacaacaacgaaccaagattcntatncnanaccacaattctttgccacaccaaccacacnttgcattcctattgnagtnggnncattngtttgtcctntgcccacaccanaccacccacaccatacacgcntgccattgcacanaccgcctcccacncacangctntctattgcncanacccanacatgatacacntnnctcacccccangncctcaattttgccccacacacacactcttgcttgcttcttgtccncacaccccacacccttgctcctgcccaagnncaattccccccttgcaccatgcccccnaangngtgcntagacaangnttgcntatgccccccanaccatnngcccccaactcccacccncaacttcnacacnctctggctnttgaccatacccacaatngccanctncactctgccactcttcantntgcccaatcaaanacnnacanccccacaccncaccaccaaacccaacaccccacacgcancacccacaacccaccaccccacaacccnncatnngntctttcccacaacccacacccaacacccacaccncaaccnnacacacaaacccaatgccacaaccatngtggccgcgcaagcaacncaaagaaccacaacaacnctgcaacgcaccccaacaaacngcnacaaccncaacgaaccccnncgaacaac

SEQ ID NO: 104033 - DNA, 800 bp, Triticum aestivum
  unsure (1)..(800): unsure at all n locations
  Clone ID: PAT_TA_104033
gactgtgactngctctcacacncccatactctgttggttgctgaccacacctgtgncacncttgngacacttgnggtcacacgtgcnttgngtntntntggcctgtgnttgaccttgacattggcacccccacagntgncttggtncctttcncctacngcactnttagtactgtgacactagtggccaccatgcccacataccctgtggttgantacactttgtgntcttgtgctcaccttgtngatgcccaacaccacactngtgaccttgcccctaacattgtatgtgtgctgaccttgacacacgacctccacacctgnccgaacaccnngaactgaaccangtggtaactccccntttgacccctantcatcgaccacactacacnccccacntnttggacaacncacttgntgcacctncnntgnatccacacacaacacccttgtgntgcacatntagaaccannntatgtngaccncnaacacaacaacttacctttggtgccacataacaacaacaaactgatatnncccattaaccncaacaaacacaggaaccngatcttccccccctgcatttgtcncctanngactactcccaatcnganaacngtgaaccttncacanttcacgcnttgtgtttggatatatttgacatatggacacctatngaacnggatggnnccccaccacctnccatacncnacnagtacccccnccccaanccnaccnggcntggcccccaaancacnccnncgactcagnaccagcaacanggaaacacccacnancgnt

SEQ ID NO: 104034 - DNA, 800 bp, Triticum aestivum
  unsure (1)..(800): unsure at all n locations
  Clone ID: PAT_TA_104034
gacntacctcttgtcttcctctnacntnngtctaanctanaacagccacaaacaaacccanccactcgtgcccatggccaanccacccctcgccnacctgcactgtcctgcctctccnatctgctgccacccagacaccctgctntcnngcacctcctgtcntctgcctcccanccatactccatcccacacccntcaagtcttgcttgcccagccaattgcactgccttcntcccctgtgntcctcccctcccanatcctgccactcagccntcctctgccctgcnttgtgnttgctgtgtgccatgttgccncactctgtgtgcacccccacactctgtctgccnacacactctgtgtgcaccatgtgcctgcangtgctctgcatgtgtgcactcccactgactgnccatctgacacatgnaatgcacanaatgttgtgantacacnaangatntccttgatttgacatacgncacntgnaacctgacattgaatacctcactggattgtgaatgatgatcccctgnctgttgtacctncnnccacttnctgnnccaaaaactggtggcntgctncnctnatccctggctntgttgccacctgcctangtcctngcaatttggacatccccactcncacatgcnccccaatcccntnatcncccnnaaatngcaangaccnttncncaagnatttgnttgcacaanatagatccacccacaaagntggcgcngcataacaaccgccacccacaagtccncattgatttgtggccaccattanntaccccccancaac

SEQ ID NO: 104035 - DNA, 1335 bp, Triticum aestivum
  unsure (1)..(1335): unsure at all n locations
  Clone ID: PAT_TA_104035
tgactngacgagcactccatctccatgcccccgccccgccgggcccggccagatctccgngcngtggctgtagcctgatcctgatcctggccctgatgggctggtgatgtgcctggagcctgnggtggtcacctgtgctgctcanttcggnngtgccctgangatgcgctgnacctcgtcatgggctacgtcacnccccgngcgactgggatgtgcctgcctcngctctgatcttgcctgcctgacantgtgacacctgcaatcgaacagctgcntcaccactgcanaagcacgatcacctgntcnnacacntatcattgcatacanncacganctgaacccccatcaganaaccctccatccgccctgctatccnctgctgcctctgnaagatcngacattggcacctcaaagtgngcagtgnncagcagacngcncgcacaaantgtaacngtgcctcaactcataccngaaacagacttggtgtgcagccctaacngacacngncagccccctnganangtccgcancngngcctccgcnccaanacccngnnatacagacnnttgccatcaaagtgnccagcntcacanccttggntanacncgncaanttgaaccctgancncctgaacnnnacanacnagatncagcncnacngnncntaccaatcccngcaacccnngncngagncccnccanntgcnnatgcananngacncacnacgcnnccaccaangtgccccggcnccccaccgaccgcgcaccgccnngacacncgcnaccctgncnaaccncnaanagaaccncncaacccccgncnacngccgcgacnccgnnacaccgnnnnngccccnnggncncacaccannccgcccgncccaccaancgcccccnnnnacnccnganncccccnccccncccnnccccacagccncccnccannacccngncccncccccacacacaagctcnacnacccacaccancannacagcagcgcccacctancgcnggaccnncactacgcccntccacntgcgccacnacaganacgcgacacagaaagaaagaacnncnacnnanaagngncacnggncccannnacncgnncaacacnaccgncaccnnnaggcgagngcaaacnccnanacccncacaananaccncnaccnacnnaaacananacananaaacnnaacnanagcacaccnanccacccacnacacccacanacncacnaccnnncnccanncaccnnaccccccccanncacacgccncanacancacacnaccacnnccnncaccaacnancacccgcnncnnccaacancc

SEQ ID NO: 104036 - DNA, 1119 bp, Triticum aestivum
  unsure (1)..(1119): unsure at all n locations
  Clone ID: PAT_TA_104036
caacnccaatgattgncagattggtatacttgatcctggantgngtgacatgatgctggtgnggagatgatccatgggaggagtcttgcaacatanntgcgcaagatctctcatctacaccnaggngtgagtgtccaaagatgaactcnaagtcatctaccccganaaaggaggaangtgtntcctgcngnnatgccgatgtgcngcaaantgagaattgcccatccctgccactgtcaagccattntagatcaactagccaactagtgtttgctgtnaagcctgattttgagtgcatgaatgttgangtgtatcngcactgtgtgngagcttttgtccttgccctcgctctgtgngtcccagccagccagccaatgacatgtaactcctgatgtctntttggttgatctgccccctaccnccacattgtgatgcacgcaacnagacanacncacaanaccaaccttttggatnatnagnctatttantttgnctaggtacattgtaaagannagacttttgnttgcnnctgcgcganatganaatncctgcttggnntatgctctgcattgcctcttgtgcccnctctaacgatcaccnaaanncgagcccancanatannaatcgatannatncngtttgnccncnncntagnatctcgaccttgcatagcanntagaaacctaangnaacctccnctcccncacnccacccnccancanccacacaccncaaatcgaanancaaacacnaaacactcaagnntccnacnncnccancanaacccacannacaaaacannaaanaaacacanggnnanaanagccaacaacncaccnacacacaaanaagangaggancgganngnancaacagacaaacaanaggaagaaacaananacagaaagnannancgcggccgntgggaananaccgcngagagnaacanacnnagancnnnaaacanaaannanaaaggagacnnntacagcnccaagacagnaccaagtagccaganggntacaacaanacagagaggacgnancagcaannaccanccacaacacatngccgtancanntanttccnnttgtctgngaganananaanacaagaaag

SEQ ID NO: 104037 - DNA, 800 bp, Triticum aestivum
  unsure (1)..(800): unsure at all n locations
  Clone ID: PAT_TA_104037
cacctgcacaactgcatgcnttagatgttccatgtgccacaagttgcaggccacaaaatccatctcagcaacacccacaagagcaaagttcctgttgtgtacaacaacaacaaatttctatgtgtgcatgcaacaatcatattccaccgacgagagcatagcccatatccgagcatgncctgcaacccatttccatctagctaacagancccagtatcttggcgatgcttgcaaccaatttccctgcgaaggcctgcaagancatcaccaatagtntattgcatgtcccatcanaacacnagttttctgaccccacaacacgaanccaatnantcccacaacctgccaagccagcanagntaattcgtncaagcgcagcaaaagcaagcaaacaagttaacccgtcncaanaatangcaagttcctcacgcgagagncacagcgaagnncaagagctagccaccgaaagacaaaaacagaacnaanacgtcgcnccgaggcaaccgcnaacaacganangtttccgcgccccagncngaaccaantattcgccccgcaaagccgaaagctagaagcancagagctttgccgcccnacaaacaaaannncanacggannactatccnccccacacccangccnacacttctcccnctgcctaagccgaaaccnaaatntcccanacccctaaacacaccnacacntttcacctgcnaaaccacacaaaattttcctcncacnganacccacgcccatntctcccnttcnaaaggccccgnagagaanngacaagcanccnc

SEQ ID NO: 104038 - DNA, 685 bp, Triticum aestivum
  unsure (1)..(685): unsure at all n locations
  Clone ID: PAT_TA_104038
cgaggcttcgctctccacaatgagttgcgggaaagtgatgtttgtgtattcgaagtatcaaaaagcgctggtgaaatgacaatggttgttcattctcttgaaggaggccatcacctacaagggaaagagcccgaatctcaaaacaagtgcgattatcctgttaagggcaaggcgatcaaggaagctgagagtgaccataaacatgctgagtccaagtccaactactactactcaaagtatgccaagggcctgactggcgaggagctagaggagatattcaggtcagcgttgatccaacagggcaatgtggtatacgtcaccatcctggggaagaatcaagttagaatcaagaacaacttgctgaccttccccgggaagtttgcagctaagcatctcgtggagaggtcgcatgacatcctgctcctgaggcctaaccggagtgagacgtggtgtgcgagatactactaccacccgaaagaacagggtttcagctacagttcctggaccaagttcgtccgagacaacaagctgtgcaagggccacgtctgcgtcttcgagctgatgaagggcgtgagtaaggcgacaatgattgtccacgtgttcacaaaggtcgatggcaggttcgttctgctanactaactgtctaggttccagcctaattgcatcctccttaatttgncggata

SEQ ID NO: 104039 - DNA, 499 bp, Triticum aestivum
  unsure (1)..(499): unsure at all n locations
  Clone ID: PAT_TA_104039
ccgnngctcgagcccatggccgcgcctccctgtcgcgttgctgctccatgctccacctccagcctgcctccgtcgtgctgcctgcctcgccatggacctggctgccctgccgaccccctcgctctcgcatcctgtcctgcctccagtgcccagcacccatctgctgctcctgccctctgcccagcagcaagctgcacccaggcctggcagcccctgtctgtgcctccatctgtctgtctgtccctgttccttcccatcnagccagcnagcaccagcctgcctgccctctgcaccatctcccagcacctcctgnctgcccctctgctacccctgtcccctgtagctgctcctgccttctcccacctgaagctcttctcctgtgctgcctgtctgcctgntccncacacacaccaagcncatgtgcccncaccncaccatgccacccatagnctntgccatcccntcctccacntgnttctcactctgntcncnttgngaa

SEQ ID NO: 104040 - DNA, 309 bp, Triticum aestivum
  unsure (1)..(309): unsure at all n locations
  Clone ID: PAT_TA_104040
gacagctgactgcactggcgcctgcagcgcacgccttctcctgctcgaggcatgctgcaaccagctctggtgatgccatggagcctatctttgtgcagcgccagtgggggcattcttgctatgcccgactccccccctcctanngcctcctacggctcgtcggaagactattgctggatgtaangtgtttccangcaatgggnggngcctctctctgcagaaagtgaagcgtgggggttcctgtgtggcnggtttcggcagccaaggcagcggaaaagctggtcagtcggtccctgggaattaccaggg

SEQ ID NO: 104041 - DNA, 1218 bp, Triticum aestivum
  unsure (1)..(1218): unsure at all n locations
  Clone ID: PAT_TA_104041
aganatgcactctggcgaagctaacanaaannaancgagnccaanaaatgcagcgacgtttactactgcatnccacttcgtagatcccttcgaccagtgactacaatcnntcctctgctcgactaacatggatnagctagtaanngatncttgaccagtggcatccatngntgtagcattaagagatccntnctattaacgatgcccnntctcaatctagtncaagttggcaaanntgggctangtgctccacctcgacattgtgttggaaagtggagctanttgatctgtaccattagagacnatangggctacaccaagattttcattgggaggagctcncctcattgaaacaatgttccacctaactagtctcggcgccagggataggtttctgttcttatcacatttgagagcaaatttccaactcttttcgcccatacgcagagcactatnncgcccacgtatcgaaacgacgcacccaagacaaggttcatctgcttagtcacganacgcacatgagcgagtcgcntctcgcgnaatcgcttcacaatcatctnaatcacagactccatagtgtgnccactaccccaaatcaatgtcactttctgctaattattcactttntggaccgtaggcagagttgagttcgccccccaatgncctttctgagacnggacaaggctcgctanaatagtcctttgacanttgcatcntaattgctttggctttcgctcctggacatcgaaatcgcagcacttgcgctccaaattcccaccgtgtatttgtggagtactcactcttgtagttcctcacctacatagggagtataggcnggntcaaacaaattggntnaagccctnggtaccggaggaaccccgtngtccaanagaggggttngcggaangaatnannatctangggncngatgtctgtananaannnaggtataaaggtnaaanactcctantggtgtattcgatatcgataataaactttgggaattcgaattgtgganaccaaaacatgtaaantattntggntctgcctttctagggaaannantgaatggntnagttttgannagtgggggtacctgannggtnttggtttgtaaacanctatnttnnaaaatntggaggnnncngggngtgtgggnggtgggttggggtgtgttganaaaantgccngnaaatcnccannnnnnaagggggagaa

SEQ ID NO: 104042 - DNA, 800 bp, Triticum aestivum
  unsure (1)..(800): unsure at all n locations
  Clone ID: PAT_TA_104042
aaaaaaaccncgnnntgncctgtgatcggcacgagcccaaaatagttnacacaatgcagaaaatcaaatgtacngctaagtangttaaactgcanatccaccatgnaacgaccattactcantcctgcaccanatcccatntgactgcantgtgcccacatncacaccccatctgtgcnccaccctgccccacaatcatccccatgtagctcctgcaccccnatcagctgtgcccacatgtnaaccacanttgtgcntcacncanngaccnagacaacgcacaacgntcgaggatcgccccccccnacaaggcngtcncccacaccncgatggnccncaatngcagtcgcccatggccnacanccccacnncgacnacngaaacnccacaanttgntcncccccccaaggcacgtcgacgagggcgcacaangtgngcngcgccacgangccacgacggcagcnaacgngttgttggtgcgncgcgccgacaacggcgacgactgcgncngacggcnnanngacgcganaacggcgccgannagggtggtcagcgcccgnccntcgacggggacgcgcngttccnnangaccggccaacgagcagcggccgnaccnnccacgnacgcaaacgccnnnaanacancgccggcncgncgaancangatagcnntagantacccagccgagaccnnagcacaaaaggganaagcncgagtttgcccnaccnnnaaananggaggcgnncaagcaacagacangcccgnaagacncaatacaannaacaaccnancaaagcgac

SEQ ID NO: 104043 - DNA, 1047 bp, Triticum aestivum
  unsure (1)..(1047): unsure at all n locations
  Clone ID: PAT_TA_104043
gagcgtttcctcgcaaacccacagagcccagctgtttctccttcttcttcacctgnctccgactgaatcagctgctgtcccctcccctgccaccagagctgctagcttcgttctgcctgctgtctgtcaccaagagcacctgcccactcgcctgagtgtgaccagagctgaatgtgctgtctgcagaatgttccctgcctgcatgcatgcatgtgacttgccatgccctgtgcnaattgatgcactgccattgtgaccccctgcccctgatgaccctcatcaatgaactacaatgtctgtgncaacaatgctccatgttgcaattgttgtgcacttggtgacctgtgctgtgctgancctctgtgtgcatactgtgtgctgctgctgtgttgttgcccttgtgncttctgctgcttgtgatgtgtgctgctgaactgtgtttgaaacctatcanctgtactgttganantgtgtgtgcactgantgntgaccaattgaacngcngtgangtgangaaccccattggacaatgttgactgcatatacatagcttgaacnanttcaaaatgngtaccnctggcacactgtgtggctggcacctgttgcttgnaatggcacaccacaatgtgggctgcctnccccctgtgttgnctgaacncccctnctggnagtgntaacctgaatnntgantgnaaaaccattgccctgcnaaangtgtgttttgtggntttgntgaatngtngaanntggtggattttagacnatgannantcattgcctggaccaacgcntggtggncatgggggtgggnattgccattgnatttggttgaaacnaaananttncaccnnatttccttggggtanncaanaanccaaaaaacatgagcntngggtggacttatgttggaatgagnncaaatggataaanccatnngtttancanttgatgggacacctcnttatgncagaanttcaanaanccnttgnannagaaaatcaaagcgccatggaaangcnnaagtgatgtgaaacncnnnttggaaaa

SEQ ID NO: 104044 - DNA, 1211 bp, Triticum aestivum
  unsure (1)..(1211): unsure at all n locations
  Clone ID: PAT_TA_104044
tntctcgcgccgtgcacgccgcgccgctgtgaagcgtggttctctatgacaaagctcgtggtactcgtcctgctgctggtactggctgttgctgctgctcttttcactcgtgacngattctaattgtttggcttgcctggctggtacaagaagaagatggtgaangtcagacttgctcctcccatctgtcgngagaccttctgtctgttgccctgangcttgatgtgatgtgttcactgtactgtgctgatgcttggatgtgctgtgncacctgtgctctgttctgacccaattgcnaactgttgatctgtgtgatgcatgcangccntgangcactgtgtgtacaattgtgctgttgctctgttgtgatgccctgactgtgnaattgcctgtctgcctgtgaatgctgtgctcaanccttggnatgcatgttccctgtgccattgtctgtgacaatgatgcttcctccactgtgatgctctgtgactgcttgangcatgtgcttgatgtgcaccaatgaaccttgngctgctgtgtgttgtgtactgtgtgtnactgctgttgtgtgatgtgccttcaatgattgaangtgccctggtcctctgnaagataacnattggaacaaaaactgtgctgaacctctgganctgtgctgctngagtcccactggcccctggtgaactgctagcactgantgggttgtgactgtgatgtgcttgtgagctgngcattgctgctgttgttgctgtaatcttgngtgngcnngccaactgtgtgctaagtgtaacccttgcanactcctgnngctacagtggatncccccaatcgttgcaacttggagaccngtcaaangccctccaacngncntagcttggacngccncgactttgngagtggtgcgtggtcaagtgngattcngggaactggnggtggattggttggggtgttccacctgactggatngtngttggngnccctgattctggtgagagtnngnngagttncngtgtggnactgangggttaatttggnncannctnttngtngttatttangggggntcccnttggtgannntgnactcgggcttgtgattagnnnacncaatggagcnntggaaatntgagtntgnnnnannngtaacagtntgaaanacngtnaagtagatgagcacnnnagnagancagnnnanngngntnagnanngtnataa

SEQ ID NO: 104045 - DNA, 907 bp, Triticum aestivum
  unsure (1)..(907): unsure at all n locations
  Clone ID: PAT_TA_104045
gaatctggcaccagcntatcgtgtaaccatgacgcaccgactnntaanncctgtcgattcagancgatccagagtnggagctgatcgtgtgctgactgcncncgtgatgtgtgnccacantgngtgacgnncacgtggtntccatgaaaccatngcaacgattacattgtcctacagattcgaaggggtantaaaccggatncagtctctgtaacggatagcgtcgtgcgtatccatactatcttcttcngtcatcttcctccgctccgtnagaggcatgcaggctangtcnatgtgttacntgctgntnttgagtcgctctgcagccgttgnagcagtagcctcgataaattaaatacgatgtccaangtgccattgaaatctgacccagaagtggagntgcgtttgtgnttatncatttgtgtttgtgatagaataataggtttgtttaaaggctngtcccaagtgagagttgactcattgctagtagagaacattggacaatgatgnaacaaatnngtatnnttgctaagggnttaacatccataacttaacaatttgttgntctatnggcttccnaatatatgtaaaacatnntgcgtcantagagtcagacttgttgtcactctataattntttcgcaagccntaantaagaatgtttgtaacngagtaatagtactataatacccctattgtcttgtcacacctgantctgtggagnttgttgtacactngttagccaaacacaaccngnngaggacagatatacataaagatgnttcccanatacaggccttattggtttccatccttngcgctacntcatcaaactgcatncctaccataacgtacataactttncctacacanttngaccacanggancnaggtancnccnatntggg

SEQ ID NO: 104046 - DNA, 612 bp, Triticum aestivum
  unsure (1)..(612): unsure at all n locations
  Clone ID: PAT_TA_104046
cacaaaaaaaaaaaaaaaaaaaaaaaaaaaaaaaaaaaaaaaaaaactcgaggtgngngtngccctggtacccaattcgccctatagtgagtcgtatnacaattcacttggcctgtcgttttacaacgtcgtgacttgggaaaaccctgctgttacccaacttaatctgccttgcagcacatccccctttctgccagctggcgtaatagcngaagnagngccctgcacctgatctgcccttcccaacagtttgcngcagcctgaatggcgaatggcaaatttgtaagcgtaaatattttntgttaaaattcgcgttaaatttttgttnaaatccagctcattttttaaccaataggcctgaaatctggcaaaatcccttataaatcaaaagaatagacctgagatagcggtntcgagtgtcgtcccatgtnttgtgaacaacgatgtccacttattnaaagnaactgttgngaactcccanactgtcncacgtgggcngaaaaaacctggtctatccaggggcgattgtgcccccactcactgttgaaccaatcaccntaatccaagtttttgggggtcnnaaggttgccgnnaaagcctaaatcgaancct

SEQ ID NO: 104047 - DNA, 800 bp, Triticum aestivum
  unsure (1)..(800): unsure at all n locations
  Clone ID: PAT_TA_104047
tagnngcatagcnaanngaaccaaccaatatnttctcatgcaacaancaattctaccacangcaaccaccaatttatctctccatagaggcaaatgggcaaaancaanagcaaaancctttnnataggtcatcccttaancccctaggcaaagaacaagaggccaaagcnccaattcatatatccaagcataaggngggncagacanagncnaangagngcanaagtaagcnccaaaggggggttatgattttanacagccccctttcccccccnagaagcanaaaagaatgccaaacagcagtnttaccccagaagtccccttttctcttntnntccnccccagaaggcnnagagaaggcagaaagaangccanaanagagcccagaaagagncagaaaaaaanccaaaacncccccagnnanaaacgccntaatggagnccttttttagggtgggttataggccaagangaacacaanaaagccanaaaaaganttttcccccnccccttttatagatttcatagagagtgtnntccnncnannangnggagnncacccaccaacaantntttcccncccccnaaaaaagtntataaatctagatncattagagaggacgcacacaacagtanncgccnnancaaatagtaggcccttttctatnacacaacgagncaacnaangncggcccnaccctccacnanananttttnttntnagcnnccanaaccanntatgtgtggngngtcttacacaagttctttccnaccccccantncttccaccccccacaacaa

SEQ ID NO: 104048 - DNA, 1142 bp, Triticum aestivum
  unsure (1)..(1142): unsure at all n locations
  Clone ID: PAT_TA_104048
cccacactggccncaacncnccctanccctgntnctganctggacccgccnntacntacccncttacacncaccactgtgnacntncntnccatncnatcaacacccccgccaatccatncanacnntcncgcctancnntctgnacaccntgngcgtacnncacctggnctgacnttncgcaccacacaccactngtnttggacacacatcagcnnccgtactgccctaccacanattcattntcantaacatcataaccgcnacaatcactagnncacccacnttggaccaactaggagcaccccctctggtgnacagtacacnnnganacccttatntacacacnttanccncggnaccaaccnnttacttgaacacctgatnggacccttanccntcaaaccgcccaccagactagngcaccanttncnnccaangcaacctncnggactctctggtctcgcatnctccgncttttttggttgtttnngtcnggttgggcncctcgggntccgctgnctntttggtnccncttagaaacccncgacnccctactcctgcacatctancatctgnggtcatncncnctaactgcgncattnaatataancagactncgnnaccctatggcttggtcccncccananttncgaccnncacanncnatntgctgnncacccntggaactnnctcgntnggacataccacatctctgnccacatatatagnccnacannatcaaatcgcngggcttcgacccaacccacaanancnanttgtcccacncnccatccccnacacccattttgatcgnactntttggncnatatacacanaattactccacccnancnacncattgggacgtacagancaaagttcccacncaatagngtncccgtngcnacntcccttgtgcngaaacactatgngcccanattgtttgcancacanccaagttacgaaacttgtgccccncgnngttncnnaaacnaccnnatggccnacatcaacggnncnaaacatcccacctcaacatataggtatcngttccgacgataccatccccaaatgggctncnacacagtagggctcanttcngnagacanttannntttgggccatctccgtccccaactc

SEQ ID NO: 104049 - DNA, 892 bp, Triticum aestivum
  unsure (1)..(892): unsure at all n locations
  Clone ID: PAT_TA_104049
aggatcgatcagnggtagacagaggatggcagtcgatagcatgcacgtcgtgatgttccccttcctcgccttcggccacatcagcccgttcgtgcagctggctgcgcaagctcgtcgccgccggcggcgtgcngggtcacgctgctgtcggccgcggccaacgtgccccgcgtcngatgtgccatgcttggtgtgcctggctggcctggctgctggtgtgcctngtgtgcccctgctgcgcctccatgctgctgtgcctggggctcccctgaagtgtgctgcctgangatgcactggcctgaagtggtctcngngctgtgaactgtgctgcctgangcttgcntcaatgtgtctgcctgntctgancngtgcaccatgngcctgcangtgtggctgtgccctgctcgctggangctctgngcccctgacngccctgcttgttctgancttcngccaccccattgggnggtccacnctggaaggcctcngctgtgnctgcccngcnttctgggncattcaangtggctgcntcccnaggttcntcnggnggttccttctcccnggccnggttggtccctgggctgcccttacctgnatgaaccccnngnccctatggcnctnngcctttccnnnggagcanggccnccgnntgntggcnctggtnggncccaaanggcngtgtggcgccaagaacacccntggcncnngatggaaacccgtgaagncacagttaccaaagccgangaatncagaagccntggcncccacctgggccnaaaanggaggcnttttaccaccacccaagncgccnngnttccnnggnttccacccaaaaaagccaanttccctngacncccaaacnccactggnngttgggccncccnnncggnng

SEQ ID NO: 104050 - DNA, 623 bp, Triticum aestivum
  unsure (1)..(623): unsure at all n locations
  Clone ID: PAT_TA_104050
acagcacctggttacacaatccacatgaagacttcctcatctttgctctcctcgccattgtggcngacaagtgccattgcacaaatggagaatagccacatccctggttttggagagaccatcgcagcaacaaccattaccaccacaacaaacattatcgcaccaccaacaacaacaacccatccaacaacaaccacaaccattttcacaacatgcaaccatgttcacatgcaacaacaacaaccattatctgcagcaacaacaaccaccattttcacaacaacaaccaccattttctgcagcaacaacaactagttctacctgcaacaaccaccattttcacatgcaacaacaaccagttttacctccacaacaatcaccttttccacaacaacaacaacaacaccaacatgcttggtgcaacaacaaatccctgtttgttcangccatccatttttgcagcatgctaaacccatgcaaggtattcctccagcagcangtgcagccctgtggcaattgccacaacgtcttgctagngtcgcaaattgtttgcagcagagcagtttgccatgtgatgcaacaacaatgttgccagcagttgccgcaaatcccccagcaatccc

SEQ ID NO: 104051 - DNA, 990 bp, Triticum aestivum
  unsure (1)..(990): unsure at all n locations
  Clone ID: PAT_TA_104051
tgaatgacttactcatcgtaacaatccttgcgatggcaacaaccatctgccacctgccaatatgcaatgtctgacccctggctaccaatgtacatttggccacaacaacaaccattcccccagccccaacaaccattcttgccagcaaccacaacaaactattccccaaccccatcaaactgttccaccatcaacacaacaaacatttccccaacccaacaaacatacccccatcaancacaacaacaatttccccagacccatgcaaccacaacaaccatttccccatgcccaacaaacattcccnccaacaaccccaactaccatttccccaacaacccaacaaccattcccccatgcctcaanaatccnccaacaacaatnttccccatgtcacatgcaanccacaacaagcttttccccatgncccaagaacaattccgtgcatgccccaacaacctggaacaatcattccacccatgnnaatgaanaactgttgattcatgctatctctacaacaacagatgaanccctgcaagaatttnctcttgcagcaatgcaancctgtgtcatttggttgtccatccctcatatcaatgatcttgccacngaagtgattgncnngtgattgcaggcacaatgttgccaagaactggnncagatccntcaancnaggttcccgtgtgcacgcgnatcccatangtggnctngtgaaatccatcanncattgncagcatgganncnngttgaanattggtgtttgcgantccnggcggnccattggnnanngnnncgncatggnncnngggcatcncacactccacnnancaggccaattggctgtgagncgggcntggnttggacaactctcccntntggcngtgnttnngctacttggngntcaccaagncatgngaagtntnnngcatnncgnngaanacantcgaagagaacncggtnnnaacacngananagtntggggnganantt

SEQ ID NO: 104052 - DNA, 886 bp, Triticum aestivum
  unsure (1)..(886): unsure at all n locations
  Clone ID: PAT_TA_104052
catcttcttctccttgaaatctttttgggtcacagatttggaggatgcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgttgtgtgcgcatgtctccctgtaattgcttcatctatctccactatggatggagtgatgaatatgtaagaatgaaagatttacctaattaactagtcaaaaaaaaactcgaggngggggcccggtaccaattcgncctatagtgagtcgtattacaattcactggccgtcgtttnacaacgtcgtgactggggaaaancctggcgttaccaacttaatcgncttgcagnacataccccctttcgccagcntggcgtaatagccgaagaaggcccgcaccgatnggccttcccaaaagtgcngcagcngaannggnngaatggcaaantgtaacgngtanaatncgncanactccgnttaattngnncatnacanncaannaacnanagccgaanncgaaaccntaataaaaaaccggnagggncgggcctgcacacagcacacaaaaggccgcagganac

SEQ ID NO: 104053 - DNA, 963 bp, Triticum aestivum
  unsure (1)..(963): unsure at all n locations
  Clone ID: PAT_TA_104053
cggcatcccacggattanatagcgccaccggaaagttgctgctgctgctgctatatatctcttgcggnctccaggctccagcgtcgaggattaatttgcctgccagcttaantgaagcaagacctgaatttggtttgtcttggcctggncatccagnggagctagtgccagngatatacatacattggatgtgctgcctgtgctgtgcccagatgtgatgtgatgctgctgaattgctgtgctcctgtgcttggttgtccctgtgttgngttgtgttggttggctgaattgtgctgtgctgtgctgactgtgctgctgtgtgctgccagcttgcnangtgtctgtgtgtacctacngaacactgcttgttgccctgtgctgtgnctgtgaatgantcaatctgttgcangcaagtgaangtgtcaangcaaatgtgtgtgtgttgtcctngtgcatagccccctgtgcaacctgcctgcctgtgcctccntcctgtgnctccaactntccactngaaacttgcattctgtcangtggtgcttgctgaactgtgtgtcctgngttgcttgcttgtgactctgactgcctgtgtgcaacccatgtgctgtgcagaatgtgactgctgccgancaaaactcngaagcctcctgnctgtgtgttccngagtgtgaatctgaactgctgtgcaangaactgcngtgcttgtgatgcagtgccctgntacagtgcngtcagntctaccatgcngcctgacggnttgctcngccctntctggccngccangaagaacagccacatcnggcccttgngatccaggaagtgcagtctgttacccagggttgccctgggccctggtgnctgaaccagangaccnggaaaantgntcatccgaggntgggnagaggggggaagaacccaacannggggaaanccattgaccnggcagngaccggaacnagccaa

SEQ ID NO: 104054 - DNA, 750 bp, Triticum aestivum
  unsure (1)..(750): unsure at all n locations
  Clone ID: PAT_TA_104054
cccctgncacatgcccctgctgcccaangctgctccctgctactgctgcaccaccacctccgcctgtgtgactgtgctgngactgctgctcctcaaccanctcctgtggcctgcttcccctgcatggatccccagtttgcttgagattggcccttgaangctgtcttggagattgattttggattattgcaataaagagtcttgaagtgcagcttgcnaccctccatggagtccaacatcaagtgctcaacccttgtctgtgcctgctgtgttcctgcnattttgacacaactgtgtgcctgcacttgcnatgtcccaagccatccttgtctgacangtgccattgttacccagcctgcctgtgttgttgtgnacacagntacttgcaaccaccnaacccttgcctgccnagcctcaggccacaccagcccacagcacatcagttgtgctgcnacattggtgtttgcatctnnnatnctgttgcagtgtgcagcattgtccacacattgctnntccttgcacattggccactgcattgctgcctggtggcatcgttgcgtccaagcagctctggacaagcctntgcacgcaaagncccancccctgnnccaagtgtgnttgcacaagtgaacgacntngnngaccagccngcaacataccnctgncttcacgnngaanaaacaatngaatagcntcanacgnggangnnccaccactgaccncgcctgaccccttgntcagcacaanccn

SEQ ID NO: 104055 - DNA, 665 bp, Triticum aestivum
  unsure (1)..(665): unsure at all n locations
  Clone ID: PAT_TA_104055
cagtacaacacagagaggaacagaaagcacagaggaaagcgagagcatgccatggacgtcgcaaaagcggctcatcccgagcagcatcacttcatcacgggaagcccctcgccgaagctgctaaagctggagcctttcgctgccgatctcctctagcctcccggccctcctcctctcccggagagcccttcgccgcccactccaacgagccgaggcgccaaaaataaacttgtaattctccgcccgatcctcgcggaggcggtcgatggaggttgccgcggcgggagagccggcgcccgcgggcgagtggctggaggagcgcggcgtggacgccgtgtacctccccaggctgatcgccggcgtcatctccggcgcgctcaccggcctcttcgctctcgctggagcattgaccggggccgtcaccggcgcgctggcngggcagagcctccgacagcggcgttctccggggagctggactgggagcgattgccggggccgtcctctccatcgaggttctcgaggcgtctcgcgcgtactggtgctcggaccggctcggcacatgctccatgctcagcataccggattttgggcacgatgatgtgtacgacatcttcggggacatttcgtcgagagggctttcgcgggaggcactggagaaattaccg

SEQ ID NO: 104056 - DNA, 386 bp, Triticum aestivum
  unsure (1)..(386): unsure at all n locations
  Clone ID: PAT_TA_104056
aagcaaaagctancggcgtantanctcacttcagtccagtcggcatggcnggctccgagtgggtgctggcactggtgctggcgatgngtgctcgcggccatggtggtgtgcngccgccgngcgactgtgcacgccatatcctgctccacggtgtacagcacngctgatgccngtgcctgcagtactgtgcagcagtggctgggtctgccngtgccctggggctgctgcacctggcatccagaacctgctggccgaggccaacaacagccccgaccgcctgcaccaatcttgctgtgcttgcctcaagaactgtcngccaaactngtgctgccntcctgtgctgtgtgcccctaccatcaccctggctgcctgcctgcgctcccctc

SEQ ID NO: 104057 - DNA, 928 bp, Triticum aestivum
  unsure (1)..(928): unsure at all n locations
  Clone ID: PAT_TA_104057
ctgatntgcacacancactgcacgacactaccaagattcatcgaagaaaacctcgagaggatcatggcctggtgtgaacaccagtgtggtcnggcctcaagcccgccgnggtggtgccgcagtcctgcctcgccggcggctgtgcaaagctgcgtgcagtgtcgccccggtcaatgacctggctgtgatctgtgcagcgtttctctgtngccttgnctggcctgtcttcngcctgtctactgtgcctgccntcctgccaggngtcatgctcagntgtcaaagctgtcnttcagactgagtaccgtcgagnaagagctaagctctagacnaantgagcttgaacngacaaagtaangangtggctgggctgacagaaggctgtgctgccaacattcngctgccgcngcctaacaacctgtccanttcnggcagctgcaatgattcccctacagantttcannctggcttgccaaggacctctgccaagcaggaacgaaagtcccngttcaatcnacccgatctgaccttggagattcgaggtgctgatggtgngaaggacnaagttcaaggatgcaggagtccaaatgatcatcttggaaacttggtgaatgcttggtctgatcgttgncgaggcaaatagtggctgagtgcttgatnttatgtcaagnngcactctgcngctgatancttaagtantgtcctagatttgagcaagatgtttcagagagntgttgaaagttgnntctgactgggtggtaaatttnanncattnatcaancgtgggaaaattnnnattggttgtanatagaatataaaannaaaaananactcgaagtggnggngnccnngtatanccangtntnagcncaaananntnaagatagaaataaacanttngttgggcagattgntttacaacagttnttag

SEQ ID NO: 104058 - DNA, 500 bp, Triticum aestivum
  unsure (1)..(500): unsure at all n locations
  Clone ID: PAT_TA_104058
nacactcatgtcccccccacaccccccaaccatgcccattcatccccatgccacacctgcnacacncaatgccatattccccccaaccccccacacacacacnattttcccccccatccacaccccaccacacacacacaatgtatcccncaatgcctcnatgccaaccccacnaaccacacccaatattctcccatgcncccncacaccaatgcattcccacccaacnacaccccacnanaccacacgcgcagtgtcgcncatccgcaggcacatcccacaccanaccccacncanagccgaacacccccagtttccccccccncaggcncacaccnccncacgnacagcgcacaaccnncanttgtcccnccccccgnaggncacctccaancaggccncagncaacnnaacacgcacaaccccagcaaatattntncgcccgcnagnaggcgcnccacancgcccnaccgaaagcgcgcagcagccccgnaagtatt

SEQ ID NO: 104059 - DNA, 574 bp, Triticum aestivum
  unsure (1)..(574): unsure at all n locations
  Clone ID: PAT_TA_104059
aacaacaaccaccatgttcacatgcaacaacaacccatttcccacatgcaacaacaaccaattattcatcacnttgcaacaatcaccattttctgcagcaacaacaaccatgttcttgcctgcaacatgcaaccagttattatacttgcaacaaccaccattttctgcatgcaacaacaaccatgttctaccacaacaaccaccattttcacaacaacaacaacaacaacaacaacaacaaccaccattttctgcatgcaacaacaaccatgttctaccacaacaaccaccagttttcacaacaacaacaaccatnncattttctgcatgctatgcgaacaagcatcttcacaacaaccaccttgttgcacaacaanaccaacatgtttccacaacaacaaatccctgttgttcaaccatcctgtttttgcatgcagctaaacccatgcaattgttgttcctccaacatgcatgtgtanccatgtggcaattgtcgcaactgtcttgctagtgtcacaaatgtgtgcaacatgagtagtttgccattgtgattgcaacgaacaattgtttgcca

SEQ ID NO: 104060 - DNA, 761 bp, Triticum aestivum
  unsure (1)..(761): unsure at all n locations
  Clone ID: PAT_TA_104060
cccccctcctccctcaccacagccgcaacctagaggcttcgccgtccgtttcgatgagatccaccacctcatgagtgttctcatctgccccaggttgcgagngaagccgcgggagngagngagtgacctcggtgcgagatagngtacgtgagtgagtgagctcaaccaacgcgtcttctgtgcctggagtgatgtggaagcangctggattgcgaagccatgaagtgctgtgatctgtgcttgggccccaagngtattgtgangtgctgtgcttggtgtgctgtgngctgctgtgaanaagtggcctgaattgctggctgtgctgtgccaagtgacagtggatgtgacgaagtgtttgcatccatcagctgagaagctggcctgatccacctgcngtgcnttgtcactgcatgtggatagctgccgcctgtctcccatctcccctcgtggcacctccctatatgttgagtgacgattatgtggttatcttgtgngcagtgtgctcctatcctccccgnctccatacttcattttttggaaaactaatgattttaattcctgnatgtcatagatgttgaggtttggtcctgaatggttggctttgggacttttggtggcagtatattcttatgccaacgacaagcatttgnaggataattatgtggtnatctgtggcagtgtgctcctatcctccccgctcatacttcatttntggaaaactaatgatttaattcttggatatcatagtaccattggttgtg

SEQ ID NO: 104061 - DNA, 888 bp, Triticum aestivum
  unsure (1)..(888): unsure at all n locations
  Clone ID: PAT_TA_104061
gatcggagantggctggnngctggctggtttcgatccgtgatctttctcgacgcggatggcgngcgtatcgatcccgctgaancggctggctggcttcctggcccannagtgcttgngngtgtgtncgtggnctgngctgcgantgagtgtancgatgtggtgttcttgcgacctggatgagtgaaagtggcgccgatctcgctcctcctgctcccaatctgctgngctgcggccacccatcgaccagnatcttcagaacctccagttgtttgaagccacaaaatnagaagtggtgtgtgaattgagtgagtgccaattggtttgcacgtgcaacccatggtgcagtgagtgtctgngtnngcgtctnaancagtcatttgacnctttgtgcgaatccnggcgagcattgtggttcangcanaatgtnttgattgattgctgtgnaattgagaagaccctctctgtgagccctatcccntctcactttgtgagtctcnggtnnttntgtcntcattggtgcatcccntatatctctccttcattnttagttgtnccggttcngtntgaanaacaccagctgctaanntgttctttagacccgtctgtgacgaaagcatccattacttccattaggacnacanantcttgccactttnaccaannatangacgtctccaaantnnagcagtgcaaggaaatnatctcgatcattggccagatgtggtgatgttgcatctcgttgaatganccggncgtcggtncacctctacnncnntgtgctgnancattggtgattncaaactcanattgtananctgcanagnactggnncacanctcccctctcnttttcacatgntcacnnngaccaccggctctntgcactgn

SEQ ID NO: 104062 - DNA, 304 bp, Triticum aestivum
  unsure (1)..(304): unsure at all n locations
  Clone ID: PAT_TA_104062
cagcttctccggcgagcgctcccccgctcctctccttcctatgcctgcgcgaacgaactcccatcccatgggggcttccgagtctctcctggccaggcagacgcagcagcagcagcgacctgcagtgggctggacgagatcacgacgtgtatccgacngngcctggctgctgactgcctgctgaactgaagaccctctcctcctgcctgcatcctggtcacttaccatctgcccctgcctgctgttgagctgtgtcatgccangctgtgctgtgtgctcngngaagaactgtgagaccagcttc

SEQ ID NO: 104063 - DNA, 603 bp, Triticum aestivum
  unsure (1)..(603): unsure at all n locations
  Clone ID: PAT_TA_104063
ggacagtcgtttgcaacttccctgctatccgacggcacagcgtgcagtttggcgacgcagccatggcgtgatctcccaacgccgtggcctgcntgcacctgngccccacccccttgctcctgcctcacccgcccacgccgctggggctctgtactccactgcattgacttactgctgaggagtggaggatagaaggtggcgcatccccgcggcgatgagatttgccgtgtgcacctgcagtctactatctttgttgctttttttttaagaaaaaggtcaaaagtgcagagtagtctgctattatttgctcttgaggttcagtttacatattgttgcaggaagaaagtggcgcaactcggttggacatcgcgttgcctgtttttgtggtttccatggacattctgcttggagggaaatagcctccctccgcgcagtccgccgacgcgtccatgcagtacgcgggtccgtgtgtgcagcccatgtaaattttgttcttttgtttgtgcagtgtggtgtgtgtgatcatgcagagtattggggtgaatgcagtttgcttcgattgtttgagagaaaatgtgaattgaaactgcagttcattttaat

SEQ ID NO: 104064 - DNA, 813 bp, Triticum aestivum
  unsure (1)..(813): unsure at all n locations
  Clone ID: PAT_TA_104064
acatcccgtgcacacaacaatcattcccccaacaatcccaacaatcacaacaaccttttgcccagccccaacaattatttcctgaactccaacaaccaattccccagcaaccacaacaaccattccccctgcaacctgcaacaaccattcccccagcaacctgcaacaaccattcccccagcaacctgcaacaatcatttccccatgccccaacaaccacaacaaccatttccccangccccaacaaccccaactaccatttcctgcaacaaccacaacaaccattcccccatgcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcaacaatgcaaccctgtgtcattggtgtcatccctcgtgtcaatgatcttgccacgaagtgatttgcaaggtgatgctggnaacaatgttgccaacaactagcacagattcctcagcagctccagtgcngcagccatccatggnnngtcgtgcattccatcatcatgcagaagaacaacaacaacaacaanaacaacaacaaggcatacagatcatgcnggcactatttcagnntcgtccaggtccngggcatcaatccaaacctcaaaaaacccagctccaanttggaggnngatccagggcacttgganttggggactcttcccacccngtncccntgttggccccctnatnngtccacan

SEQ ID NO: 104065 - DNA, 761 bp, Triticum aestivum
  unsure (1)..(761): unsure at all n locations
  Clone ID: PAT_TA_104065
nctgggaaactccgatccgagcgaagcgaaggctctctcgtctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctacgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctgnaggtggagtcatctgacaccatcgacaacgtgaaggcgaagatccaggacaaggagggcattcccccgtgaccagcagcgcctcatctttgctggtaagcagnttgaggatggcgaccttggnggactacaacattcagaagagtcacccttccacttggtgctcgctcgggtggcaanaaanctccggcatggagctgntnggnn

SEQ ID NO: 104066 - DNA, 442 bp, Triticum aestivum
  unsure (1)..(442): unsure at all n locations
  Clone ID: PAT_TA_104066
ctccctccccctanttccaccccggngcacgaccaactcatcccctgcttccacntccaggggatggcctctctccnccatgcttccnggctggnccggccncctcctctatgcgccatccgtccacatcgtcagttgccaaaacgagatccctgccactgtttgccaggacctcgtcngatgatctgtcntgagtgcaccagcgccaccatcgtccgacgcgcctaagcatagncccggctcccgccgaccctcatgccctccactcaccacngcganctgcgtgcttccccctacgaccactgcatgccgnacccgcgaggaaaccagnccacccatcgctccgagtcgcccgtgccaaatccagatgcagttcagggagtcttcctgctgcaggtcgcaccagntctanctacagngccgccgccatgacgattggaca

SEQ ID NO: 104067 - DNA, 671 bp, Triticum aestivum
  unsure (1)..(671): unsure at all n locations
  Clone ID: PAT_TA_104067
ggctcaagaagccaagctgacccacgncggcgccattatgactcccaccaccacgggagcaccctgtgccaacaactcgcccccatctgccgccgtcgtgcctgccgtgccggggacagcagcggcgacagcggcggtaacgtgacagccgacgcgggcttcctgctggagcacgcggtgcccaactgctcgccgtatctcttcgacggcggcttgcttagtgatgccggcgaggagcggctgatgccgagcgacgccggcgggctcctggaggacatggtgccgctgatggtccggcggccgtcgtgcaactcggcggccaccaccgccagctcgtcgacgacgctcggctcgcccccggcaccggtgtcctcgccttccccctccacgtcgtccgtgtcctggacccccgcgtcgccatacatcgacatggccatcctctccaacatcttctagccagtagcgtagtgtcaattggtccatcacgatgatcgatcgggagcaatttggctccaggaaaatcggattatctgtgcttgtgcatgcaagcgtgcaagatgcgcgcaggaatggtgtgtgattagtagtagtagtagtactattatactagctacaagtagtancatctagctagatagttgtgggttaatcccaaaaataaaggaggatnn

SEQ ID NO: 104068 - DNA, 909 bp, Triticum aestivum
  unsure (1)..(909): unsure at all n locations
  Clone ID: PAT_TA_104068
tgctgccctgctcctgcctgctgtgtgccctgctgctgcctgnctcgtgctcctgntgatggcctgtctcctccgactgtgctcaattgccngctgccctgcctgccgccgcgtatcctggctgtcacacngctgaagagtgcatttggagcttgtacgatgacatgatccttgngcctgtaacttcgagtgcacatgtgctgcacaaatgtcactacctgtggccaagattgttnttggtttcngtcccatctttcacacactgtgtgccagtgagtgcctgtctccacctgtgcttcatcaagcagcttgaacccaaccccgactgttgtcngtcagccacngtacctgtgacccacgtcccacagctgctgtccaanntgtgttgtccctggcacctgtgcagtcactaggncctgagctctttttgcgcnatgtgccactggcttgcttgncccgctggacatgtggttggtntccaatgncacatngttcatctgaaacccccacaanaccctccttgnangtgttcnntggccttncccattctggnccaacggagcaaatcaccccctagatcnaccnacatnggncacggccccgcccttatggccccggcnaaacgcnacaccggccaangaaacggctggcccccanaccgacanncaccnanancaccccgtnaacagggnggacccatgcaangcgccacacagccncgngcaaacaccacancngggccgacacacnnggcancacccgncgataaancaacaacngcgcccagacaaccaantnaagnggcnccgtgcaaaaaaacgtnggacccaccgnncagnctggcagnacaccnccccgacgaaacaccacncnnngcgcganaacaaacanacaanggangnaaaacgg

SEQ ID NO: 104069 - DNA, 916 bp, Triticum aestivum
  unsure (1)..(916): unsure at all n locations
  Clone ID: PAT_TA_104069
gctggatcggcacgaggcttctggtnttgcatagtanngttcacaatcaatcnctaaaaacacaaactttgccatgtttctcgccatcaatccacctcctggtccttgtcncgtaaccccctctctgccaactttgagagactgttcttgtacnttccagagaaatacaagnttatncacttacgtgtttctcagttnctcgcaatatgcagtatagctgctaatgcttcttcgttcttgtattgtatcattatcttgcatactgtaantttctacactttgaccagaagaaggngtgngagaggaagaaaccgcgcctgcgccgagactcgctgctccgtcattgagttgttccacttgtgatgtagccctccgctcccaccgttnacnttngttggttctcctgtggtattagcgcccataatcngagcngagctatctgcagctggaatcttngncgccctaccatccaatctgcagtggggacgatgtggaagtggggcttacggaggtccacgattgagcgctngatangcaggtcactggggatgntggcgtggngtanggggaaggtctngtnccggtttaattttggtgatanataatttgngcaggnntcggtggcaanaacttgaacnatgnangngngttgtgcntggtggaaagttgtagtnggttgttgtnatcacgganagcaaggnanatgnttgnttttctctaagaggagaaacntttantttaacgttttntgtgaataacgagncttggnccctccatntgttatttggttttcgatggcaacngaatgttgncgnggacntcangttactnttagggagggaaaggaatttnaaaagaaanttggcnnatcanatgnaaccaaaaaggggcaacttggnaggaaaangttggaaaa

SEQ ID NO: 104070 - DNA, 750 bp, Triticum aestivum
  unsure (1)..(750): unsure at all n locations
  Clone ID: PAT_TA_104070
nggtaacagaggatggagtcgatagcatgcnactgtcgtgatgttccccttcctcgccttcggccacatcagcccgttctgtgcagctggcngcgcaagctcgtcgcctgcctggctggncgtgctgggtcacgctgctgtcngtgcnctgcnggncaactgtgccctgctgntctgantgtgaccactgcttgtgtgtgccntgtgctgtgnctgtgctgctgagttgtgcgctgatgtgcgccctgcatggctgccatcccatgncngctgattgcctgtgtgtgcatcccnccctgatgtgtggctgcnctgacgatgncancnagtggccttagacgtgatcnatcttgtgctagtgacttgtgacntgcccnagatcgcnattgctccanagtgtggtcntngcccctgntcnngagctagtgcaaaacccaactagtgcncctagccangtgttgtgctgagctcccccttggnctcctggcggtgtcgaagccttcctcgcgggacacgcgcacgacaaccnggactctncncacttggcantgtngggtantgccggcggnaccatttaccnttcgcacnctcaacnccttcgcccgncaaatttgannggtcgnncttccgnctacngccaaggncncaanggccctttcccacgggnccatnnngtgtagtcctcggcaccntgncantnnttccgntnggtggnccanaacttccctccgaaaaannatgtggcngncc

SEQ ID NO: 104071 - DNA, 751 bp, Triticum aestivum
  unsure (1)..(751): unsure at all n locations
  Clone ID: PAT_TA_104071
tgactggtcagaggagattgatcatgcctgtcatgttatatgagaggatgaaagggctgggaaaggatgttcctgagctcataattttgcctgtgtatagcgctctgcctagtgaaatgcagtcaaagatctttgagccagctccacctgggaagaggaangtggtcgtaccaccaatattgctgaagcttctttaaccattgatggcatatattatgtcatcgaccctggcttcgccaaaatcaatgtttataattcaaaacaagggcttgattcattggtcatcactccaatctcacaagcatcggcaaaacaaagagcagggcgtgctggccgtactggaccaggcaaatgttatcgtctatacactgaaagtgcttaccgcaatgaaatgtcaccaacgacgattccagaaattcaaaggatcaatttgggttctacagttcttaatantgaaggcaatggggataaatgacctactatcgtttgattttatggaccccccagcaccccaagcacttatctctgctatggaacagctttacagccttggcgctcttgatgaggagggccttcttaccaaactgggcagaaaaatggctgaatttccactggatccancantttcaaagatgctantagctagcgtcgaacttggatgcngngatgagatatgactattaataggatgattcaaangggggaatantttcnaaaagcntaaaaaaaaanggtncantgatnaaagggc

SEQ ID NO: 104072 - DNA, 834 bp, Triticum aestivum
  unsure (1)..(834): unsure at all n locations
  Clone ID: PAT_TA_104072
acgagaagactttctcatccttgccctccttactatcgtggcgacaccgcacaactgcagttagagttccagtgccacaattgcagccacaaaatccatctcagcaacacccacaagagcaagttcctgttggtacaacaacaacaatttctagtggcagcaacaatcatttccaccacaacaaccatatccacagcctgcaaccatttccatcacaacaaccatatctgcagctgcaaccatttcctgcagcctgcaactaccatatttgcagccacaaccatttcgaccacaacaaccatatccacaacctgcaaccacaatattcngcaaccacaacaacaacaattacctgcaaaaacaattcccccaaccacaacaaataccccaacaacaacaaatcccccagcaaccacaacaattcccccagcaacaattcccccaacaacaacaatttccccaacaacaatgaattcccccaacagcaattccctgcaacaacaattccaccaacaacaattacctgcaacaacaantttccccaacagcatttcctcaancccaacaaacattcccccatcaacacaacaacaatttccccagcccagcaancacaacaacatttccccagnaaacacaaanaacaatttcccagcccaaaaacanaagaacatttcccaagnaaacacnacaanaattccccatggcccanaacacaanaacattcccagncnaaaanccaaattacatttcggnanaacanaanaacaatncccaggttaaaacccaaacattcccagtagganacatnatnaactgttttctcatgagnnc

SEQ ID NO: 104073 - DNA, 550 bp, Triticum aestivum
  unsure (1)..(550): unsure at all n locations
  Clone ID: PAT_TA_104073
ctgcgtgagtgcaactgcgtggtgcggatccggctgcaagtgcggcaacggctgcgngagtggtgcaagatgtaccctgagatgngacgatgtgnggtgaccaccactcccanaacctcatcatggtgcgtcgcccctccaagtggcaccccgtcgttcgagtgccgcgncgagaacnggagcgaaaacngtgcngtggtgcaagtgcngnggtccaantggactgaaacctgtgcanctgcaagttgatccatcaaatcaggacaaggangattnggattnngnatgngattntgactaatgaagtgagcanctagtagtagttattgcatgggtgtgtgcgttatgtgttctctttttaaatttgccgncgagaataagacgagatctatacggatcgtatncgtatcggtatcgagactaattcatgggncccttgtgggcttgtaacggtgtggtgttgcaaanggcgcgcgtaacgtacctgtgtctgtgacgcgccttttcctactgtnctaaaactcctgtaccgntgccttcccgtnantcg

SEQ ID NO: 104074 - DNA, 709 bp, Triticum aestivum
  unsure (1)..(709): unsure at all n locations
  Clone ID: PAT_TA_104074
caggcgcgcacgangtcgtcgtggcttctctggagaccttctcttccactatcctcacacggtgcactaaccctaggttcctccgtactaccctatgcttctcgcactctgcctccgcccccgccctcggcgccgcctctcttcagccaaccccgcctcctcctcctcctacaacctgctccagcgatggaggtggcgggatgaggtgggagtctacgcgcaagaagagagtcgtgctccgcgtcggctacgtcggcagcgagtaccgaggtcttcagaagcagcgagatctcagcgcggactcaaccattgagtcagttttggaatctgccatcttcaaggcagggggcattcttgagagtaattatggaaagttgcaaaaagttggttgggaaaggagcagccgaactgataaaggggtacattcactggctacaatgatctctcttaagatggaaatccctgatcgagcatgggagaaggatcctgatggcattgctcttgcgaactttattaactcaaatttaccagataatatcaaagttttcagtatcttgcctgctcaaaggagttttgattgtaagaagggaatgcttgtaccgggagtacttctatcttctgctgntgaaataattggaatttaaagcagttgtatctggganaaattggnngancnntaattgatcatattntgnaggtttgggaancc

SEQ ID NO: 104075 - DNA, 804 bp, Triticum aestivum
  unsure (1)..(804): unsure at all n locations
  Clone ID: PAT_TA_104075
atcgaactccccatnggctggatctacccattccctgtcgtcatctggtcccgtgcctgccacctgccgtcgtcccctcgcctggagtcctgcggtcgcaagtcgcatttggcttcctctgcttcccgctcgcctgctgctttgcatttgacctgaagctgtcngccctgcttcacgaaacgaatgncngcccttgtttgactttggtccagatctagctgagcctgagcccagcagcctggnctgcccagttccttcngcctcgctgtgggcctccttgcctctccaattgcccagcctgcctggctctctcctctccacctgaactgggccaangcccatggtgtgatcctcacttgcttgcgccccctcccacttgtttgtgngccaaccagatcctggccctgagatgtattcnnctnnncttgcagaactgtnaagctanatttcctgagntactaccctgttnttgcanaatagtccctagagttcatgcatncnantaactcacaaatggtgcntcggattaaaacaattnaaatatgtaacaantgcttanaattcatatacgtatcataatattgtcttntncacccatgtnctaacncttgttcaccncntgcttgcnctgtgtaactnttgtacanatgccatgctnaaaattggtnaccnncannnaactnaactnaccgganctcattnaacanacctcatntcctggggccacatcccacancccctggncacntgctngatgcatacaaccaaaaaatggtantgccaacgcaccaaccnaaacacann

SEQ ID NO: 104076 - DNA, 708 bp, Triticum aestivum
  unsure (1)..(708): unsure at all n locations
  Clone ID: PAT_TA_104076
accaacttctccgcaacagccaggcattgcaacaaccagcacaatgtgcaacaaccagcacaatgtgcaacaatcagcacaatgagcaacatgccaggacaatgctgcaacaatcagtgacaatggcaactagtgtactacccaacttctcctgcaacangccagngacaatttgcaacaaccatgcacaattgtgcaacaattgtgtactacccaacttctccacaacatgtcatgtgacaattgtgcaacaattgtgtactacccaacttctcctgcaacatgtcatgtgacaattgtgcaactatgttgtactacccaacttctcctgcaacatgccangngacaatttgcaacaaccatgcacaattgtgcaacaattgtgtactacccaacttctccacaacatgtcatgtgacaattgtgcaacaattgtgtactacccaacttctcctgcaacatgtcatgtgacaatntgtgcaacaatntgtgtactacccaacttctcctgcaacatgtcangtgacaantgtgcaagcaagccanggacaattgacaacagccaagacaattgtgcaacaattgtgtactacccaantttctcctggcatgcatgtcatgtgacaattgtgcaaacaacccatngaccaacntgtgcaacaannngantactacccaacttctcctgagcagtcnntgacaanggca

SEQ ID NO: 104077 - DNA, 733 bp, Triticum aestivum
  unsure (1)..(733): unsure at all n locations
  Clone ID: PAT_TA_104077
cctccccctccccctcctgcctgcctgtcccctgtgatgtgtgatgtgctgactgatgtgatgtgttggagatgtgngccatggtgtgattgtganctgtgctgtgcatccctgtgtgaacatcctggctgatgcttgctttgctgcctgctgtctcctccctgctgcctactgtgcncanttgctgcctgccaccctcnatggatgtcngctctgactcccntctgcctactgnactgnttgtttgtgatgacaaacccnattggcatgtgtgaacaacatgccccnaatgcccatggtctcactgttgcttgtgcntcangcaaagcagcaccacantccaaacttcattgtgcaccaaattggcaacaacccctgncaagtggcacacccctgccagcttgcacacgtccccgcaaatgtgtgncaactttgtgcacattgcttttncttcccacacangtgtgcangttgtgtgtgcntcccactctgcaacgcttcttggcgtcgaactacgacatcccaccanactgctcaaccttcccttgtnccttcccacacaccgcttttcanacnccatcgtgtccnngntncngcacactgaactccttccaaccatgaanngctggttgtaaccttggtgactttgntcntnctgnaaaaanaaccngaanagtggcatttgnaatttgccttnggcnccacccacntgagcntaaacctttggnctgng

SEQ ID NO: 104078 - DNA, 563 bp, Triticum aestivum
  unsure (1)..(563): unsure at all n locations
  Clone ID: PAT_TA_104078
acaacaactgattccatgcatggatgttgtattgcagcaacacaacttagcgcatggaagatcacaagtttttgcaacaaagtacttaccagctgttgcaagaattgtgttgtcagcacctatggcagatccctgagcagtcgcagtgccaggccatccacaatgttgttcatgctattattctgcatcaacaacaaaagcaacaacaacaactatcgagccaggtctccttccaacagcctcagcaacaatatccattaggccagngctccttcctggccatctcagcaaaactcacagngcccagggctctgtccagcctcaacaactgccccagttcgaggaaataaggaacctagcgctacagaccctacctgcaatgtgcaatgtctacatccctccatattgcancatcgcgccatttggcattttcggtactaaatgagaagaaaataactctagtaatagatatatgaaaaacgtttncttatcatggtatgggcggntgtaangggtgaaaaaatatgtganatggantaacatgttagaaccgaaatatatta

SEQ ID NO: 104079 - DNA, 650 bp, Triticum aestivum
  Clone ID: PAT_TA_104079
ctcttttgaaaatctcaggcctccagaaaggaaaatctgctcgagcagtccaaacaagctgtcagaagagctcatcaagctgacggtgaccatcttccacaagctgagcaggacaacggatcatgcagacccagagctggagctgagcagcgcgccgaagctcaacatcacctcctgcataggctcctccagaagcctcgcccccaagttgtcctcgtcgtcgtcgagcgaccgtgcggcgccgtcgcccatccgctccgtcaagagccgtgcagcagcgcccctggagtgcggcggcgacgaaggggagccggccggccggtgcgagaggttcgtcgagttcacccggagctcgttcgactcgagccgcgtgtggctgtgcctcgctgacatcaagaacttgagagtgctgatgaacaagctgtgcaccgtggatccgagcttcctgaccaacaagcagaagctggccttctggctcaacatctacaacttctgcgtgatgcatgcatttcttcagcacggtctgcctccatcgccggacaagctgctggccctgctgaatcaggcttcagtgaacgtgggaggaagggtgctgagcgtcctgtcgatcgagcgtctgttcctcaggcacccccctgatgagggcaaca

SEQ ID NO: 104080 - DNA, 711 bp, Triticum aestivum
  unsure (1)..(711): unsure at all n locations
  Clone ID: PAT_TA_104080
tgatcggcacgagagaagatcactgagtgcgatgaagctggtggctgccgccaatgtcctgtcgcgcgcagtgagtgccgtggtctcctcccgccccttctcggagtgctctggtggagtgtgctctacaacatgaaccaggagatccagtcggagngacatngactggccctcaaccgcancngcgccgtcaagcgcgtcgcgatcgtcgtcctcacctggcngagcgtggctctgcggcngccttcaacaacaacgtgctcaagaagtgncganntgcccgcatggaggacctcaggcagctgggcngtnngactacaccgtcaatcagcgtcggcaagaagggcaacgcctacttccaggtgccgcngactacattcccancgagctgcttcctcgangtgtgtggtgtgccctngtaaccaattcgccctatagtgagtccgtattacaattcacttggcctgtcgttttacaacgtcgtgacttggngaaaaacctggctgttaccaacttaatctgccttgcagcacattcccctttctgccagctggctgtaatagcgaagagnggccgancgatcngnccttccaaagttgcgcagnctgaatggcgaatggnaaattgtaagcgttaatattttgttaaaattcgcgttaaatttttgttaatcagctcatttttttaaccaatanggcgaaatctgggaaa

SEQ ID NO: 104081 - DNA, 580 bp, Triticum aestivum
  unsure (1)..(580): unsure at all n locations
  Clone ID: PAT_TA_104081
gcagccgcggcatccatggcccccaagggcggagaagaagccggtggcggagaaggccgagaagacgacggcggcgaagaagaccaaggccgagaagcggccgccggcgtccaaggagnggcggcngagaagaaggggaagaagaagtcgaanaanagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctccgcttagatagtctgttcctgtcttctttgtcgatcgatggtactctgtaatagtcaggtgttcggaccatgtcgtcttgtaactgtttcattatcttgtgaaatagtaatggcgcttctttgaaaaaaaaaaaaaaaaaaatcgagggggg

SEQ ID NO: 104082 - DNA, 645 bp, Triticum aestivum
  unsure (1)..(645): unsure at all n locations
  Clone ID: PAT_TA_104082
ggcagcacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttctgcagccgcaactaccatattcacagccacaaccatttcgaccacaacaaccatatccacaaccacaaccacagtattcgcaagcacaanaaccaatttcacagcagcagcagcagcagcaacaacaacaacaacaacaacaacaacaacaacaacaacaaatccttcaacaaattttgcaacaacaactgattccatgcatggatgtngtattgcagcaacacaacatagcccatggcacagatcacaaggtttttggcaaacaaagtaactttaaccagntgnttggcaagaaatggtgtggtcagaacctatgggcangatcccttggaagcaaggtncggccagtggcccagggcccattccaacaaatggttggttncaattggcntaatttaatttcntggcattccaaaccaaccaanaaaacaaagnaaanncaaanaaaccaattccgnaaggccacaggtctttccctttccaa

SEQ ID NO: 104083 - DNA, 866 bp, Triticum aestivum
  unsure (1)..(866): unsure at all n locations
  Clone ID: PAT_TA_104083
gagggcgacctnncgtgcggcggctgttggcggcgagggtggtggtgatggttcggggttgcccctcgggttccgatgtggatgtgggctgccacggcgtggtggtggcccatggcggtggtctgggtcatttcacggcggcggctggacttcttcggcgtccgcttgtcggtgagcggtcttggcgaccttcgattcctctccccgtcgttcgggcgctaccttcatcgaagggttggccctctcccagcggcgcccatcgcccgtctcgcgcccggcggcaagaccgagctcgtctcgcgcccgacagcaggaccggactcgtttcgcgcccggcagcaggatcggactcgtctcgcgcccggcagcaggacctgactcgtctcgcgcccggcagtaggaccgagctcgtctcgcgtccggcagcaggacgggtcgatggtggccagttttggccggtctatcgggtctcgacgctggggactgctcaggagtgagaaaggcggttcctttccattcatctctttggttgaggtagcggtgggtggcgggtgaggtggcgtcaaggtcctaatgctggggcggggccctggtggtggtgtnccggtgcttttgggcaanccccgtgacttgtgctgcctgtggccatgccgtgtggcggcgtgtagcaggtgtgcgtnaggtggnggggacaatggccggggtnaaanccgtcacactccgaattaccgggaaaggaancctacctcttnnanggntcncaanccctcgnnntcccgaggaaanaaacatnncnngggggcnnngacaccttangacncctgtacacgagnatatacccccgggcananccacnnctacaggng

SEQ ID NO: 104084 - DNA, 648 bp, Triticum aestivum
  unsure (1)..(648): unsure at all n locations
  Clone ID: PAT_TA_104084
cgnacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagncagtcaggacaagggcaacaaccaggacaagggcaanaaggatactacccaanttctccgcagcantcaggaccaagggcaacaacaggacatgagcaaanagccaggacaatggctggaa

SEQ ID NO: 104085 - DNA, 1146 bp, Triticum aestivum
  unsure (1)..(1146): unsure at all n locations
  Clone ID: PAT_TA_104085
gaancagcngccttcaaccaaaaccactttcgaccatngctggtatatactaaagggacggctcttctgaggaangactgntaatatnctggagtaggacaggtggatngggtaacgagtgactggcggtgaaactaactccaaagaacgngaaaccctcatanggtgtgttcttgntattgcnantngcaaaaantcncttcgcctgtgcctgaacatgaacggatntaaccgaaaaggtcgagatggaggttagtcgctcaangttagtgtggngcgctctccgancatcgtctccancngcgtccatcaacacacgcacttgttgcgctcnctcnggttgtgcgatgcgttcatgcacancacganagcggtgttttccaagangcacccggtgacncanacccaggcaatcngatnctacatgatctcatnacnggtgctactggtgtcgtcatctaatgctacaatgtcaatctcctccgtctgtgtgnaagcaacgcaacncacaantgcccgactagaccggcgatctcagacactaggatgggtcgctgagctcncaggatcacccttgcgttcgagnctcagcaacaggaacgtntaaancccctgagacgataatgcacgncgcanctaaaataatgccacgtgntcccagccaaggcatggaaanccantcctggcagntcncacnaatncgttcnaaaagtggtgccagntacactagtgcgggacaccacaaantgcccaacagnacttcgnncctgaactaaaaatcacaactggnccttccatggactcgggnaaagccaggaatgaaccacactcnaancacgtgacctgnagtngngcgncnncccccggntgggtcaactggnnggcccntccaagcaangcgcatgntcncnccgggcnactaatacntgcatcancgnccanggcatggacacnaanncantggagcnnnccgcgaatccacctgcccacngngtgncgttgaacatctgcgtgcancaaagaacngaaangcnaccngncccanacancgtccncangcggggnacnnaccaaaacaacnncncaaancaaccnaannaacccngnggacaccccngaanacgacgccacaggccccgcgnnaaa

SEQ ID NO: 104086 - DNA, 800 bp, Triticum aestivum
  unsure (1)..(800): unsure at all n locations
  Clone ID: PAT_TA_104086
gtgctgtgattgtgctgcaagcaagctgctgcccatctgcacctgtgaacagcctgctgtctgccaantgatgcctctcctgaccctgctgatgtgatgtgtgcacctccntcgtgnctgtgnctgcctccaacacccntcccctccctgactgtgactgtgactgtgtgctgaccactctgttgtccctcacantgacacctaccacattgacaccctgctcgcactgtacacttctgnngtgtgactgacttctgtggctgtnctgtggcactgcctgcctgcantggacactggttcacncctgnntacacntcattnctgannacacncctgtgncacctggnctcccanacacctcnttgtgtgnttggcccnntcactggccacacnatgntttggctacnctatcatcgacattttgcngatttgncataccccttacacacnnnctggncanncttggcctacncacacctgttgggccccgtntgtgtngcctgganttcccccacatgacanccccnttacancacnanctangtacactcgaaccacntttggtgaccaccactggcccccttggacctttggcncacatntnccaccggtaaccctgtggacancccttttggtgnatntnccannnannangtagtttggagcnnttatggttgcaacattaannttttantaccacatgancntgnaaacatggtggaaccttaacttgcgatntgngttataaacgccaccatggtatntggttngtgnttttggacccttancgttatgtggag

SEQ ID NO: 104087 - DNA, 830 bp, Triticum aestivum
  unsure (1)..(830): unsure at all n locations
  Clone ID: PAT_TA_104087
ggacagcaccaangcgcgcaggctttgactccatcgcctctccctcctcttcgtctccggccggccaggtagttaacagctccagcagccatggggaaggagaagatccacatcagcattgtggtcattggccatgtcgactctggcaagtcaaccacgaccggccacctcatctacaagcttggaggcattgacaagcgtgtgatcgagaggtttgagaaggaagccgctgagatgaacaagaggtctttcaagtatgcctgggtgcttgacaagctcaaggctgagcgtgagaggggtatcaccatagatattgctctgtggaagttcgagaccaccaagtactcgtgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcatgctctccttgctttcactcttggtgtgaaacagatgatctgctgctgtaacaagatggatgccacatcccaagtactcgaaggcccgttatgaagaaacttgtcaaggaagtctcttcatacctgaagaaggtcggtacaacctgnacaaggttcccttcgntcccanctcngggtncgagggcgacaccntgatcgaaaggtcacaacnntgcttggtccaagggccccaccttcntgaggccctggacanaataatganccanaggccncgaaaancccgngntncctcnanaagncacatggcgcctggancggcncgggnngtnaaga

SEQ ID NO: 104088 - DNA, 482 bp, Triticum aestivum
  unsure (1)..(482): unsure at all n locations
  Clone ID: PAT_TA_104088
ggggggcgccgntcccgccacagttcggtccgagggaagaccccaatctaccccaccggcggcgcggntgcgaacctataatggcgcagtcgtgagctgtacggtccgctgatcgactgtcggcggcgcggcacgtcggtggattcgtacagctcctggcgtccgttcgccgtgtccttccccaccaggagcaaaatgctgcaaccggaaggacgtatcacagagttattctggaggttggtgatgacacgaggtcgagcttctccgtctctctatggtccaacactactagctcgacgatatcgctggcgatgttttactgttgcagaatattaagatagtagagtttagaaatggcttggagggaagggctgntcagatgtctgcagtccaaattttgatgaactctaaagatttagtgcaatccgaaggaattgatgaattcataattaattgtaaagtcggaatgctacaagatcaaa

SEQ ID NO: 104089 - DNA, 749 bp, Triticum aestivum
  unsure (1)..(749): unsure at all n locations
  Clone ID: PAT_TA_104089
gtttgacaggagactagtctgagctttttaananaaannaaggtaactaagtgcatgacataacgttaagcatattcggatacacacntaacaaacnagcataattaattcttgttcaaggtnaataataggacttggaaanactttagtgttcaacactaaacaaaactggngacttgnaaggacnggnacacagctntaggtcgctccgaaacaaggccctggaaaattcaccccaattctccgacncaatcctganttccgtcctcggtgctcgtccttcttcgtccgtccntccttagagggcagcggcgtgcagctaccaccgtgaggcatgcagccatgcaggggcagacaacggcaaacttgctcgggtccgtntggaggtactccgttgtatccttatcgggcgatggtcatagtgaagtaagtcgtgtcgtccaatagcaaccgctagagaacattcattgtatgcgttgaggaacagtgtgcaggcgcancagcgcatggtggggtatgangaatccgccagggtacagtgaggcaaccattggaaacaccagaaagcaanagcttgtccatcaggtcttcctcagtaagngtcaagaacctcagtggctganagacatgacccactgctcatagacatttgcagatgaccagtccatatcgagaaggggcggatacncaagcttggcaagcaggcagactcagaggagnccacttgtgcacccttcttgatccangnt

SEQ ID NO: 104090 - DNA, 757 bp, Triticum aestivum
  unsure (1)..(757): unsure at all n locations
  Clone ID: PAT_TA_104090
anaaagaatagctcgctgaactcaacggcggcgtgccctctgcctgcccctccggcgacggcggctggctgctacaaagcccgcagctttctcgccccccaaggtcgaccttgacnggattagatcttgacacaggtaatatccgaccttcaaaaccttccgctgcttcccttctacgngcgccggcagacgcatctctgacgcctctcactccttcatcctggcngttcctgctcgaaacactacaaaaagagctatgagaacgatcctgccggaagagacaaagaagggcttggataataagcccaatgtcgttgctgcctgccgccgccgtcgtctctgacggccagccccccaaaccgttgaagaagaagccggtcatgaggcccagcgaccccaccagtgctggcgtcaagcgcccgccgtctgaccgccaggaggagatttgcctccaagaagaaaatcaagctggacaagattaagactctggccgccgacaagaaggccgggctggagcagaaagtcgtcacctgccaccgagctgcgggaggcgggacgacggcggcggctcagctgcggcgggctggcatgaacgtgcagaacggctctggcgngcagccaagacagaagtgtgccagcggcagcgacgcctgtgaaagaggacgccgtcgncgacaggcagctgatgatgaagctccccgctgaaacaaccaccgctgccgncngtggacctcccctcaagcnaanaacgacncag

SEQ ID NO: 104091 - DNA, 790 bp, Triticum aestivum
  unsure (1)..(790): unsure at all n locations
  Clone ID: PAT_TA_104091
catgtggttggcttctcctccccactcagtcctcggttccctggtcctggtccgttcctgttctgttagtggtttagtagtagctggngaagagngaatgaatggcnggactgtcgagtacctgctgcttcgtcgtgcgtgcctcgcctgtgccacctgacgaccagtccctccagaactgccttctccaagtactgtgctgactgtcatctgactccaagatcatcacttgacatgtggangactgtggcctgatccctgctgtgtgtttctgtgtgttcngtcaccctttcngcngtcngtgactgaagtgctgaattgctgcccangtgctgaatctgatgtgccattgaactgtgccatgngacctggactgtgcctgcaacatcacctgtcaactgatgtgctgcagtccctgtctgctcctgtgctgtgangtgatgtgctgtgctgtgctgtgcntttcngtgctgtgctgtgctgtgnttgtgctgtgctaactgtgtgtgtgcccatgctgcctgtgatgtgtgctgtgatgtgcttgtgctgtgctgtgctaacnngtgctgtgctgttgctgtgctgtgctgtgctaactgtgatgtggttgtgcccctgccagctgtgctgtgctgtgctgtgctgtgctaacngatggcangcctgttgaactgtgcagtgcntgtgctaacagtgacgtgctgtgcntgtgctgtgctgtgctgtgnctaactgnggcaggccaatgcccgctggagacgagctcccctgtgctgtggcntgggca

SEQ ID NO: 104092 - DNA, 1245 bp, Triticum aestivum
  unsure (1)..(1245): unsure at all n locations
  Clone ID: PAT_TA_104092
aaaancntcgtctcttccatcccntccagnacgtctccatggaattacagagatggaagattnactcctgcgnctgacctacatgtgcattcnngagcctattcgacgatgtnaaaggccaaancantgactcgttgctntgctgggtgaaaatnagnnntnnnnatactctgctagctgaantancgcattgcgatcttggttgcttngggagtatncngaaaatntagccatcccaaatcgcgaggtccgctccngctccagacagtcacgnttcagaacggnnacgctacattcaatgancacaaagctagcgcaagcngctgctactccacaaaatgcattcagtgtcgttngaatagccatgtggatagggggagtttgagggatcagtgntcacgaaatngagacatacacgaacaacctcgatgncccngtntcatcttctnnaaacnacgtggtaagcgngattcatcgagtgagagttgagcaatacggtncctaattcgtnggctacgtccatgagtcgcgaaagcgtgagcctatntagagggatccacgcgttcnancncccnatnggcccgtactccaaacacnagtgcgaanagggtccgggcgcaagcctttaccaataactncgcnaagcaagcgtacgtactnccataaagtggnaccgccacgccatggtgcgatatgccatagttngcatccccttttgnttcgccctaagttgtgngntcacaaggatcccgcctaaggaatttgtaacgccnttgcctttgntatttgggcganngggcctatagggggaccnnttttnaccacnactcaattgtgatatccntgtggctngtattggactttanagtaccacnagganctcgaanngttannatgntaancgatcgaaccgatgnaataatatcctttccctcgaagtgnaccgtatctagtagtgctgtcncaatgcaaggttggccaggttcctcncagagccagatactattgaccccctgcacttccatcnagcnttgtggnnagcctccatcttcgcnctccacncgtgtgctncancggagtgtggnccatttgnnnatagngcccatgganatacacttccnncaagnttngggggncccnctnttntancaaannggggtacagancgtnccaccccggacnntatancncancgagggccacacagtagctnngngcacnncgnaccggnaganccccnnatgg

SEQ ID NO: 104093 - DNA, 890 bp, Triticum aestivum
  unsure (1)..(890): unsure at all n locations
  Clone ID: PAT_TA_104093
ngggaaactccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccngcacccttgcggactacaacatccagaaggagtccactctccacttggtgctcaggctacgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctgnaggtggagtcatctgacaccatcgacaacgtgaaggcgaaatcagnacaangagggcattcccaccggacagcagcgcctcaatcctnnacgccnggggtaaagccangctntcgagagatgggcacgcacaccntgggcggactcacaacactccngcaaagangctcaaacccttcaacntggggngccccagacacccggggtcggccccaaaaacnccccgncangggnagncggcanagggacnnggggcnncaannncgnacaccngngccnccaacgacagcgnacaanacgccggccgccaacanggntgggcncaaccgnacanan

SEQ ID NO: 104094 - DNA, 800 bp, Triticum aestivum
  unsure (1)..(800): unsure at all n locations
  Clone ID: PAT_TA_104094
ccggtgattcccgacgggcattgcatgggagagcggcgattcccggcgtgcacagccggagagagngggcgattcantgtggttctggcagacaacggagtgcnggagtgcccagtgacgagcttcctgagacagcgccatggacgcatccgcgagtgggcngacacgatgngtctcctccccgactgtgctgtcctctcgtcngngctgaagagtgtgactctgccctccactgtgtgatctcgcctgcagtgtgangtgatgtcgcttggttgtgatgtgtcccttgctcgctggagtgnggagctgacgacgaagtccccatgaattttgcagatgtggagtgggtgtgctgaattgacctgtcatatacangcaattgangtgctgtgntgcatgcngcatatanttgagcgcacagangacacngaagncttggatgtgcccctccctttaaatttttgcngcattgctcagcattgctcttccacngncctgaacgacgtgacagnngangtgnccctncattcctcttcctgagatcgancngaacgaaannngacggcgcaaagtgccagaagtgacngaanttgtncgagcaaccaacattgggtacaggcatgaacngacngtgnggcacatgtgcctcccgacctgcntcactgttggactcanaagncaagaacaaataagnaacancccanntgggaaagctagaaacntnnncncaanagaaannnaacntnagctaacaanctanggggancgggngnaancncaaaaanaaccaccaaaagcaa

SEQ ID NO: 104095 - DNA, 974 bp, Triticum aestivum
  unsure (1)..(974): unsure at all n locations
  Clone ID: PAT_TA_104095
ctggatcccatcgctgtgactgctganctcgccgcgcacgcctggcttcttctccttcctgtctccttgcccgtgtccagcgtgcacctgccggcccacccatggctgctgtcacctgctggncacccacttctcctacctccccacggcngaggctgtgcctccacctgccgccgctgaccccatgcctgtgcatctcctgtgctgtggctgcctccccaccacctgctgctaccccatccctgccctaccccctactccngtcgccgctgnctggngctgngacctcgatttccctacatggaaggaagtgggttctncacctgtctactgtgtgtgaataatgtgccangnggagaacttgaccgtgtgtcattgccgtgtgcacctgtgttgntattgcgtagncaagctaagtgtgctgccngcctgtcgaantatatttcaagtgacgacttgctgtgccccntatccaccctgagtccaaaacttgacagancacaanttgngncanngatantgtcccaaacacgtctcgntacattgttgctgcngccaagntcacaatcncatatgantntacaacntaccagacatccagcccatgaccaagagtggttgatgannnnncacacccctgacccccacatatcaaccaacctcantttgntttngcacgatccncnttnttcccccaggcaaanccngttcgcagccagaacacagcctggggcgacacatagaanntnaagaccnnnaaaaatttgggtcaaacctcagggncatggattaacacnagataccnttaagnntttcncaaaccntccaaagtngngatggttgganctacattacaatncacaacnnggncactatancacacatcncaccnngagantgaggaaaggaccnttacaanatgttgggnaagcccncnaacnnttaaaaatgncncacaaaaanaacagnccacc

SEQ ID NO: 104096 - DNA, 875 bp, Triticum aestivum
  unsure (1)..(875): unsure at all n locations
  Clone ID: PAT_TA_104096
gctggctgctcgttgcctgtcggcctcaacctcgccttctccgccgtcgccgcccaccgccggagtgaagctggcaagagcttccagtgtttagtgctgcagtgtcaacctctcagcagccgaaatcaagagatttggctgacctggattatttgctaagtcaaagtgaaacatatgatgcctgtggccgcagttcccctagatnaagtgtcaacttcgctaatgcaatttgcaccngttggcagaattagatgctcagcagtttcctctggttcaatgcttgttgttgctcccaaggatggtgtcaccatccgaagatatatgcagggcaagtgctgaagcagaaaagcgatttggattcccactttctgctgtgcaggcagctgtgaagatgtgtaccgtgttgtaaaggntttcacnggagagagatgaaagaataggtccagaagcaacaagatttgtccagtgctggactaatctaagttccttgtagatgttagatccaagnctgaagtagttcatagaactggntaattattgattcctttnanggatngagagtatatagtggccatgcanatacagcagtgttggcctanantgggttgaaccccagaagncatngcgaatggctnnnctcnccccacntactgggtgaccngtcancanagntgnangcnncaggacaaaacaaacccaacanaaacncacntgtcgcnctaanncccaccncnacnacacnccnnactcaccanacagacagcatcncnccacancnnnanacancnaaacnacncaccaccncaagcnctcaanacacgnnngcgnnccanngaaacaacnatcaagnnngcagnaacanncanngcactcaa

SEQ ID NO: 104097 - DNA, 588 bp, Triticum aestivum
  unsure (1)..(588): unsure at all n locations
  Clone ID: PAT_TA_104097
cacagatccatctccgtcacccctcagnccccanacacccacggcgncaccccaacctctccatccctatctgatctcgatcggcctgctctccancgccgctcggctcgccggagatagaggcgtcgccgccagaacacggtggcttgctcgccnggcgagcacgacgctccatcaagctggcctggactagtaattgcttgttagatccttcgagagcaatgggagcagngcaatgatagtcatggngtacccacccgatggccaggngnggataccctctggcagggtacccgccgcagcagggaggttaccctccacagcaaggatacccgcctgcacctggagcttacccacctgcactattaattcaccaatgattcttaagttctacctaagctcaaggtgaangaagtgccatctgagaagggcaacaccgangngtgcccagaatctatntcagacaacgccatctgcaagcgcactgagcacatgaactacctccgctcgncctcccgaatcgncccatatgcccatgagtgatatatactacttgcctgctgcatgtatcatantgcttaatntnac

SEQ ID NO: 104098 - DNA, 606 bp, Triticum aestivum
  unsure (1)..(606): unsure at all n locations
  Clone ID: PAT_TA_104098
ncggcacgagccaactantagcacaagcagaaaatcaaagtacgtagtagttaacngcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatcttggccacaaagcngattgccaagtgatgcggcaacaatgctgccaacaactagcacagattcctcaacagctccagtgcgcagccatccatagcgtc

SEQ ID NO: 104099 - DNA, 786 bp, Triticum aestivum
  unsure (1)..(786): unsure at all n locations
  Clone ID: PAT_TA_104099
tccatgccaacccacgtcgcctcgccccacggcggccgcgacatggccatcggcacgcttttcctgtgcgggagctgcgtcagctacgcgctctggttcgtcgtgcaggccaaggtcgccaaggtgttcccgtcccggtactgggccacggcactcacgtgcgccgcgggcagcttgcagtctgccgtggccgcggccgtggcggtcgtcctcgcccccgccggcgacggacatggatgggcgcgcacgtggacgctgcgctgggacctgcagctggccacggtggtctactccggggtgttcaacacgggcgtcacgttcgtgctcgtgtcgtgggcggtggagcgccgcggcccggtgtaccctcccatgttcaactccctgtcgctcgtcgccaccaccgccgtcgacgccgtcgtactcggaaccgacgtgtacctcggcggcgtgctgggagcggcgctcgtcgtcgtcggcctctatgcgtttctgtggggcaaaagcaaggagctcgcggccgccaaagcggtcaacgccgagcaggagctgcggtgtgcaggagacaccgacgatggcattgcctaacgattttatccagcttgggtacagatatcgatggaattaattgaactattgagccgtatgaatctgtgatcacatcgcacacagttcattcaatgtgtccgggacatnagaatgganaagnnatnaangggaacngggnaattngtcaaaaaaaanaaaaaaaatncggggggccgganacaaatgccaaangagtntaaa

SEQ ID NO: 104100 - DNA, 590 bp, Triticum aestivum
  unsure (1)..(590): unsure at all n locations
  Clone ID: PAT_TA_104100
atcggnacagatcgcctcgctgcgctgcatctcgtctccaccaccccacttgccccggaccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcg

SEQ ID NO: 104101 - DNA, 800 bp, Triticum aestivum
  unsure (1)..(800): unsure at all n locations
  Clone ID: PAT_TA_104101
gaatgncttgcntgctgccntgatctgtgntcnctgtccangtgcccacacancatcctgcactcccccctgcatcatctctgtgtttgcctgantacttgctgacctgcagctgtcagcatctctgaaactgtgctgntcatccccaagaatgacctgnncctcctgcccctgtgatcctcactgtgtgtgtgcactganctctccctgntgtgtgtgcatgcanntngacaacaccaaatgatacaatgcatcctgctgaatgtgtgtgaatatggtcctatcatcatgnttntgcctgttgtgcnnaccatacaaanacccacccattgcntcacatgccatctcacntggctgtggntggaattgcaattgcaattgcactngcaattcgcacngcanttgcacctggcaattgcacactgcacatgcaaancttggnaccagttccacantgccaatcaccctcccacaanacncacaccnacaaccctttgggttgtgcaaatgcacacacaatggtgcaatantatctcccaatcaatanatccctatnccggcaaggcaaacaagcacaccantttcacgccacttatttgccccctctgcaattcaattccantnntttggattnnnnggcaattnncgctggccnnacccatnncacttcttnntncctttgggtacaccaccttanantttcgccataacacactggccctaatttggtgcnacttnttcnaaatcccnaatctccaccaccgcacaccattaacttttgttgctttccccatntaaac

SEQ ID NO: 104102 - DNA, 500 bp, Triticum aestivum
  unsure (1)..(500): unsure at all n locations
  Clone ID: PAT_TA_104102
ntcgttgtccgtgtcgtgtcanngtgtgtgtagtcctctcagtacnacacacagtagcgtcgtcccccaagtanacnaaccccaagtaacaagtaagtgtacgtagtggtcaccccagtggtagtcacgtnataaagtacgtanatccaatccnatcccnccacgtaagttacaangtacanctaacgtaacaccacanntcaacacccccagtgcaanccanntcccanccgacncacaacaccnttggngacgccccgnataatacnctggggtgnnntnntccnctntggcnaatccnccncngtaatcccaacngtggccacanccncanggtnganttccncccntttggcatgncaacanatnttggncccnnttccaccaccaaccacttttgggcnnccanncanccaccaantctnatnttgccaaattgngaccncttcccncagtttgggcnnanctcattccccagtntggacgagncatacccacta

SEQ ID NO: 104103 - DNA, 750 bp, Triticum aestivum
  unsure (1)..(750): unsure at all n locations
  Clone ID: PAT_TA_104103
ctgtgacctgctgctgtgcacancacccnctgtgacctgacannttgctacctgtgntgacccntgcnttggctgctgactgtgtgctgcctgcctgaccntancacatcaanctgccactctgcctgccaatgaagtgacngaatgttcctgcncatcacacacctgncacnatcaccacgatgatcacaangtgacangattgcatgntccatgcncctgntcnagtgtgccnntcccacacntatcacctgncaagattcctgccctgacncatgacaacaagcctgccatgtggccctgcacncaattggntntctgcacacgcacatgtgcacccacaccatcacctgcacaattggtcacacatcaccntcanngtgctcagtgcattgcacnctgcnaccacacangccttgtggtcaagatcctngntctagtgcttgtgcnttcacaaacantcacagtggtccncaatncagctcactttgccccactttgcacacntgttgcntccatggttggcnccancttggatataactcnntccgcacntttggcaaaagataatcacccncantggtgnncaaattntggcnnngncccggcactggccaggccantgacnttggtcacanntcccntgacacnaaaaagngcagcccnntntcnctccnaattatctgatttttnggnttaatnnattggntcnatatttgggccacccatcnttntcntttggcnaatntc

SEQ ID NO: 104104 - DNA, 800 bp, Triticum aestivum
  unsure (1)..(800): unsure at all n locations
  Clone ID: PAT_TA_104104
tcatgctgattgttgccagngcaacatgttacgtcnacgcataagngcattgttttgccnaacacaccattntggccttgcacanatcactcacccctgncttcatcctccagcnagctnacanaggtgtgcaccatccttgncaagtttgtcccaatttgttcactntgcacaccacaagcattgcatnttttgggccatttggggtgtgcacacattgggccccananagcatcacattgggcnnacacacacatngcctttcaccactatttgcntntgcntcngcaccatgnggcaccaatcaattgngcaccacattttggtctcacacagcctggttcacctnttgcaaggccacacagcatccccaccagcctcangcccacaagcacgcanacattgcaccacagcacaccagtgntcccaacacncgangccacttgccattcattgngccttggttgcacacacgtgcacacttcaaacttggttggcatcggtntaccttccagcacgccacttggttgggcattgccttgcatncccaggcacatntgatcacattggcttgccccagacaccacacacacatgggcacanacncacttggccttgagccattggttcangacccaaacccanaggggcacaacacaacatgccngcatgnccnagngcaggncattcaggtttncnnttgnggttcccttattatgtgcctngngctcacccccangcattnaccccgnattggttccnnaanattggcncacttngnancacccaggcagcatcnn

SEQ ID NO: 104105 - DNA, 500 bp, Triticum aestivum
  unsure (1)..(500): unsure at all n locations
  Clone ID: PAT_TA_104105
ncanncccccccccccnccccnccnancancaccgcctgngactagcgccaccaccccaanagggctgtcttcatgngacangctccnccatcaccagcaccnttgccccagcccccanangcatacaacacaccaatattacaatntgctggtcgatccacanttgcnttgcagnatcattgtacccccactcccagcagcccccctcctctgntgtgtgcncacccccantcaattggtcacanggttgcacgtgcacacgcangcaccacaacacccaccntnttgtccacttgcttgngcagcattgcaattgtgcctcacaaccacantatccnttgtgtcgcantctctcacangcaangcactccccatcaccntgtcccnntccnttgtttgtgngcacacctcacacctcacnttgcccccccccacanngtgngccttgctnatcatcactnccacatacgntaccnntattacccantatttncgtcgg

SEQ ID NO: 104106 - DNA, 500 bp, Triticum aestivum
  unsure (1)..(500): unsure at all n locations
  Clone ID: PAT_TA_104106
caagtgcagcaagcatcccaacatccanccatctgttgtgtccatttgngcaccatgtcngcacntcttgtgccaagctccacaccncactgcacctgtgnccccacctccatctacacnaagcctantgtgcagtgccatattgcaccnanncctgattgnttgcatccgcaagcagtgatnantgcangacacatagtgcacatgcccctgcnttgcacgcaatntgcacacccacatngcaagtggtcctcttcncacatgntcattgcccttgtgttggttgccntaatgcacccacaagnctccanaangtgcccttgcgacagctgttngacaagacatagttgtngtggatcaatcacaaanccancattcaaagccaatcnattatnttgncnctncaattgncttngtggcaacaatngntctccntagcaatagaccaacacnnacccccanaaagncttcaccncttcctngttgacccaacantttgg

SEQ ID NO: 104107 - DNA, 500 bp, Triticum aestivum
  unsure (1)..(500): unsure at all n locations
  Clone ID: PAT_TA_104107
gtgtgtgccccagtgcattgttgcctgtgccaagcatttgtgcangtgtgctgcactgcactgcnttgcngtnttgtccacatgcacccttntgctcncacacttgcccttcacccattgtgacaccncttgtgncactagtgtgacaattgtgcacnattgcntncgcctcccacaaacagtacacattccctgacaagtgncacactgncnncacntgncacngcacacctgnttgcaccaatatctanccatgncacctggttgancnctcatggctgtgtcnnanacacactgnctgccnttgccncatgactgacctgtgacncctgaaantgaataganccatatgnctggtacntgnnanaccgcaatgcgccntgcaangacatgccacnncatggntccccannaacccnnattcnncaagccnctgatngcncagcnangttgccacatngttgcaacctggtggcatggcncacaanatggtccatacn

SEQ ID NO: 104108 - DNA, 700 bp, Triticum aestivum
  unsure (1)..(700): unsure at all n locations
  Clone ID: PAT_TA_104108
tgtgtgtgccctggtacccnaantntcgacctatagtgagtctgtcattacaattcacatggcctgtctgtntttnnacanactgtcngtgcacttgggcaaaaccctggctgttcaccaacttcanatcngccttgnccagccacncatccccccttttctgcccagcttgtgctgtcaatcagctgcacagcagtgccctgcnnacctgnatctgcccttcccncacacacagtattgcagcnagccctgncacaattgtgcgcacaattgtngccacacatttggtcacanngcnngttcacantcatntnncttggtctcacanacaatntccngctgtntccacacaattntntncatatggtananaaatcccatggccntnccaatttnnttcacacccacactcagtgcccgcacaacactcctgtgcncacacacatcncccnatttcatcacanattcccacacaccaggcacaattcagcacctgcangcattcagtgtgttttgccaagttgtnttgttacccangttttgtgcacacncacangcaagtcaccncacatncatctacacaaccangcacaacctcggttgagcaaccntaccnncaaacttgttcccagacaaatgttggctttgccacacacanacncntgtccctcaattccaagttgngaccctcncaattngt

SEQ ID NO: 104109 - DNA, 800 bp, Triticum aestivum
  unsure (1)..(800): unsure at all n locations
  Clone ID: PAT_TA_104109
ncacnacaacannnaaangnnannaanncnnnacaaannaaccaagngtgatgngaataggccatgagncagcacagcataacaanagnntacnnagcagtaanaaanaaaaaanaaaaaaaaaaaaanaanaaanaatatatatatntatattctattatcttatattatattanctnnatatctaatatancttnncaccattgntcatnacactcacannaatcancaatcncacctcacatnttngcacacntttgcantcacacccncatgnctaaccaattgacacacccncacatgttgtgctcatgctnaattgntnacacacncacaccantancactttggccangctncantatcacacncacncacacacatnacacacacncacacacacacatacacacacacaacatttgnnncacacccccacacacacacacttgncacatgtgcanttgccccctcaccacacacaattagttgcctatgtgctttgcntgttccacaacgtancgtncacgntnccnncggtnntnccacngatgaccgtgtncnacnaattctacatactatcccaccncccgncggtttattcgttgttnnccnaccatcacnacnantanaacnctccttccaactacnaantaccaccgnngccccactaatacaccaacgtnannagcacncattcgttgnaatctaataccacgnttcaacnaattcaacnntaacncncnnantcnnccaaccgnntnncacaacggtcaactccccatccctacttcccacgg

SEQ ID NO: 104110 - DNA, 500 bp, Triticum aestivum
  unsure (1)..(500): unsure at all n locations
  Clone ID: PAT_TA_104110
ctcaccagtccatgcctccctctgtgacacctgcctgatgcagctgntgcaaccacaccagtgttctgcagcacangtgtgttgcacaagcaagcatnccagtggcagccacaccttgcacangcatgtgcttgtgtcagccagtgcctggattgcttgtgcattgtgnttgctcccattgtgactcaagcacatngntcnttgtgttgtgtgtgccntccttgntgattgtagcaagtgtgccannatgtgtgcccccccangtggccngtcactgcaccnttgtgnatccccatgcacctcacccacanagncacagatnnttgagtntaccncatggcnatatgtngctttgcccattgcatngtgcattgngacacattgacaacaagacctncacacaatgtgcnccccaatcncattgnatcaaatattcaccaccaccagttngattgatgattgtgccacacctgatcntggtagnnttcgcaatatgttcc

SEQ ID NO: 104111 - DNA, 500 bp, Triticum aestivum
  unsure (1)..(500): unsure at all n locations
  Clone ID: PAT_TA_104111
gatnggcacgagccnccctccttntcctcctccccgttgctctgcctgnctgnccccctcctgctcctgntgcacccanggaaagatggctgtccacattgtcnggataccctgctgcatggtgccccaaagangtggangctcaangttttgncctggagtctttcttgctgatggcaagagcagctgcctgcagtgncattttggcacgcacagtgtttgcccacactgaccctcagtggccnatgcatcttggacaagcnagcatgtgcttgcattgcttggtgcatccaatggtacatccccccagcnaacnaccnttctccttactattgcactccnatggtgtntccntantagcnaactnacnccnnaaccccttggnnaccncanttgcccntacacagtctgngattgcaccntgantncaccacnganaacccnttgntntanacntccaatttgttgcaacacctggtggctttngcggtgtcgcanng

SEQ ID NO: 104112 - DNA, 855 bp, Triticum aestivum
  unsure (1)..(855): unsure at all n locations
  Clone ID: PAT_TA_104112
cctggcgcggcgccaggctcgtgctcccggngcgcaactcaangccgccgangagacccgcgcccgcatcctcgccgacctcgtgccccggctggcaccgcgtcgtggtgctcccgctcgacctctcctccctcggctccgtcctgccgcttcgtcgcccgcttcngtcgccctccgcctccctgctcaacctcctcataaacaactgcgngggcagtacgcnggagctggttctgctgngtgtcggagtgactggctgtggagatgaccttcngccaccaactacctggtgccacttcctgctcactggagctgcttctgcctgaccatggctggacactggccatgngccatgctggctgtgcagtggcctgctgtctgttgaactgtctcctccacctgtgcactgcctggttctgcctgcctgactgcctgtgctgactgactgtggcccctcgcctacctcagcctgcngtcaccctgcaanntgccacngcctgtacngatcctgactgctgtggcctacgccctgtccaagctctgccaactgtgctccacaccactggtcctcgccggcctggctcagggagatgggctgcctgacgtgacctgncaanttgnngtccacccggatcgtccgcaaccgcatcatccgcgacgcgccggctcgtcancaacacaggtgttcnttcctgagcagtaccaaggctcantacaggaagggtgccccagagcggcggcgaagaagtgctacgccgggggtgaccgnggtggcgggggtgncggggagggaactcgncgaatggacaagnggcgcngcnaaaggtgganngaaggccggacgcacnacanngn

SEQ ID NO: 104113 - DNA, 600 bp, Triticum aestivum
  unsure (1)..(600): unsure at all n locations
  Clone ID: PAT_TA_104113
aaaatgtgctggtctgtgactgtgtagtggtttcccntgattcccatccangctgntacatgactagtgctgaccccctgcttccctgntcccctctctcctccacactgcnctcgcantccctcctccccntctgtcctgcactgcctgcctgcctgccaaccatggtgcatgtngtgcaatgttcaaaatgtngcaaatgccaancctgtgcctgcctgcacacnccttcctncccanacccctgtgantgtgactgactctgncttccttgtgacaccnctntcatgtggcttgtnccacctggncctcactttacacnngacactgacaccttgtantggctttgacantgccactngacactgactgtgacacgaccgtgacacctgaccgtgtaccgacacngacactcttgacactcgnactgtgacaccgacanttcnctgacnaccnnnaccccngacccngntggtgacacaggacncggacacccgacacacccactacaccactgtgacacncctgacaactgttgntntgtntcacgtatcacaaaacncntnttgaccacacaactccacaacacccccttggtgn

SEQ ID NO: 104114 - DNA, 600 bp, Triticum aestivum
  unsure (1)..(600): unsure at all n locations
  Clone ID: PAT_TA_104114
aatgctcttaatgngactgtgtgatgccctgcangtgacgacattgcnttgtgaaagtcccatctgacctgaagctccangaaaaccaactgntgcatctgtgcataacacgaatcaantgtgccaacntatctgncctcaatgttgctgccctgtgtgcacccatctgatgcnataccccctgtgctagtgccccatccccatcacatgctgctgtgactgtgccacccctgnccnacccccttgtngccctgacaccatctgcctgtgcccctgncacctgcncccacatgtgnattgcanaccccctgtggccccacatgtganntcatgcctgaaccntcccctgtgacctgccnaattgcacttgtgcccccattggccctccatgctgccctctgatgtgcaaatcnattcnaacncacncnaaccccacaccttgcncctggccccntgtgacatggccctgtgtgtggacacntgcacctnngcacctgtgtttgcntttgccncatgcctgcacacactgtgccctgccncaattgcncatgntncaccttgtgtgncctttgcacccacacctaggaaaacttagnttgg

SEQ ID NO: 104115 - DNA, 755 bp, Triticum aestivum
  unsure (1)..(755): unsure at all n locations
  Clone ID: PAT_TA_104115
gcgatggcggccgcgacatggcgctctcctccccggngatngcctggcacccctggntgaaatgcctccagtgctggtgcccttcgngngatggccgcatcaccatgcgcaagacggcgggcaagcccaatgtggctggcgtccagcagccctgtggtacggctccgaccgctgtgctctaccctctgngcncctgctctcctgtgcngacccccctgagctacctcacnctgtgctgagttcccctgtgctgactacgtgcttggtgacacctgctgngtggcttgtctgtgcctgacccctgagaccttctgccaatgaacctggtgagcttggagtgtcatccactgcctgctgnggccatgctcggcngcgctcngngnctgcgtcttccccgagctgcatcgnccctgcaactggctgtcaagttctggcgagtgcctgtctggttcaaanngacctggctcccagatcttcagcgaatgtgctggcctcgactaccatcgngnnaaccccagcnctgatgcacngctgcagagcatccatctgccatctggngcctgccaggtggtgctcatggtgctgcctgtggagtggctaccgcgatcgccnggccggnccgctgggcgagatcgtggacccgntctaacccggacggcagacntncgaacccactgnnggcctcgccgaggaccgaggncttcgcggagctcaaggtgaagganatccaanaacggcgcncgcaatgtctccat

SEQ ID NO: 104116 - DNA, 251 bp, Triticum aestivum
  unsure (1)..(251): unsure at all n locations
  Clone ID: PAT_TA_104116
ttctcgggcgtgcgcgcggcgggcacttctcggccgacacgggtcgcgggggtgtcgtcacgccggcgcagttcccgggcctgcacactctgggcatgtccttcgcccgcgccgacctctcggccgccggcgtgcgtcaacccgccgcaccaccacccgcgcgccaccgagacnggcgctcgtcctcgccggccgcgtctacgcgggcttcgtcgacacggggnggccgcctcttcgccaaggtgctcgtg

SEQ ID NO: 104117 - DNA, 800 bp, Triticum aestivum
  unsure (1)..(800): unsure at all n locations
  Clone ID: PAT_TA_104117
tcggcacaggctcttcctganncttgtcgagggcngagtgttctcgacttnctaagacaanatntcgtcgcctcgggttcccccttcggttccggcgtcgtctcgtatgcaagagcatcgtcgctcgtgaggtagcatcgctggatggcgtgggacgcaatgagacgtnggctcnganctagcacaanttcatctataagggcgtccaggctcaagtctcaccgcgcgcgtgcacgccnagttacagcgcaatcctttgtaacgcggcatatgcanccacgactgccatcaaaccatttagctggctgcgaatgtaagncagnccgaagtctgtacaagcagagtgcacagaatgtacctccgtatgcacagncttgnttcaaancatagggaaccgaagcagcgacaacatcttgcgctgctcctattctagatngcttgccaacgcaagaaggccaccctgggcctcggtcgactcgtcatcgtgttgntccacgccagacctngcactgcgganagccccganctgacgcanttgacgcnagacccaccatnttccttctgccagtcggggaagtgtggncttggtcaagtcacaggacttnttgaataagccttggcgtcaatnggggtctccagaaggcactgnncatnaaacgtcaaggccatctgatgggnccggcaacagtcatnnctgtcctggctctcgctctttgtggcannaaatgacacaaccctgaanctctggtaacgccgntngctctctgcanatcgtcgcactcggcagtacanaactntgc

SEQ ID NO: 104118 - DNA, 670 bp, Triticum aestivum
  unsure (1)..(670): unsure at all n locations
  Clone ID: PAT_TA_104118
cccctgacttccacccctggncacgancaancatcnccctgacttccactccngtgggatggcctctcntccnccatgcttcctggctggaccgncacctcctctatgcngccatccgtcnaacatcgtcngttgccaaaanagatcccggcacttgtcttgccaggactcgntcngatnngatctggtcagtcgagggnccangnngcnccatgcgnnccggaccgcgcctaagnatanngaccgnntccccgcggaccccttctgcantccactcaaaccaacagccggaanccnctggccgntngcaccnncccccccccacnaacngaacccaccnttggnnattgggcccaggcaagcancanngcgcacagggaaaaaacgaaaannnaaaccaaacncngncnccgggcnctncccgnggtgcccaccacaaanncccaagaaacgngcaaagtngccaangcganaannnnncaaccnccgtggccnggnaaacagggacccnaacannccggaggacnccaaacacactaacaccacaaaancgcacgagaaaaacccccaancnncaaccacannggggccaaacnacnccnntgggcacccaccacanccnaccgnncaccacagnnnggaaacacccccaagnggtgaacnngngacc

SEQ ID NO: 104119 - DNA, 690 bp, Triticum aestivum
  unsure (1)..(690): unsure at all n locations
  Clone ID: PAT_TA_104119
gagcgcacgaaaagaaagcagagagaaatgaaacttgccctgctgctgagngcctggcctccntggcgatgagcccccgccgccgcctccccgtgctcctcctcgccgccctcgccgtcgcctgcgcctgcgccgccgcccgcccctgcgcnggccctcgtcctgcctcgtgctgcctgcctccttcgtcgacgcccccgcngcngcttcngggcccctgggtgacctggcgacgggatatgcgggtcngctgcgcgccngcggagccctgccgacgctgtgctgctgccctgtcnatgtggtgctgccccctgtgctgtgtgaagctgtgctgtgtgaattgtgctgtatctgttggtttgantctgctgctgctgtgtgaacnttgcagctttcngangtgngcnaatgtgttgctgtggctgtgctngccanngctgtgtgcctgtgcatntccngaactgcctgcccntctgtccactngaacnngancnngangtgaacaaatgtggccnangccntcctaactccanttggtttgtgttgaatccttgangtgtgcantacacantanccttggcgtgtanttcgtattccaaaattgtggcttggtgtgaaaccttttaaatgaacngttttggctangaagtgttgaagattggttganngttgncttgcantaaactcggt

SEQ ID NO: 104120 - DNA, 906 bp, Triticum aestivum
  unsure (1)..(906): unsure at all n locations
  Clone ID: PAT_TA_104120
cangtgnaagnnggattatttannggaaattaaaaaatanttatctcatggacaaatgacattcttagctaggttaccgtgaatnnncatntgttatctcacatgaatacatgcctgaagcgtgggcgtgcgttgatataacaatagagcctgctataatgaatatggtgnattgatgctactaggcntaaccatcctcacttactctgatgggggggccccggatcaccgccaattctgntcgctcataggttgaagtctcttatgtgacnaatacgagcatgtgcctgtcggttgtgatcgnnacgtgcgatgcgagattgagaganaaaacccntcganttgttntcgcctatacacgtatanctctntccttgcgcagtacagaaatccnnctcatgttcaggcgcatcatnggcgntcacaatacncgacaggacgagccacgacgaccggaacagccgctntacccaaatgcantgttggcannatgccgtgagaatggacgaaactgagtgaagnattttcttgttaaaatngncccgtggtctacatgtantgttctggtatatatatagcctctcgtgcaggtgtacatagaatgtttcngtgggatgtaactacgtcatgacctcaagtcttatattaatccacattctaggcgccttggtatnnccatcctgggcgganacaatntcacgcctttatnacgnattccacaccaagatngcacattntatgcaccctaaagacatcaatggtgtgtanngaggctttgtgtntgtanncccgaagattttgttatgtgatagcccatntgcatnntcacccaacttantttacaaacgaaacgcggttggnactcccaaananncgctcancatnttgcggctgcnnagagaaacc

SEQ ID NO: 104121 - DNA, 420 bp, Triticum aestivum
  unsure (1)..(420): unsure at all n locations
  Clone ID: PAT_TA_104121
cctgtgctgtgctgcangtgctgtgtctgtgcttggctgtgcctgctgtgcctactgcttctanctngccaatgncattgtggctgcctgtgccctgctcctgcccctgtgtgtgtcngaaaccaactgtctgatgtgtgtgaactgtgtcaattgcctgtcngtctgtgcccctgtgtacngacctgctaccactgcctgtgcctgcatctgaacctcctcaatgttcctctgancctgnaattgtcgcacgagtcttgtccaggagcttggnatctgtcngttgtccctgccggtcgttgaaangatgttgcctgacctatgctcgctcttgcagcagctgangtgttgcagaaagacatgngcataattgngngcacatgnaacttggcctggccaangtctggccattgctcngtg

SEQ ID NO: 104122 - DNA, 553 bp, Triticum aestivum
  unsure (1)..(553): unsure at all n locations
  Clone ID: PAT_TA_104122
atcacgacagcggngcgagcgccccgatgtgcagggnttcaagccgcgtgaagagggtgctcgttgcggctctaaccctggtgccaacgccatgaagaaggagaacatctctcctgttcgtgaagcatccccaaccctagcccttctttgcccatgatgaccgagcagacaggaggtactaatccctccacttatctggttttcttcaccccttatgtgatgcgtgctatctacttttgtgcatgtttcatggagaggagaagctgcttcaatcccatctactgaaggaggatgcccaccatccaaggtgctcaacatcatcaccatttgttgcctgccaaggcataaaccactacacagcattatatgctaggaacgacgggatgcacgttaggaaacttgtcatgaatgatgcttcaacggatgctgcagtcatctcaactgctcagtcatgatgaaaaaacatatgataatccccataatccagtgtcaatattactgatttctgcatgtgctatgcagcttacaggcagcattgagttggctgcacata

SEQ ID NO: 104123 - DNA, 831 bp, Triticum aestivum
  unsure (1)..(831): unsure at all n locations
  Clone ID: PAT_TA_104123
cgccatggcctcgctgctcctgnctcctgtctgggccctcgcctgcctgcctccacctcctgcatccctcctccgtcctgactgcctcctgncgctggnacccccccatctgggcccccctcctcgnccctttctgtcgngccngtgcnggccctgttcctccccngtgtgtgtgctgcctgcctgtgctttcctgggtctganctgtgctgtgctganatgctgtgcactgtgtgtgtaactctgtgctgtgttgtgtgtgctgtgactgacgccaaaatctganccctgactganngatcctcctttctgagtgtgtgttgctgactacaanccacattggctcatcaccaatgtgattgttccctctgatccccaanngccctaccctgcngatgtgatgacttgaatacagaagaccctcatcgccttggcnangaacccntncagnccaangtgctcngtactgtgacatgcttcanttgangtgatgtgcctaangaagcagtgattgtnattgctcttagtnacaacaacatcattgtntggttttcaatgcttgtnaattgacttgagtgcaaatgtcagaaaagtttctngcgtgcgaatttttggccctttgggnaagtttgnttntatcnnnagttcatatggccccttgaattctccaactaactatataaagcccncnaagcanngcaccanacatggggaaggttactngtgaccgctggatnngacccaanaattaccagacgagaaaatgggtngtcnactcacanccttcccacanntgaacaccaacncaacncacttggttccaangtaata

SEQ ID NO: 104124 - DNA, 500 bp, Triticum aestivum
  unsure (1)..(500): unsure at all n locations
  Clone ID: PAT_TA_104124
nggnntnntcngcngctactgcggccanncgcggnggtggctggatgctacgtgcggcgtgcgtgtggctggctactgctggccantgcngcngngctggctacgtgccagtgncggctgtgtggctggctacgtgccagtgcggtggtggctacgtgctgtgccancgtggtggctggcagctacgtgctgtgcgtgctgtgctgtgctgtgctcactgtgctgtgctgtgctgtgttgtgctgtgctcactgtgctgtgccagctgctgtgctgtgctgcactcctgtgctgtggccagttgtgatgtgcaaccttgcagctgtgctgtgtgtgccctcccagttnatcngatctcatctnaccatctcngtcgntcctntcngnntccagnccacagnttncatncnttttccagnttgnttcngntcngtcngntcngnttgnttccccttggttgntncagntccagnttcnttttggcagttcctgnttgnttg

SEQ ID NO: 104125 - DNA, 647 bp, Triticum aestivum
  unsure (1)..(647): unsure at all n locations
  Clone ID: PAT_TA_104125
cagatcgagaggttcgagaaggaagccgctgagnatgaacaagaggtccttcaagtacgcctgggtgcttgacaagctgaaggccgagcgcgagaggggtatcaccattgatattgccctgtggaagttttgagaccaccaagtactactgcaccgtcnattgatgcccctggtcaccgtgacttcatcaagaacatgatcaccggtacctcccagngcgtggacgttgctgntgtctcatacaatcganctccaccactggtggttttgaggactggtatctcgaaggatcggnccagacccgtgagcacgccctccttgctttcactcttggagtgaagcagatgatctgctgctgcanacaagatggatgccaccactcccaagtactcgaagngcccgtntatgaggaaaatcggtcaaggaagtctcttcgtacctnaagaaggtcggctacaaccctganaaggttcccttcgttcccatctctgggtttgagggtgacaancatgattgagaggtccacgcnaaccttgnactggtacaagggccctacnnctntcttgaggctcttgaccagatcaatgagncccaagaggccctcanacaagcccctgcgtcttccccttcaggatgtttacaagatt

SEQ ID NO: 104126 - DNA, 439 bp, Triticum aestivum
  unsure (1)..(439): unsure at all n locations
  Clone ID: PAT_TA_104126
aactacactcatccactcaagcaaaagctagctggcgtagtagctcacnttcagtccagtctggcatggctgtgctccgagtgtgtgtgctgtgcactgtgtgcttggctgantgtgttgctctgctgtgccactgtgtgtggttgtgctgcctgcctgtgctgancttgtgcactgccatatccctgctcncncaactgtgtttgtanncactggcaactgncttgacttgcctgnttgncccttggcanngtaaactgttgcatggcanntgttgggctgtgtgtcctggccctgtggcccccngtgtgtgcttgcttgcacctgtgcatccagaacctgctggcctgagtgccaacaacangccccgacctgccgcaccatctgctgtgctgcctcaagaactgtcngccaactgngctgcctccgtgctgnggcc

SEQ ID NO: 104127 - DNA, 651 bp, Triticum aestivum
  unsure (1)..(651): unsure at all n locations
  Clone ID: PAT_TA_104127
gccataaagccagaggggcagaaaggtgtggaagcacatcctcatgtcagtatgggagtgggatgtgctgttcaaagatgcagaggcagtggacatagactgcttcggagccctgttaatggagaacctgagaactccacttcggagctgaagagggggctggtgccgaagctgccaaggaaacctgctgcccagccggcacagctccactactacctcagtgcacatctagtggaggagtgatgacaacacccctgttgatgtaatcgtaagcacacgcatgctgttcacctcttaaacctggattttttgtttgcattttaggctttattttncgatgctatgcaacgctgagtttgcgaacgattntgaacctgttcagncgctgtatgactcgttggtttcatactataaaatgtacctgtgggggctccaccctgttcatccaaaaaaatatataatcctttctgttaccaaaaaaaaaaaaaaaaaactcgagggnggggcccggtacccaattcgccctatagtgagtcgtattacaattcactggccgtcgttttacaacgtcgtgactgggaaaaccctggcgttacccaacttaatcgccttgcaganatcccccttcgcagntggcgtatancganagcc

SEQ ID NO: 104128 - DNA, 684 bp, Triticum aestivum
  unsure (1)..(684): unsure at all n locations
  Clone ID: PAT_TA_104128
aaaaaaaggatctctttctctctctctcttccggtgtaattcaatccccattatgagtgtctagactaatacatctctttttgggggaacggaggtaatanaaactancaaatctggctgcctcccaaccacagccaangccgccggccgccgcgtcgctcgtcgccccttgctcagccggtcagcccagcgcggcaacgccgactcgccgtccgtccgctcgcgaggcgcccagttgagtagagttcgattgtctttactgtttatttttaccttgagcgatccatcttttaactgggctgttgggcctaggggacaatagtcgggcgttgggcggatacataaaggtaaaagataggagagcggcggtcggcggatccttaatttccgccgtcgccgcgccagatctctctcaccgccacctccttcctcaagcctaacgatctctctcctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcacgatcgcccttcccaacagttgcgcagctgaatggcgaatgggaattgtaagcgttaatattttgt

SEQ ID NO: 104129 - DNA, 600 bp, Triticum aestivum
  unsure (1)..(600): unsure at all n locations
  Clone ID: PAT_TA_104129
ctttggtcgccgcgtcgcgcagccgccgtcgttcggcnctagtggntggtcagtggccgtcgtgtcgcgctggcgggttgnggtacganctcgccgacganctccgnctcttcctgngccaanggaccngnctgntcgacctcgtnngngtgngtgtgnganctgggacctgtnnctncgggntggngncgtngtgaccangtgccctgctgtgttgtgtctgtcngcctgacaattgtgctgatnctgctgctgctggnatcctgctncctgactgttgcgtctccctntcactggccagaatttgcngtggaagcacngtttaaacacanntctgcttgtnctnnnnttacntgtgtgggaannaatccccctctntatgtggncccctttcaaaaatgcgcatgtannctgaanntaacacctgctggtggcnttgcnnnttgtaggagccctngtggtganncgtggcacttgnctggcgccagctagcatggcnaatgncncntacttagtattactcagtataacgcccatgccgtctncntnctanggcggtncatatcctgcgactgggtngaaagntgancgcaccactnc

SEQ ID NO: 104130 - DNA, 454 bp, Triticum aestivum
  unsure (1)..(454): unsure at all n locations
  Clone ID: PAT_TA_104130
cangagcgatcaggcttctgcgcgcttcgccgctacaccgccgcaacctcccctcctcgggttcttccaagagctagacgaagtggctctccttcgcgccttccctcaaggccccggatcgtgtctcgcccgagcgcttctccttgcaacacgcagatttggtcgaccgcttcttctccctcggatgccgccatggcctggcgctcatctaccttcgcaagcgtctccagctccttgtgtgggaccccgtcaccggcgaccagcaccacattgccgtccccccggggttcngacacggagacatccccaatcagcggcgcggtgtttcgctctgccggagacgtccaacacttccatctggctttggtagggagcagtgagagacaaattacgcaagcagtcgcccgtgtttactcgtcggaaaccggtgtatggggnccgggnaaatttcccc

SEQ ID NO: 104131 - DNA, 679 bp, Triticum aestivum
  unsure (1)..(679): unsure at all n locations
  Clone ID: PAT_TA_104131
cggacgagggtcgagagtcnagactcgagagcgagtagccgagacccgtggattctttcactcatggacgcaaaggcggaggcatccggcgacgacgcggtcccggaggcgccggagcagtccgtcgtcctcatctccgccggcgccaaccactccgtcgcactgctctcgggccagatggtgtgctcctggnggccggggcgaggacgggcagctgggccacggagactccgaggaccggccggtgccgacggtactgacctccttcgacgtgccacgcattacgtccgtcgtctgcggtgccgatcacaccgccgcctactccgacgacgagatgcagctctacagctggggatggggagacttcgggaggctggggcatggcaactccagcgatgtgttcaacccacagccggtcgtggccctgcaggggatgaagatcaagcagatcgcctgcggtgacagccactgcctcgccgtcaccgtcaccggacaagtgcatagctgggggcgcaatcagaacggccaacttggtctcggaaacaatgaagactcgctgctcccgcaaaagatcaaggcttttcagggtgtctgcgtaaaaatgatcgctgctggcgccgagcatactacggcataactgaagatggncatctctacggatggggctgggtcggnacgg

SEQ ID NO: 104132 - DNA, 600 bp, Triticum aestivum
  unsure (1)..(600): unsure at all n locations
  Clone ID: PAT_TA_104132
caaccacccccacccgccgccatgatggagtgatctcgatccacatctggccaggcctggcatccaggtctgggaactgctgtgctggtgagctctatttgcctcgagcatggcattcagcctgatggncagatgccctggtgacaagactgtntggtgtgtgagtgttgatgattgcttttccacaccacccttcnttccagctgcagnacttggttgcttggtgcacagcactgtccccctgtgccttgtctttctgtcancatctcngcagcccacttgttgcatttgcattgcagtgttgcatgtgcacttggctgcttcacctgccagctcttccacctgcagccacgcttcatccagttgtgccacatatgcacgtgcattgccagcccaacnaactctcgcccctgtcgagatcattcacaccccatcttgtngccaatgtgcagcatttgtttgcatcatcttgcccctcaaacatcttgtcatcatgtgcacnanctntctccacgcacaanttgcaccttggntccttgccantggaattccacctnattggctcactatnccacaanctngccatttgatcactgtcga

SEQ ID NO: 104133 - DNA, 807 bp, Triticum aestivum
  unsure (1)..(807): unsure at all n locations
  Clone ID: PAT_TA_104133
ttaatgccaatgcaatgcagtgctcaatacaaatccaccatgaagacctttctcatccttgccctccttgctatntgtagcaaccacctgccacaattgcatgttagatgttccagtgccacaatttgcatgncacaaaatccatctcagcaacaaccacaagagcaatgttccatttggtacaacaacaacaatttccagtgcatgcaacaaccatttccaccacaacatgccatatcctgcagcctgcaaccatttccatcacaacaaccatatcttgcagcttgcaaccatttcctgcagcctgcaactaccatatcctgcagcctgcaactaccatatcctgcatgcctgcaactaccatatcctgcatgcctgcaaccatttctgaccacaacaacccatatccacaatctgcaaccacatgtattctgcaaccacaacaaccaatttctgcagcangcatgcatgcatgcnaacaacaacaacaacaacaaaaacaacaacaacaacaacaacaacatgatccttcaacaaattttgcnaacaacaacttgattccatgcagtggatgttgtattgcaacaacacagcatagctgtatgtgaagctcacaagnttttgngaaaaaagtacttaacagntggtgcaanaatttgtgtttgtcagnagnttgtgtgagatacacccgaagaagaagtngttgcaaancaaccacaaatgttgtcatgntaanaactgnnaaaaaggaanaaaaanaaagaataaaanaacaaangggtgnggaanggtnnncaaaaaaaaaaa

SEQ ID NO: 104134 - DNA, 600 bp, Triticum aestivum
  unsure (1)..(600): unsure at all n locations
  Clone ID: PAT_TA_104134
agtgactttgcttcacacgttagcggatctgcgcgcactcctccatggatccctggcatctgggtancctgcgtcacgtcgccgccggtancaccgtgccgccccgcgactctacggnaccaccgacgcctaccanctcttccccacccgacgccgacgcccacgccanctctgntccgcccacctcctgtgcctgtcatgctcattggcatgctcctgantccctgctgctgcttgctcctgtgctgtgctgatgcattggctgttctgcctgtgancgtgtgacccctgtggccctcactgtgncctgctctcctcatcctcctcaagactgctatcgcttgctctgtgctcctcaccttctcctcctgcctgctgccccctgtgctgtgctgtctgtctccctgctgtgcttgttgcacaacaacaacttggtgcctgtgctctgtcttgcacatccctgcttcttggtttaattatatgacatatggccaacacgctgtcttttgtacatgtgacttgttaagaagattagtgaatacctgactgagctggataatacttatgtttggntggatgatatggcttgtaatcctcgga

SEQ ID NO: 104135 - DNA, 500 bp, Triticum aestivum
  unsure (1)..(500): unsure at all n locations
  Clone ID: PAT_TA_104135
ggcttgnnatcttggctnganactcccctgcttcttcatccccctgcctgcctgtctctcccctggcaccctcnagcaccagcnnntgttcttgcgatgcagcnagctggtttntcttgtgntcttggtgntcttgtgnacangtgcacntttctgtgcagtgctgtgngcatgtgnngntcncatcctgngntgtgcctgcaactctgcctgtgccatgtgctgcatgcacctgcttgctgtgcaacaanccaaccccttctgccacctgcctcgcctgcctcctcacctgcttgctngccaactngccctccctcctgcctgccctctgtgcctgnctgctgccctccctcctctgcctgattgaactgcctgggctaccctgcaccctgttcctcattcttctccctgcctgccctgcttgcctgctgcttctgcctgcncnttcttcctcctctgtgcntccattcatctggcctgctccacnctcctctcccann

SEQ ID NO: 104136 - DNA, 501 bp, Triticum aestivum
  unsure (1)..(501): unsure at all n locations
  Clone ID: PAT_TA_104136
aaaatccccaagcacgctccccgcatcgacggcgccggcgccggcgattcacgccgacgcctgcacctcccgccgagtcgcctccgtacctgaagtagcaccgccaccaacctttccccggattcgaccaatcccgtgttcggcgggcaacctgattccccaccaaatttgttgccctagagcctgttgcgtctgacctcggtatcaagatccatggcgctccccgctctttccttccagccctccaccctgatgggctcaaaagccgctgactccgcctccggattccccgactgggtcttcctctgcgaggagccgcgtttctcggaacgccggaacgagaccaccgccaagtgccggaccggcgagggccaagccgtggaggtgtccttctggctcgtcgacccgcccggcgtctcctacttcaccttcaactgccccggcctcgacgcctccgtcttccacgagaaggagccgncctccctcgtctgcgccgcggcc

SEQ ID NO: 104137 - DNA, 561 bp, Triticum aestivum
  unsure (1)..(561): unsure at all n locations
  Clone ID: PAT_TA_104137
gatgtcttgcaactgtggatccggttgcagctgcggctcagactgcaagtgcgggaagatgtaccctgatctgacagagcagggcagcgccgcgccaggtcgccgcgtggtcgtgctcggcgtggctcctganaacaaggcgggcagttcgaggtggncgcgggnaccgggagggctgatgggngannatgnantgnaacctgnatgnanntgtgnctcntnnntnctncnttatnggnnnananntnnantannaggcgtctgatctgatggagtcgagcaagggtgcgtgttgcgtgtgatttgnttggtcgntctcgctatgntctggccatgtgtncttgtgttgtatgtgtgtgncgcatgtntcctgtaatggttcatcttatcttcantatgatggagtgatgaatatgtaggaatgaaangatttnctaatttactagtnaaaaaatcagggggggccgggtaccaattggcctaataatngtgattaaanaatggcggngttaaaagttnganntgggaaanctgggtncaataaagtggaatacctttnng

SEQ ID NO: 104138 - DNA, 513 bp, Triticum aestivum
  Clone ID: PAT_TA_104138
aagtagtgagggaaaaagaggcgtatcagatcaactgggagcaatgaagggtcatatggatttattatcccatcgacttgatttacttacagtcagagtcgacaagcaagactcttgtatatctgaaaaaaacaaggagtttgatatgattgccagcaggctggagcaagctctgcaggatgtacgtcaaaatgagatcatttccagtgagttgctcgacagatttagaaatgctacagactctctaaaggaggtggagaaacaaaatcaatatttacgtaacgtcatccaagataaggagaaaatattcacatcaaccatttataaagaaaaggagttcaaagaacgcatgacaagtcttgttgaatctatgagagagtttgagaatctggttacatatcaacaaactatcattgcaaacaaaattcagcacagtgaatcaaggttttgtttactgaaagaccaatgtaaacacctcacgaaagaaggcaatcttttgaaaaggaaggcatt

SEQ ID NO: 104139 - DNA, 500 bp, Triticum aestivum
  unsure (1)..(500): unsure at all n locations
  Clone ID: PAT_TA_104139
tgngncgtcgtcaggaagcaaccgaggncntnaatccnatncncagcacgaaaaacatggccncatctatactatctagtcccnttacctccccgcctcagtctgtccgagtntaggctgcgacacttgtgtgcctatcgacaccgaagttgggtattgtgaccgtgggagtcgtgcgcgacacattggtgcncttcccacttttgtgacttccgtngtctagagncggggagcagtntnagggctnagccgtagaattnnagggantntgcacactgtngtactgggacagattgcgacagcagactgagtntgcgtcgctgggtgggtgtccgcgtacggtcgggtttgtgattgggaattccgtggttagtgagctagccaggggttgagtctacagcccgatagacacagantcttcgagggtgcntgtcacgtgcgccctcatacttacgccgccagaggnccagccgtttgtgngngcnacgngattggcttcg

SEQ ID NO: 104140 - DNA, 437 bp, Triticum aestivum
  unsure (1)..(437): unsure at all n locations
  Clone ID: PAT_TA_104140
nncacgcatgtgcacagcactatcatgtgtgagaatagcggtacgaggaagtcaagatatcctgatgtatctaaattatgttaatcccttgtgtgatgttggttgataaagaaattgtttgcagccatggaatcggtcaacagtgttcaaaatcaaggatgtgtgtatgtgatttagtactaatccttcatccatggcatgagcctatctggcatcttgttcatttatattttcccgtgctgctgtggttttcttattattacaaggtataatataatgcatgccatcaagttttgtttatagctatcaaatttgaataataatttgcatctgcagggcattcataaaactccctttaaattgttcaatgccacttatttgtcgttcttatttgtgcttttaactaatcttggaattataatccatttattgtaggt

SEQ ID NO: 104141 - DNA, 541 bp, Triticum aestivum
  unsure (1)..(541): unsure at all n locations
  Clone ID: PAT_TA_104141
attgatgccctggtcacgtgacttcatcaagaacatgatcacggtactcccaggctgactgtgctgttctcatcatcgactccaccactggtggttttgagtgctggtatctccaagtganttggnccaagaacacgtgagcacgccctccttgctttcactcttggagtgaagcagatgatctgctgctgcaacaagatggacgccaccactcccaagtactcgaagngctcgttacgaagaaattgttaagngaggtctcttcgtacctgaagaaggtcggctacaaccctgacaanggttcccttcgtccccatctctgggttcgagngngtgacaacatgattgagaggtccaccaaccttgacttggtacaagngtgcccaaccctgcttgagtgcacttgaccagatcaacgagcccaagaggccctcagacaagcccctccgtcttcccctacaggatgtttacaagattggtggcattggaactgtgcctgttggccgtgttgagactggtgtcatcaagcctggtatggttg

SEQ ID NO: 104142 - DNA, 600 bp, Triticum aestivum
  unsure (1)..(600): unsure at all n locations
  Clone ID: PAT_TA_104142
ggacagatgcagcaggacagcaccgatccctctcctcgatcttccccttccctccgtcgcgccgtccctcaagcttctgcgcacccaacctcctccctcacctgcggnctcctcctcgcccttccttctcccgcgcaccactgcccggcgaccggccacgcctccggccacccattcctctgccgccgtgccgtcgttctggcctggcngagcccatctcctccggcggccccatcaccngtcacgccccttgccgcctcctctgctggtggtgaccaccaggagctccaccaggagccccgagtcccctgcctcctcttcacgagcgcccngtgcacgctggtctcctttgcttgccngtggtgctccttccctgcgaccgaagcctcgcgccaagctcccctgcatcgcgcgagtcgccgagcccctgcctcctccatcgccctgtcccagccatcctttctccttccctcgcaaancgcgggcatcgagctcgtcgccccgnctccagggtcctcccctgcgcactggtcctaccggagctccttgccgcatctcttgccgcgccgcctgtgtgttcgncttccgaaccttgcgacg

SEQ ID NO: 104143 - DNA, 171 bp, Triticum aestivum
  Clone ID: PAT_TA_104143
caactgcccaaaccagcacgcaagcgtctagtgggggtattttctccagtcgcctgctgcttcttcctccagtacaagtagtagctgtagcagcagtcatttcttcgcaggaaaaaagcccagcaagcggtgattagtctggacagtatagcttccaactccccacatctc

SEQ ID NO: 104144 - DNA, 270 bp, Triticum aestivum
  Clone ID: PAT_TA_104144
cagacattggagaattgatcgtcgtcgtcaacaagcacatctatagtgccaagttctgtgaattctgaagcaactaactgctactacgctctgaaaaccacacctttgttgtaaatggtatgatctccatgacggattcccagtcccatggattactagcctatgtacaaccccgcggacgtgcgcatgccgctgtgggcaactccattgctgcaaacggatggattcgcattggcatcagtgatcatggcacttcatctcctccatcac

SEQ ID NO: 104145 - DNA, 322 bp, Triticum aestivum
  Clone ID: PAT_TA_104145
aggtgcgaaagtcactctagactctgcgtctagcatcacgttccatgcacctagctataaaatgatcaggacaagagcttctcaactggtccaagtatcttctcatcttctaatgaaactggtctgacccaacaccagctgggccgtccggccggaaagcgtgatagcttctcgcctccggcccgagcgacgcacccatgtagcccttcgacctagccagctgagtatccgcctccagcctcgacgcgacgggcacctctgcggccgccttcccgcagcgcgcacgggcgtccaagtccacggtcgtcatgctgctctggca

SEQ ID NO: 104146 - DNA, 146 bp, Triticum aestivum
  Clone ID: PAT_TA_104146
agttgttctgggctggttctggttcgttgtccttgggctcccctcctcccctccctccttcctttagccccttctccgtccaactcctttcgccacaccaccgctgtgctgcgcccaacatcaactccggtgctcgccccacaatc

SEQ ID NO: 104147 - DNA, 124 bp, Triticum aestivum
  Clone ID: PAT_TA_104147
aggccatgtggagtctattagtcatgatgccatgttacataggatttcttgtggcaattctttaggtcacatcatgtgtgacaatccgcttgacttgttgtcggtgtcaaaaccagcggatctc

SEQ ID NO: 104148 - DNA, 262 bp, Triticum aestivum
  Clone ID: PAT_TA_104148
ttttaaaaaaattaaatggactaactcaatgaaatttaacaaggcttccgatgcacgcttcaagtttatgaagcaatacacattttcctcctaattacctaagtaaaccaacattccaaataaatacgccatgaaagaaaactggtacatctactcaatggcttgtccatgagactgggagatagtagcctatatgatttcaacaaagtaattgtcgagcatatcagcaataatgcatcacctttagtggccttcaccaaag

SEQ ID NO: 104149 - DNA, 221 bp, Triticum aestivum
  Clone ID: PAT_TA_104149
agacgattgcaaaagcccgtttgcacacaaagccgagcccaggcgcgcttgtctgagagagcgacgaaaaccggctgctcgcccgacccacgcacctcccggaccaccacgccaccatggccgccgcctccctgtctcgcctctctcgccgcgcctccgccaccgcggcgccttccctccgtcggatactctcctccaccgccaccgcccccgctgcgcca

SEQ ID NO: 104150 - DNA, 150 bp, Triticum aestivum
  Clone ID: PAT_TA_104150
aatctcggctccggcaagcaagcaccagcgctctcctctcccctcgcttcctcgctgcaatgtcgaccgacgtggccgccgatgtcccggcccctgaagtggaagtggccgccgaccccgtcgtggagaccacggccgaagccgccgccg

SEQ ID NO: 104151 - DNA, 226 bp, Triticum aestivum
  Clone ID: PAT_TA_104151
attgcatgatgatcttgaaacattttggacgagcaagctgaactccaaatgatccattctgaatcattttctcgaacaatcgctataactatatggtggtagcagtctctctgccaagatttgacgcgataaatcgccacctaggttcaaatcctctcaggccagatccgggtgtccaacccataaatctcatttcagtaagaacaaacgaacgaatgacgccatg

SEQ ID NO: 104152 - DNA, 300 bp, Triticum aestivum
  Clone ID: PAT_TA_104152
agtaccaacgaactgggcctgtcaaaacaaatatggcgtccaagtccaactgcgttctcctcttggccgccgtcctagtctccatctttgccgccgttgccgccatcggcaatgaagaatgcaccccatggatgagtactctgatcactccactcccaagctgccgtgactatgtggaacaacaagcatgtcgcatcgaaacgcccgggtcgccgtacctcgccaagcagcagtgctgtggggagcttgcaaacattccgcagcagtgccgatgccaggcgctgcgctacttcatggggc

SEQ ID NO: 104153 - DNA, 146 bp, Triticum aestivum
  Clone ID: PAT_TA_104153
ttttttttcagaattaaattcataggcatcgacaacatcacgatcatatatctctgctcgtttgtaacagcgtttgaaagacattgttcgtaacaaaatttggtcacacgagttctacacacggacgggtacacaacacaacccga

SEQ ID NO: 104154 - DNA, 279 bp, Triticum aestivum
  Clone ID: PAT_TA_104154
agcatccccttccccttcccctcacgcgcgcgacctcgtcgtcgtcgtcgtctcggagatctcgccttcccgccggcagcagccatggacgccgtcgactccgtggtggaccccctccgcgagttcgccaaggacagcgtccgcctcgtcaagcgctgccacaagcccgaccgcaaggagttcaccaaggtggcggcgcggacggcgatcgggttcgtcgtcatggggttcgtcggcttcttcgtcaagctcatcttcatccccatcaacaacatcatc

SEQ ID NO: 104155 - DNA, 400 bp, Triticum aestivum
  unsure (1)..(400): unsure at all n locations
  Clone ID: PAT_TA_104155
tgcaannaangctcttgcncaatttntggatgganctgangtgacctggggaagggttnaantannagcntctacangtgatantaccctctcncttagcaacntctncgnggagttngactatagagngngtgcgancttcctttacaagtatcnnaanccatggatttganatnagtttacccgntgatcctgaanctggaggactanaccnagggantagttntcncncatttgcttcncctgacnncgccnnagntgcatctcatctgcnncnnnnaccggatgcattgattacccttgttnanatttgaaanggaatctgctccgatccctacaggaatctangtcggatcntgcnatnntgcnggttaacacagttattccccaacatgttcct

SEQ ID NO: 104156 - DNA, 400 bp, Triticum aestivum
  unsure (1)..(400): unsure at all n locations
  Clone ID: PAT_TA_104156
ggttcttacatnanantgcatntcncattattttttcnccgctacaacaaccaaaccatgggactgaaaaaacggngttncatatatctantactaaatttatttcctncncagttagtaccnaaaatnccaaatggcncaatggtgcaatntggagggatntnaacattgcncnttgcaggtnncntctgtancnctaggttccntattnccccctactggggcanttnttaaggctggacaaaccctgggcctntgggttttgctnaaatgccgnaaaggaccccggcctaatggatnttnttgcaaaagctnttggaaagaaaccnggctccaaggttgttgttgttgttttngttngtngaancccaaataataccatgaacaacattgttgnatg

SEQ ID NO: 104157 - DNA, 400 bp, Triticum aestivum
  unsure (1)..(400): unsure at all n locations
  Clone ID: PAT_TA_104157
gctcatcaagaacgctgcctacattggcacccctggcaagggtatccttgctgctgatgaatccaccggcaccatcggcaagcgcttcgccagcatcaatgttgagaacgttgangacaaccgtcgtgccctccgtgagctcctcttctgcacccctggtgccctccagtacctcagcggtgtgatcctgtttgangaaaccctgtaccagancaccaagggtggcaagcccttcgtcnacatcctcaaagcgggcaatgtcctccccggcatcaagtggacaaaggcaccatccaacttgcttggaacaacggtgagaccaccaccccangctttgatgaccttgngcaacgctgtgcccaattctacaaagctggtgcccgcttcccccaattgcttg

SEQ ID NO: 104158 - DNA, 400 bp, Triticum aestivum
  unsure (1)..(400): unsure at all n locations
  Clone ID: PAT_TA_104158
tcctctctctctctctccaccgcatggcccatncctccctccgtccgtccccatgcccccngccgcgtgcgccnattccgggngnngcgcncccgccgctcccggtctcncgccnctgcccttcgtcntncccntcnnccgttcacgtgtttcnctcccctncggngccttccntcactagcatnctnctnnaatgtctnttcgtcctcncccncgangctgcntccgcctntgnntntgcttctttcgtnncngtccganntgtgtantnggcccnctggaacnngtacttcccnnatgtgnnaactgtccnnagatccnnnccntccntgctnccntattcantnngaangacgctgttnanggncaannannttncnncaagtcttnngcctcnatt

SEQ ID NO: 104159 - DNA, 400 bp, Triticum aestivum
  unsure (1)..(400): unsure at all n locations
  Clone ID: PAT_TA_104159
catanaaaaactccatcnctgcagaaaatccgctcctctcgatcccatcccagggatcgaagtccctccttcgatgccacgatctncgatctctctgccgccgactcttccgacccttgccgccgacgcttcattgccgcggcccacntanaaagtcnttcgttgccgccgccgccgtccaagggganacaccgtcntcttcgtctccacggcaaggcggttttgaatccctnccgccnacatncgggatcgccgccgccgaactcccgganacgtcgtnnccgcccgtccnagggaagaagccgccncngcggnggtttncatcccnagtntgctnaaaaaaatctggctgccntgtaatctcacagncgaactccatncantctacacatgtgtttct

SEQ ID NO: 104160 - DNA, 400 bp, Triticum aestivum
  unsure (1)..(400): unsure at all n locations
  Clone ID: PAT_TA_104160
cgctgccttctctactgcaccgccgcagccatggtgaaatactcgacggatcccgccaatcccaccaantccgccaangccatgggccgggacctgcgtgttcatttcaagaacactaaggaaacagcgtttgccctgangaanatgtcgctcaacaaggccaanaagtacttgaggatgtnttggcacacaagcaagccatccccttccggaagttatgccgtggtgttnggacgcncacccaagtnaanaaccgtccngcccnatggtccaggaaccctngcctgccaatctgctaattccntctgattttcntaaaaatgctgaaaaccatccgaagtgaaagtctgantttnaatccccccactttcccctcccanttnaacccagcccnaaaaca

SEQ ID NO: 104161 - DNA, 400 bp, Triticum aestivum
  unsure (1)..(400): unsure at all n locations
  Clone ID: PAT_TA_104161
caacagccaggacaagcgcaacaatcaggacaatggcaactagtgtactacccaacttctccgcaacanccaggacaattgcaacaaccagcacaagggcaacaagggtnctacccaacttctccacaacagtcaggacaagggcaacaagggtactacccancttctccgctacactcagganaacggctacaanggtantacccnacttctccgctacaatcaagacaacggctgcanccatganaaggacaacagccacnacaagggcaacaagggtnctacccantttctcngntacaatctnggacaagggcaacaaccangacnanggcaacaangatnntacccaacttctcngntcnatcatgacaanggcaacaaccntgacatnagctac

SEQ ID NO: 104162 - DNA, 400 bp, Triticum aestivum
  unsure (1)..(400): unsure at all n locations
  Clone ID: PAT_TA_104162
cgtctcgaccggcacgacccatttccgtcggcggcgctgctcgctttgcactgccagcacggcggacgtccccggcgcgagcgcgcaggtnagcatggagcgcattggcgaagcccaccaggtgcaccagctgcagcaggtccagcagcanggggtggcggcggcgccgtcgttcggcgtggtcgaacactctgttgtngcngcggcggcggcggcggcgaccaatccgaaggcgccggggctgccgccgacnccgcccgcgtccttcnccgggcagcaacgcngtgcgggcggcgacatntgcatggacgactcctcnggggcngcngggcgcaaacangtcnttccggcgcancgccggtctctcaacgangtnccgttcccgggcttcttcccgccg

SEQ ID NO: 104163 - DNA, 400 bp, Triticum aestivum
  unsure (1)..(400): unsure at all n locations
  Clone ID: PAT_TA_104163
gcgccgcctcctctcggctccttcttccttcnaatttcagccatgggtnaggagaagatcacatcaacatcgtggtcattggccatgtcnactccggtaagtcgaccaccactggccatctgatctacaagcttgggaggtattgacaagcgtgtgatcnaaaagttcgagaaagaagccgctganatgaacaagcggtcgttcaantacgcctgggtgcttgacaactgaagccgacgtnagaagggtttcccattgatattgcctgtntgaaatttcnaaaaccaccaaattctactgcaccncctttgaagcccccggtcccccnnnaantnctncaaaanntnaatctgnttccccccngcnganagngtgtgctccnccctnaanccccncngtn

SEQ ID NO: 104164 - DNA, 400 bp, Triticum aestivum
  unsure (1)..(400): unsure at all n locations
  Clone ID: PAT_TA_104164
aaatccccatctcctcccccgtatccctcctctctcccgtccctctnccctccccctctctcctccctaaggttcgggtctctcctcccccgtcgccatgatacatccaccgncgccgtcncagccgctancgggcatgggcgcccccatnccnccgcatggcgcgggagggcanccgccncactggggcncgattccgncgccnatnccccactacgcgcanncntctcctcagcatcaactnccgtcncangccatgttnggancagncgtcgtncccntgncncnccctacgnntacgtncctntcccnttncnnttactncgcctctgtncctanggccctgctgccnccntcnggnnctgantaagttntggactctcttgatttgnnanctccn

SEQ ID NO: 104165 - DNA, 400 bp, Triticum aestivum
  unsure (1)..(400): unsure at all n locations
  Clone ID: PAT_TA_104165
ccaacttcgccctcgacaaccatccatgtccgtcgccaccgcccaccacctccgcccgtcgccaccggcggcccgcgaccgcctccccgggtgcgccgcgcgcgcctcctccttccggcccntgcnccgccncggantctccgcgggggcgaccgccggcggcgatgcgaccgccgtcgtgtcngcggtcaacacnaacgccaattagggatcnccgggactgcnnggttcggcgccacncnatttcggtcttcntccgggacnanaacggcntgatanacnngatcnccggggtcttcnccacganaagctactncntctnantngttcgccgtggggctcaacnncgacaaggcgctcttctcaatngtcttctccngganggatangggtgcccnan

SEQ ID NO: 104166 - DNA, 400 bp, Triticum aestivum
  unsure (1)..(400): unsure at all n locations
  Clone ID: PAT_TA_104166
gtttgtcttttattcccaagtttgaactagtatagttcgggttcttacatgatagtgcatgtcacattattttttcaccgctacaacgaccaaaccatggactgagaaaacggtgtttcatatatctagtactaaanttattttcttctcagttagtaccgaanatgccaaatggcgcgatggtgcaatatggagggatgtngacattgcacattgcaggtagcgtctgtagcgctaggttccttatttcctccaactggggcagttgttgaggctggacanaccctgggcctgtgggttttgctgaaatggccggaaagaccctggcctaacggatattgttgccaaagctgttggaaagaaaactggctccaaggttgttgttgttgtttttgtttgt

SEQ ID NO: 104167 - DNA, 400 bp, Triticum aestivum
  unsure (1)..(400): unsure at all n locations
  Clone ID: PAT_TA_104167
tggactcttacttgcgtctttacattcaagatcttttgcagatactaacttacttgccttttcattgtgcacggccttggtggttcttggaanaaaacataaaggtgccatgccagccaagcagcatcattggatgtctttgcaggcattattaccctggcctggtccccatanganacngtgangaagatccancttggtcttgggaacattggaaannnncccggataccgaagacaagtggggcagggtgtacagcagtgcttacgtntcagaaagaagaatagggagaaaagttagggcgaaagaaccgctcaatacattccatgggattatttctctccccaattccaaagaaacccnaaaggggtngggttccacccaaagtncctggcttgaa

SEQ ID NO: 104168 - DNA, 400 bp, Triticum aestivum
  unsure (1)..(400): unsure at all n locations
  Clone ID: PAT_TA_104168
aaaaaaagacacagatagactgagcgaccgacaccggcgacatctccggcggcgggcgacgcgaggcgatggcgggccgccgctcccgctccccctcgctctcctccccctcctcccgctccctctcctccttctcctcggtctcctccccgtcccgcanccgctcccctcccgaccgcggccgccgcagctcgtccgccgcgcggaggggccgctcgccgccgccgccgcgggaggggcccaagggangccgcccgacctcgccttcgccgccgcccaagaaaccctcgcctccccctccagcaccgangaagccctcccccgctccggtcccgacgaatcntcgctcgtcctcctcgtcagccgcctctcccgcaacgtcaccgaaggccatctcang

SEQ ID NO: 104169 - DNA, 400 bp, Triticum aestivum
  unsure (1)..(400): unsure at all n locations
  Clone ID: PAT_TA_104169
ccactcagtcctcggttcccggcccggttcggttcgttnnggtttagtattggggaacaagangaacaatggcggacgtcnagtnccgctgcttcgtctgcggcctcncctgngccaccgacgaccantccctccntaacnccttccccaantacngcgatatcnncnactccnngatnatctctgatanggtanaccggncgttcccgcgggttcnggttngtctcctccncntctgacnangcntatnncncctggccatccacgcccntaanccgccntttacctnnnattgtcnccccntcttccgttctattatgcccnctccccnccnctcctgcnngatgnngnnnntngtttccatccnntcncatgctggntntgcgnttttcntntggnt

SEQ ID NO: 104170 - DNA, 400 bp, Triticum aestivum
  unsure (1)..(400): unsure at all n locations
  Clone ID: PAT_TA_104170
anancatggtctncncntncntcnncncncnccgncncntggacncccnccngntctncgncnnggcancnncatctncctccggaagatncgtcgnngnggtggcnnttcngaccaatcttntgcctnnntnccnngcactatgtgttacaacatgcttntngcagatcagcctncagtcatagttangtgaatgagatnacatctagcatgcanntntcncntatgaaacnatgcctctctnanttatattatctgtcattacctcgcngaaatntctcgtnaatnccngtgtgatgcgnngcacnncttccnnacntntccggttccgcnccgtctagtangacnnaaagtccggnancctnggtgagaancggnccctcgaattaccnggatacgc

SEQ ID NO: 104171 - DNA, 400 bp, Triticum aestivum
  unsure (1)..(400): unsure at all n locations
  Clone ID: PAT_TA_104171
cctccccggccatggatgtcttttttgtacaantcccatntcatcntatttcatcatgtaanttttacacacatntgcctcacatccttgtttacttgttaaaaaaatcngatttttttgaaacctatttatttttaattttnaatttatcaaaaattangcctccanggaggccaatatccaaaacnccantctcctaatgatgtcctttctttcagatataaangnaanancntcncgcccacaaanctnaantttacttctttccaacntcncgntnctgngncgaaacaacntgagggtccctgaaaagtgcaaaccttctgtatttgtagtattacatganatnaaagcattgactttggnactaggattttangtcngtactatctcccttccg

SEQ ID NO: 104172 - DNA, 400 bp, Triticum aestivum
  unsure (1)..(400): unsure at all n locations
  Clone ID: PAT_TA_104172
gcttgctttggataaagagccaaaaggctttcagttgaaactactcctaatcaggaccctcttgtgaccaaagggtcaaacctgcatcctttgttgggaattgatgtctgggaacatgcgtactacctgcagtacaagaacgtgaggccggactacctgaccaacatctggaaggtggtgaaactggaaantatgctggaaaaaaantataaaaaantgcttgcntnattgtctnatnantaaacaaacagtncttgggcncccnctgaatttncccccngttgnttcttnntttatccnttaanaaantggggccctatccncngtcgggaactccntttntttgccntaaaggtnaaccancnntttaaccccccaattcnnttccantttggggnct

SEQ ID NO: 104173 - DNA, 400 bp, Triticum aestivum
  unsure (1)..(400): unsure at all n locations
  Clone ID: PAT_TA_104173
agctttacnagtacaaagcatataagtgtgtanttccnnattcngaaaacagacagaagtnncagcttagacaggcacnttttttttgctactgtcaaccaagantacagctcaagaaccaaccacaccgcaccgcatgccctttgatcatttanacatagctgtcaatcagcgacttcctcatgtcntcgacnatcgccgtgggctggccttctctcaacttgaanacgctctcaatgacngacagctcggtaccgtggtgtctgaccacanaagcggtccatccttcccccgtcatgcccgcancaatgacctcnctaccacggttcacggttcccactccgtgccnaattccatatcaaccttatcgataccgtccacctccaaaggggggcccngg

SEQ ID NO: 104174 - DNA, 400 bp, Triticum aestivum
  unsure (1)..(400): unsure at all n locations
  Clone ID: PAT_TA_104174
tagtgcatgtcacattattttttcaccgctacaacgaccaaaccatggactgagaaaacggtgtttcatatatctagtactanagttattttcttctcagttagtaccgaanatgccaaatggcgcgatggtgcaatatggagggatgtagacattgcacattgcaggtancgtctgtagggctangttccttatttcctcgaactggggcagttgttgaggctggacaaaccctgggcctgtgggttttgctgaaatggccggaaggaccctggcctaatggatattgttgcagaagctgttggaaagaaacctggctcgatggttgttgttgttgtttttgtngttgatgccaaataatancatgaacaacattgtggatggccctnccactgcgact

SEQ ID NO: 104175 - DNA, 400 bp, Triticum aestivum
  unsure (1)..(400): unsure at all n locations
  Clone ID: PAT_TA_104175
ttttntttttttttttgtttgttnttnnnnntntttntgtnnantttnntantttttttttattttnntncncaaaaantgntngtntttttgcaaaaaaaaaaataaaancaanctcaanaaaagggtnngtangttttttntntnaantccccaaanctgccctntntgnttcncnaaannggaaaaacaatccnnctcntattannncanaaaaaaaggagtnccccccctngggatgtgggnggggggggngtgacnacctngtcaaaaannnnnntnacnaanaanaaaagaancccccngttgaaaattctncccntncccctgtccntttctnnnaaagtnatnccggaaaaaaaaaaaaanaaccctcnnaagctnttnattntttttntat

SEQ ID NO: 104176 - DNA, 400 bp, Triticum aestivum
  unsure (1)..(400): unsure at all n locations
  Clone ID: PAT_TA_104176
cctccatcgtacaancaaacaaccgtacntntcagcntgcccacncccacacacggctcaaatcagatcanattcanaatgtacattgccaaanaaaaaaataantaaaatgcantaagcccaaatccanaagtccgacaanctangcgancgtcaccggcgccggggagcnacaanggctatatcaaatggcggcttcgtcccagntggcggcccanttggtggcgctaccgacgcggggcatggaattnatcttggtgaangcgtcnaccttgaatttggcnccgcacatgacccctcgctgtccaccgcgggancccttgctcctgccnaattccatatcaacttatcgataccgtcgacctncaaaggggggcccggtacccaatccccccnataa

SEQ ID NO: 104177 - DNA, 400 bp, Triticum aestivum
  unsure (1)..(400): unsure at all n locations
  Clone ID: PAT_TA_104177
gcagcaacaacaaccaccattttcgcagcaacaacaacaaccaccatttacacagcaacaacaaccatcgttttcacaacagccaccaatttcacagcagcagcagcagcaacaacaacaacaacaaccatttacacagcaacaacaaccaccattttcacaacagccaccantttcacagcagcaacnaccaccattttcgcagcancaacaaccaccatttncacagcaactanaaataccagttantcatccatctgttttgcagcagctaaanccatgcaaggtattcctccagcagcagtgcatcncggtggnaatncancgattcttgctatgtcnnnaatgttgcancaaaacatttgccatgttgatgcagcnacnatgttnncagcagttg

SEQ ID NO: 104178 - DNA, 400 bp, Triticum aestivum
  unsure (1)..(400): unsure at all n locations
  Clone ID: PAT_TA_104178
tctatgttctttctttgatctacatgacanaaaatagtctttttcaattcagtgtagtacgcacacacacacgcacaacaaatccgcatttttttggctgacatctattcaggcataaatacaaacacattttttatgtactatagctcgcctgcaantatcattcttcttttatcggactcganttctctgcaatccttgaagctccattgggaagctagcaagcaacactagtgctctcagatgaaaatcaaacgaccaaaaaatagcctctccacctccatgggttcgttcacnatctacttctgcttgttanactccatcgccgggtggtgcacctgctgctgctaacattatnaaanaaatactgttcctaagcaaccttacaaaagcaaaaatc

SEQ ID NO: 104179 - DNA, 400 bp, Triticum aestivum
  unsure (1)..(400): unsure at all n locations
  Clone ID: PAT_TA_104179
tggncctccttgatatcagtggcgaccaccgccacaaatgcagttanagttccagtgccacaattgcanccacaaaatcnatctcaacaanagccacaagagcaanttccattggtacaacaacaacaatttctagggcagnaacaaccatttccaccncaacaaccatatccacagccgcaaccatttccatcacaacaaccatatntgcaactgcaaccatttctgcagccgcaactacnanattcacagccacaaccatttcgaccacaacaaccatatccacnaccgcaaccacaagtatncgcaaccacaacaaccaatttcacngcngcancanncagcagcagcaacnacaacancaacnacnacnacaactacaaataaatcattcgncaan

SEQ ID NO: 104180 - DNA, 400 bp, Triticum aestivum
  unsure (1)..(400): unsure at all n locations
  Clone ID: PAT_TA_104180
ctatggcattatgccagatgagccacatttagatttttgatattaacagaaatttttcaccttccacgggatgtctaaatgatctatagtccacatgggatatatgatcacatagagattcgacacataaattaccatttttagtacaattccatgaatttgtatccgtcgatcggtctctggtgatggcttgcaccgacctataacgggatttcacttctgtggtcagcgccatcaccctcatcgtcgcggtcatcggggctgangganaccatctcgaattcagacccccggtggcgaaagcctccttgcgttacaaaaatttctctcnccacnttnacngtgcggtaagcgggcttgcccacgcccacggcttcccctgaancggcctaccttgact

SEQ ID NO: 104181 - DNA, 400 bp, Triticum aestivum
  unsure (1)..(400): unsure at all n locations
  Clone ID: PAT_TA_104181
cgcaactccccggacccgccgggcacctccggctcgcccttgccgtcaccgcctccttcgccatcagctgcatcggccgctcccgccgccgccgccgcgcgaancacaagcgcatcgcgttcccacccccgccgctccgccgactggtctcctcctccatccgccgactcctcccgcgcccgcgcccgctcggcggcggatggcccgggcgaagggggaggcggaaggcgcccgccgangactggtgctgctcgtcctctctctggccctgggcgacaggctcgccgtcctcncngaagcctggcgcgcntcnggcctgggccaagcgctcngcatctgggccgcggtgttggggcgggccaagaagaagaaaaaagacaaacgggctcccgaaggctcn

SEQ ID NO: 104182 - DNA, 400 bp, Triticum aestivum
  unsure (1)..(400): unsure at all n locations
  Clone ID: PAT_TA_104182
ggttcacaacaacaatatattacaagttgacaaccataacaaatgaaagaaccattagttcaaagtccacacatgcatacatatgcaacaagagttcacaaacgaaaggaccgtgagttccaagtccacacatgcatacatatccaacaaangttcacaacaacatacatgtaaccagaagttcacaaatgaaaggaccatganttccaagttcacaccaagcatgaacctaaaagatgcaatgagctccaccgcaacatgtntgcccacccgtcaacggcatccacgatgcaaactcnattgatcattgttgcggggaagattcgaacnacatgacccntattggtgggtnttcactgggcttgcttggccagttttagtcccacaaatttgaaattta

SEQ ID NO: 104183 - DNA, 400 bp, Triticum aestivum
  unsure (1)..(400): unsure at all n locations
  Clone ID: PAT_TA_104183
gacttggaccgtgatgatgatgatgatgatgtgttgtcaaccagtgaaaaaggcaccatgaagtcaaaatgtanaaggcagaananagccaaatattgtattgcagagacagaagaaagcgacatgtgtgtggtgtgcagcctaaactactatctttcatgctacattgatggtatgcccatcactgatattggcacagcggcactctggaaatggcttacatccttctangancgaatggagaacgtcttcggactggactaacataacctcttcttggtgaaaacgccttggtgatctgaatcttcgagggggtggagaaggaaaccgtcttcnaactggatatcctggtctcangctaagaagtgttctgccgccctgaataaaagaagatcttccc

SEQ ID NO: 104184 - DNA, 400 bp, Triticum aestivum
  unsure (1)..(400): unsure at all n locations
  Clone ID: PAT_TA_104184
tttcatttcaatctnngaancatagcgaacacaagcggggacagaacagtnacacggaacggtancancgtcacatctaacggtancctgaacatctcngaacctncccgacggacctanatctangatnctcnggaccgcagcgancgatatcntttnggtnnacangttnanacggatccggtntttttgatanctggcccccntagggggngcntcattctttccctctatttncngccntcnagatacntccttccgcttttnntcttaccctcctccntcttcttctntntttcngncctcccccctctctgttttcctttcccnttnctccctcntcagnantcttcntcntntcntcccccnttnnttccttctttcttttncccttctctcc

SEQ ID NO: 104185 - DNA, 400 bp, Triticum aestivum
  unsure (1)..(400): unsure at all n locations
  Clone ID: PAT_TA_104185
antgatactctntnttctcattcataccngatnacccantnttnttgaccgcgcggatctcacttatntntanttncacaccacccacntatagatgntccatnnctgctgantaataaacnactgganttgntcnctatatccnaagaagnngttcccnaganggggnggaancggaaccttntgaatngtcaccaacttncactggcccggggcgactaatantctgacgagtngcctgcnntccctgccggcanccgggcncattgatcatgacgctctcacngggcttgccggacctccggtcctccacgctaacacagtacnagcactctgtnnattttngcaacgnctcccacnggtactgcctnagaatttcttcgagntcccngntatccat

SEQ ID NO: 104186 - DNA, 400 bp, Triticum aestivum
  unsure (1)..(400): unsure at all n locations
  Clone ID: PAT_TA_104186
cccaacccgagcgagcaccggccgaggaggaagaggaaggtgagatggctcgcggcacggcggcgacggcggcggcggctgccaagggcaaaaaaaaggggtccgtctccttcgtgatcgactgcaccaagcccgtggaggacaagatcatggagatcgcgtcgctggagaagttcctccaagaacgcatcaaggtcgccggcggcaangccgggaatctcggcgactccgtcaccgtcacgcgcgacaagagcaangtcaccgtcacctccgacggcgccttctccaagaagtncctcaagttcttgacaaagaattcttgaagaagcacaacgtgcgggactggcttcctgtnattcccnnccnacaaggancgcaacgtgttcnaactccggttctt

SEQ ID NO: 104187 - DNA, 547 bp, Triticum aestivum
  Clone ID: PAT_TA_104187
ttctttgtgcttgtgtgggctacatcgttgggcctatttacgggtttttgtttctcttagttcgcttcttcttttcgtttacttttagtttctttgtgtgatttctaagcttccaacttttctcagtttcaaatctctgtacagtgtttgtaaaggatgtatgctggtgcaaaatcttccaatccggctgtgacaaatcttccttggacagcccggccaccttttgcacataaggatgggctacgtgtgttaaacattagtggcgcagtgctcgtttcactcagctatggaggcttggagttcgtcagattccaatcctcctagtaaagcaagctcacatcttcccccttttttcttcccagtctccacatggttttgtgttttggaaaagagaaacgagattttccctgcttccgattgcttggtttgctgtcttgtgttgacggagacatttggatctgcaagttttcattttggtgatgttaaaacgagccagatctgcagtccttgagagatgaagatgttggaaactatttgttgtttcagt

SEQ ID NO: 104188 - DNA, 563 bp, Triticum aestivum
  Clone ID: PAT_TA_104188
ctcgttcttctgctgtttttgtgccgtgatgattgctttacttctgacacctcttgtacgagaagcgccttgatgcgcttcgctgagcagattgcagcaaacatatctgagcacagtcacacgctaatttgtttgtttatttttgatggatttgcaacgacaactagtatcttggtaagaatcgttggccgtgatgagcactgcttatttctgacacctcttgtatgagaagggactcgtcccttccatgagcagattagcaaccctctgagctcatcttacgatcaagatctcatcctgtgaatgtcccttttccgtttggttatttttcttgtcatttggcttcaatatgggcaacagctgtgacgagcatcgatttcttctgacacctcttgtatgagaagtgtgccactctctcgagagaggcacccttcgttgagcagagtatagcaactgtctgagcttttcttatgttgcttgcgccagctttacaattttcgttggccatagtatagcctgttacggttgtcctcctggttgactctctgagattagttgtgtgt

SEQ ID NO: 104189 - DNA, 571 bp, Triticum aestivum
  Clone ID: PAT_TA_104189
gcacaaatacctgctcaggtattttccagttattttaacttcttgcaatatgtttgctgacacttactcgattcagatacagtatgttggctgaatcttactccgttcagatatctctcttctttggctctttgctttggctcggatatgtctttgcaaaagaattttttgccaccaattaatttgcaagggcacatagtatttgtagcagcgtacaaaaactcaattcacctcatgcttttgtagaaatggattgtcgcacgaagttgtctcagttagtagactatatttgttaacgtatagttattttttgtgagaagtaaacatatagttttttgacggcagtatacttatataatattcttattgttgagatactaaaaacattttggttaattattacttactgtgacacttcagtaagtcttttgagtaggcaaaatctctcaatttatattgccataataggcgatgtctcattcatggcatcaaatacagcttattttagaatggtacatatgtaatgtttggcttccttatatcatgtatgctttccgtttgctgtaaacta

SEQ ID NO: 104190 - DNA, 301 bp, Triticum aestivum
  Clone ID: PAT_TA_104190
tgacaatgagctcatcagacaaacggcctcattaggtatgtattcgtaattgagatctagaacaaagcagcttttggggactccaggagttgaacaactgaagcaacgcctattggtaatgtttcacctgtcaaagctagaagtaacagccttctatagattgcgatgcaacctcacgacagtaggccgtttttccccgtgacttttgtaatgctggattgcttgcacggggttaccgcatgatgcttcatctcagttgtgtcttcagatatttacagaaacatatttgtagtggaagttt

SEQ ID NO: 104191 - DNA, 581 bp, Triticum aestivum
  Clone ID: PAT_TA_104191
aaacccgatcgatcgatcgccgcatctcacctcatggcgctgcgtaaccttgtgaccaggatggggaccccggccgccgccgctctccggccgccgtcggtatcccgcggggcgcaggcggcgcgctctcggcccttctcccgtcaggttgaacacgaggatatttccaagatacgtgctaaaaagaagtatgagttcagtctgttcctccttgaacggtcagaaaaacagctggagtctgcgaaggtctgggctcagaggtttcaaagggcagacaagtacctgggttggactctcaaggtggtcatgcctgcttctcttgtggctgtgatagcagggtccaagtaggcgatcaaatgtccattcgctgttttgtttattgatgatggcatgtgttatgtacgggcgctctacttatggctcttgtgcactttgtctatagcatgttatgtaagtctcggcttatggcggttcgaatatgatcactatgatgatgataacattacctggtgaaagatgagccgggcagttttattaatgcagcagaacatattgttgtcctgaaaaaaatcatatgagac

SEQ ID NO: 104192 - DNA, 634 bp, Triticum aestivum
  Clone ID: PAT_TA_104192
attaccatgatttaattaaaatagactttatattatactttttaactaaatgtaattttaagatcatcattctaaatttaaaatgttatattttccaaccattatatctgttcttgaagtattggctgttactgtacctgttttattaacagtagcgtttgtaactatagctgagagaaaaacaatggctagcatgcaaagaagactgggacctaatgcagtgggttgatatggtctacttcaagcatttgccgatgctcttaaacttttattaaaagagtatgtttctcctacacaagccaatatagtattatttttccttggtccgattataactttaatcttttcattattaggatacgccgtaataccttatggtcctggtttagtgctactagattataatctgggtatattatatatgttagctatgtcttcattagctacatatggaattctgctggctggatggtcagctaattctaaatatgcttttttagggtctttaagaagtacagctcaattaattagttatgaattaattttaagttctgctatacttttagtagtattattagcaggtagcttagacataactgttattatagaagctcaaagagctatttgatatgta

SEQ ID NO: 104193 - DNA, 430 bp, Triticum aestivum
  Clone ID: PAT_TA_104193
atgtaaccttgcacctacctattttttgacctggcaggtaaagagaatacttgaactatggactccgttgttgatttttcaccccaccgacaacgattttagccaggaaggccatggccgctgctcttccccactccgccgtgacctcactgcatgaccccgtctctatggacggccaccggagtccccatcgtcccgtcgatttgggatccgccaaggaggctctcctaggcatttcgccatcgacgcggctaccatctaggctctgatgagcagccgtctggtttcatcctcctcgcacactcgatgaaatttatgcaatgtaaattttgttaacgtatctttttttcgttgtgcacgaagatatagtttgatggagttgtcatgaatccaatgctttatttaggtgtaccatgacattagagagtcc

SEQ ID NO: 104194 - DNA, 560 bp, Triticum aestivum
  Clone ID: PAT_TA_104194
ccaacgactacatctgctgctactacagcgacgccgcgagcgggacggccaccgtggccgtcggcagcgggggcgggagcggcactagcaaggccggcgtggcgaggatggtggttgtttccaaggggccgagcaagttcctggccgcgcacgggctggagcagtggtgggctgacgatgtcgagctgcaggtggcgctcaaccacagcaaactcgtcgaccgccagctcaggtcgctctacgccccgccaccagccgcaccagccgctcggagttaggcacgtgtgccatggtactattgacttattatcattgttttttttttcgttgaatggttattgccattgttgctgttcatgttgggtccttgcggctggggttaatgatgtgcccaattctttttttacagacccaatttgacatattggtttataccctccccgtcccataatataagatgtttttgcaggctatattaacttgcaaaattgtggaacggaagaagtactaaataaaacagatcttgtcgaagtcgtctcttaaaaaaaaaaaaaaaaact

SEQ ID NO: 104195 - DNA, 651 bp, Triticum aestivum
  Clone ID: PAT_TA_104195
tcgcggcagtcccgtatcctcgcggcgttgtctaagaaggtgatagatctcgatgagctccggatgctcgctgcgcagggcgtccccgacggcgccggcgtccggtctactgtgtggaagctgctactgggctatctgcccaaggatcgtgcactgtgggagcaggagttggcaaaaaagaggtcacaatatgaagccttcaaagacgaattccttcccaacactgtaggtggaagtagcacgcctgggggatcagaaggccacagtgacggaaatgcagagcatgttgagaatgggtttcttgacaggtcggagatagcccaagatgatcatcctttgagccttgggaagaccagccaatggaatcaggtcgctgagcattcggagatgatcgagcaggttgaccgtgatgtaaaacgcactcaccctgacatacatttcttctgtggagactcttcttttgcaaagtccaatcaggattctctgagaaatatattaattatctttgccaagctgaatgctgggataagatacgtgcaaggaatgaatgaaattttggcgcctctcttctttgtatttcggaatgatccagattataaaaatgctaacttcgccgaagccgattctttcttttgcttcgtggagttactt

SEQ ID NO: 104196 - DNA, 282 bp, Triticum aestivum
  Clone ID: PAT_TA_104196
ccttgcaggtggaggcgatccttcatggctggtagggaggggtccaaggtcatggcacggcttctgtttttctggtacaaaacagagatacaggaggatccagggaggagaagacagaacgggaacaaggaatggtgccacaggggtgagtgtgctgccgcctgccgcgcccaacgcttgatctaccgccgcctctcctcttcctatgctggctgctacacgtcacatctcgagccgctggcacttctccactgtccatgggccatggctgctctgatgcat

SEQ ID NO: 104197 - DNA, 489 bp, Triticum aestivum
  Clone ID: PAT_TA_104197
ggcaggcttattggaaatggatcttatggagacagaagctcagttagagcatacagtggcatcagttgaggctattagtgaacatcagagcatgttaaagtcttcaatctctgatatgcaacatgtgattgaagatctgaaggataagtatttgaaagctgaaaccagggctgagaatgctgaatcaaaatgtacattgttgacagataccaagttcgagcttagtgaagagatatcatttctgagaggtcgagttggaggtctagagaactcgttacgccaagctaaccaactaaagctgtccactgcaaaagatattggtattaaaactaagaccatcactgacttggttgcgaaacttgcattggaaagagaacgccttcatctgcagattgtcacgctaacaaggaagaacaggatgttgactcaaaaatgcaaagagaatgtcaatgaaggcaccttgttaagcaaaaaggttactgctaatga

SEQ ID NO: 104198 - DNA, 531 bp, Triticum aestivum
  Clone ID: PAT_TA_104198
caattgatctgatcgatgaggcatgtactttcatagccagaaagatgaagcagattgacaaccaactactagtagatgacaacactactcccaatagcttaaacgatgcaaataaaaaggtggttgtcaacccgaaaagtagctccacaaatagagtgaagaaagcaattgttgatccaaatgatgtcgcgcaggttgtgagtcgatggactggaattcctgttgctacgctttgtgaagaggagaaggacaaattaatccacattggagatagattgcatgagcgtgttattggtcaagatgaagcggtcaatttggttgcgcaagctgtgttacgctctagggccggccttgatcaacctagccaaccgacaggttctttcctctttttaggcccgtctggtgttggaaagacggagcttgcaaaagctcttgccgagcaactatttgacagtgaaaagatgcttgttcgggttgacatgtctgaatatgctactgctgggtctgtaacacgtctcattggagcacctc

SEQ ID NO: 104199 - DNA, 603 bp, Triticum aestivum
  Clone ID: PAT_TA_104199
tcggcacgaggtactttgtaacagtttgcaacctgtgatatagcttatgtcatggaatagatgtgtcctagctttatgaccgttcaaactcgttcgtaagcgtcatcatgcttttctgtgtacatttgatgggagcatactatatatatgttctgtttgtggcatattgaaaatgctcaggcaaaacagatccaacttgtccatacttccgtggaaggtcatctctcttatcgcatacagctgaagaagttcagcctttttgctgtcggaggtgcgtgatagtgatctggtgaaggatgcggaggctatagctaacggcctggctggtgcatccggtgattttctgttgaagagcattacttgtaataaatatcctcataaatttgaaattaagtaatcctggctaaactttcctcagattctgaagagctaaaactttgtgggaagaagtttttgaaaatcctagcacctgctgtttctgcttttctctgcaccttggagtgtgtgcatgaattgcaaatgttatggtagaagcttcactctttgttttgcttacacatacgctgccctgcagatggttgaagtcttcaatgcttacccctg

SEQ ID NO: 104200 - DNA, 315 bp, Triticum aestivum
  Clone ID: PAT_TA_104200
tggatgttgtgaatcggcgagtgcggattcagggagaagctgttactgtcatggctgggacactcttcgcttagcttgcatattgaccatccatggacttgctctatgaacttggaagaaataaatatatttgctgctatgtgctggttgttagaagtatatttacgtttaagataaagataagagatagaaataggataggtttaacttgtcctctactccatagtctctctccctccattgtacctctatatatacccctacacgggtcagatcaatacaacataatattcatccaaaaaaaaaaaaaaaaaa

SEQ ID NO: 104201 - DNA, 624 bp, Triticum aestivum
  Clone ID: PAT_TA_104201
tcttcaccctggtcgatcgactgactcagactatcattttgcgtttgaggtaaagaggccaccgattccacgttgtaaaattacatcgggttggaagtaattacgtttatcgttgagtcgaatctgcccccacttacccatcttttttctgagttgtcccttcgaacggtttgtgagtatcggcggcgatgcacacgcaggagacggcggtgtggttctcattgttttggctcggaccgaattaatcgattggctggctggcggggcggcgtgctctcggcagcgttgttgctgggccgctgggacagagtattctgtggcgtctgcctaggtcttgggcggcgtcctgcggggtcgtcgcggtggagccgtgatgggtgatcgtggcggcgctgcagtgtgtggccgagcttgcgctgcttcatgacggcattctgtaatgtttagattgaagtttggttgggtgcgagtgcacgggatgaggtgcgcaaccccaaaactgatgctatctcttctaaatttccaattaacttgcacctatgtttcactttgccatgctattcctcaattgctttgtcatgctcttctcaaatcgctagtctagcctggttcgctcaaaaaagc

SEQ ID NO: 104202 - DNA, 608 bp, Triticum aestivum
  unsure (1)..(608): unsure at all n locations
  Clone ID: PAT_TA_104202
accgtgtgtaattccagaacgcacacagattgataagacttgagcccttgaggacacctctacgctggctagccatgagcacttcttcgttccgatctgctaatgcatgaaatgtatgattcggtagtgtaattccagaacgcacctgggttgatatttgacaagactaggaagaacttctatgatggccagctatggtagttggagtatgtagtgtagggtgagaatatggtgacgaggacncanggaggaagagcacaaactttgttttgttgtcacccactcccctacgggctcggggtcgaggcgccgcttccggcctagctagccgcaagaaaacacaaagcgctccattttggagagtgccatggccccgcgtgccctgactccgatagtatcatgttggcgttggcattcgctgttggatttggacctctctatttgcttctctttcccccaatctacttttctttcctttttcttcccactttctccatttcaagatattaataaaaaacaaggatttcttcaactctttatgatttagtggaaaccttttcacctttcttaaaataaggactgagttgaaacttataccggggacgatc

SEQ ID NO: 104203 - DNA, 563 bp, Triticum aestivum
  Clone ID: PAT_TA_104203
acgctggggcagggcgggagccaggacttcttcgacctgtcggtcatcgacggcttcaatacgcccatgagcttccagcccgtcggcggcgcgccgtgccgtgcggcgacctgcgccgtggacatcaccagagagtgcctgccggagctgcaggtgcccggagggtgcgcgagcgcgtgcggcaagttcggcggcgacacctactgctgccggggccagttcgagcacaactgcccgccgaccaactactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagtcttcctcttacttattatgatcatccatcattctgcgtgtgcccatattatatactccgtatataatgtcacatatgtgcgtgcgtgcatggccggtgcgtgccattcagcgaataaatgtataaataaaatggaagtgtaatttct

SEQ ID NO: 104204 - DNA, 550 bp, Triticum aestivum
  unsure (1)..(550): unsure at all n locations
  Clone ID: PAT_TA_104204
aagtgggtgctagctacgagaagtttcaaaacacactantctgaaatgatatagtgttttttcttcctactgactacaaaatggtatcgccccatcttgcatgtagaacctgcaagcgtgttgagaaatcatcttatgtgcacacactgacagacctgcaagtcatcttgtgcttgagcttcctagatgatttatgcatgtgcatgcgtccacataaaaacgtgtagatgaatgtgttatcaacggtcggaaacctatacaatctagcttgacataattaatttttgttttcctttcgtactatatatagtttctcgtactctgtaaaatatcttttgtttaagctgcgtttggtagcaaagtttttttaaagttttctggcaataccatggtttcttaaaaaaagcatggttttgaatactttgatgtgtttagcttcagcaaaaactaaagttttgtaaaccacggtatccttgaaaccatggtctttttggagtatatggaaaagaggtcctgacctctttttttctagacagagcagagagaaaag

SEQ ID NO: 104205 - DNA, 549 bp, Triticum aestivum
  Clone ID: PAT_TA_104205
ttgtgcggtcgcgctggtcatcccccgtccgctccaggaagcatctcgccggggttggggtcaatcccgggtaggcctgaggaggagagagggcggcctccatcagtcctctccggtgaggcctcgaggggcaagatgctaccaagtgccatttgcttcagtgcattttgttcgatgaatctgcagtgctaacaaagaagatggaaaaggaaggaataatagtaggacatgcatgtgttattttccaagacttgttcgagataaagacccaatgagtcgtcggaaacttcccctgtctctgcagcagcatatgattgttcagagtgagagtttgtctgaaaattgttcaaaatgaggctctagcatgctgcacacggtgtaccaaagttccctcggagcaagagcaaatttaacaaggcaatacaacaaaacgtggagcagctaatggacatccaatcagctctcaaggcattcgaggagcgaggaacaatggatatatcgaataaaaaatgtaaccagctttccccgggtgaagaatcctccactaat

SEQ ID NO: 104206 - DNA, 452 bp, Triticum aestivum
  Clone ID: PAT_TA_104206
agtccttcttctggagggggtcgccggggactggagcaaccacatgacgccggcgatggctgtgcggctggacaagattgtcgaggatgcactccaagggtcggagttcaccttcaacgccatggctgaccggtaggccggcagggacgatcgatgctgagaaactagcacggccgggccggccggccgctccatgaacacaaggagtgaagcagaaggaatatcgatgcgatgttcagtagttcatgtaaaactgagagaggagtccactttactttctggacttgttgccatttactcctccactttagctatacttgcgtgtgttgcaacgggaaaaaaagtagtatacatttaaatttattgacaattatatgtgcaagcaaaaccgcgtgtgcacatcaagaatgaacttttagattctgagtttcatcaaaaaaaaaaaaaaaaaa

SEQ ID NO: 104207 - DNA, 603 bp, Triticum aestivum
  Clone ID: PAT_TA_104207
cgaatcaattagatgaagctcccattggtcacgccgaagtgaacttcctgaagagcaatttgtcagatttaatggacatatgggttcctcttgatgggaagtgtgatccagcaagcaaccctaagctacatttgagaatatttttgaacaactcgagaggaactgaagttgttctgaattacctggcaaagatggggaatgaagtcggtaagaagataaatttgcggtcagcacaaacaaatttagcattccgaaagctctttaacctccctcctgaagaattcctcatcgatgatttcacctgtcatctaaaacggaagatgccacttcagggacgcgtatttttttctccaagaataattggattctactctaatatatttggtcacaagaccaagtttttctttctgtgggaagacgttgatgatatccaggttatccctcctacactgtcaattggcagcccatccttgatggttatccttagaaaggatagagggtcagaagcaaaacatggtgccaaggcaacagatcatcatggaagactcaagttccattttcagtcctttgtttcgttcaatgatgctcacagaataatcatgg

SEQ ID NO: 104208 - DNA, 662 bp, Triticum aestivum
  Clone ID: PAT_TA_104208
cctccatacacagtattacctggagaaacaagtagcatccgactaagttggtggcggggttgcctgaccggatattattatttagcctcctaacaccagcgagcaggcattgaatcacatactcacaccagttgaactgcttaatcgtctcagtattagccagtgttccctagaaatcaataatgtcatatcatgctttctgaaaatttcagtatcttgttctctgccaggacaatggtgcagcgggtggtgcttaccttactcattgtccatgcactgaatttcaggtttagtttctgcagcatttgaaggtcaagcataccaccaaacccaatgctcgtaacaagaaatcgcttgaactcattgaatgtccagatgacatcgacaacgtgcttgacagatatacgagaggttggtgctgggggcacggctgggtcactgctctgtcctgaatcttggctagctgcctgcaggttctcgtcgcccatctctccctcacagctgcctccaactgacattttatgctgcagcattggtggaaaaaaataagcctggtattgtggactaaaaaatataaacctgggattcagactttcagagaattcaaaaaacatattgccttttctctgatatacagttatcaaatggatcctatataaaat

SEQ ID NO: 104209 - DNA, 250 bp, Triticum aestivum
  Clone ID: PAT_TA_104209
gagccggcggcggggcccaagccgtcggaggtgtacgggttcgtggggtccatcaccgtggtgatcgcgacggcggtgtacctggcgtgggcctacacgccggagccggtgctccgctcgctgggcatcacctactaccccaccaagtactgggcgctggccgtgccgtcgctcgccatggtcgccctcgcgctctccctcctcgcctacctcggctccaacttggtcgccacccctccccccacctcct

SEQ ID NO: 104210 - DNA, 611 bp, Triticum aestivum
  Clone ID: PAT_TA_104210
ggctgaggcgtgtgtggcgtcaaggcaccgggatggattactctccggcggtgcgcaagcccccgcgtcgcgcaggccccccggcgccgaggtctttgaaataaaagacttgttgcacaggcacgcgtaaccgagttctcctggtttaattctccattccataatgtagcgcacatagatattttacaagaattaaaccttacaaaatttgaccaattttttggagaaaacatttttatctagaaaacaaaacacatattattagatttactataagcagttccatattttatatatttggtattgtagatataaatagtttctctttataaacttggtcaaagtttgcaatgtttggcttttcaaaaaatctatacacattatattttatatggaacagagcgagtatttcggttgattgctcaaatcaactggtgtgtcctcctgttcctgctgtgttgattttcacttcactccttttcctatttttgagttgagtgtgatattggtttctaaacttgtgtgctttggttcaataaaagagcgtcagcgtgcgagctgtgcacgtcgcgccttgtcgagtgcatgccccgtgtcgagcatgctggcac

SEQ ID NO: 104211 - DNA, 507 bp, Triticum aestivum
  Clone ID: PAT_TA_104211
gccaacctggtgatgctcttcttcctcctcagaaagctcatcctgcccttctactccttcacgctcttctgtgtgatcctgccgctcaccatgttcgtgcccgaggcggagctgccgatctgggtcatctgctacgtgcccatgatcatgtcggtgctcaacatcctgccggcgcccaagtccttcccttttgtcatcccatacctcctcttcgagaacaccatgtccgtgaccaagttcaacgccatggtgtcagggctgttccagctgggcagctcctacgagtgggtcgtcacgaagaaggccggcagaacctcgtcggagtccgacatctttgcaatggccgaggagaccgacaccgccaccaggcccgcccccaggctcgtccgcggagtgtccgaggctgggctggaggcatgggccaagacacatcaacttgacaacaaggacctgcaactgaaggcccaggcggaggaggtcacatcactggcagctgcgatcaagaag

SEQ ID NO: 104212 - DNA, 608 bp, Triticum aestivum
  Clone ID: PAT_TA_104212
cacagtaaatggtctatccaatgccaatttagtgaaatgattcccgtgatctcttagttaggaagttttcaattaggaagattcattttgcggtccttaagccaattagagataagatctatgatttggtccttagattggattgttaggcctctatataaataagaccctttgtagaataaagcaagcaataattaggagagtaagaaaaaactcttctgtctaacccccaggggcaagagcctctccctaagcctagtacccaacagacaaaatgcagcgggcgaacttaactagcatgctgacatttgtgcatttatttctccctcgtttactcatatatagatcttattacttacagtaaaaaatgtaaacgcaataacttttatcattgtgaatctttcctttgttattgttctgggaagagcttggaagaacctaataaaatagttgcaatgagctgggattctttcttgtattttttgttctgacaagagctatttttctcttggcatctgtccaccatctaaaggatgagaagcattatcaaccatctcaagcagagtcgtgattttccacgtctaagaattggcattggacgaccacct

SEQ ID NO: 104213 - DNA, 299 bp, Triticum aestivum
  Clone ID: PAT_TA_104213
ttttttttttttttttgtcttataaggaattttctctatatattgcttgtaggaagtacatgttcataaaggatgaaactataagtcaaaagaaaaggatgaaacaaaaatcacacattgacttcacgctcactgcttatacccacggccaactcaaaacgtcaagcacgaatccacgcgtccaccagccttgccaatgtcacctctgattccccgccctcgagtagagcctcttccgcctgtctcagcgccgccaaagtccgctctcggagcaccctcccaccgtctgagttcatcat

SEQ ID NO: 104214 - DNA, 598 bp, Triticum aestivum
  Clone ID: PAT_TA_104214
cgggatgatgacttaacagaacatcatacggacaaagagaaaagaatggacttgcgatcagtagataaattccattatgtggatcacgagagaggtaataatgaggaacaaaacctaattcggacagagaaattaaaagaaaggtttgatgagaaatatgacagagatcatagagaaaaaacagatcggactgagaggcgacgtggagaagacgtggttgagagaccagcagacagatcattggaaaggagagaacattctattgaaaggatgcaagacagagggacggatagggttcctgaaaaaggaagagaggacaggaataaggagagaagcaaagttaagcatgctgaaccctcgatagaccgggcacatacttctgatgaacggttccgagggcaaagcttgccaccacctccacctcttccaactagttttgtaccccaatcagtcgctgctaaccgaagagatgaagatagtgaccgaaggggtggaagcaccagacatacacagcggttgtctcccaggcatgatgagaaagaaaggtggcacgtggaggagggagaatgctccgctgtcgcaggatgatgggaagcac

SEQ ID NO: 104215 - DNA, 546 bp, Triticum aestivum
  Clone ID: PAT_TA_104215
ccccttttgttcaaactgagccaaataacataatcatctttccgagaattacaacaaaaagtatacatatagagaattgatggaaacatgcgttgatgttaaatttggtacaaagtatgtttgggtgatgaacatgataagttatcactcaacttgtattataataacagatagtgtttcatatttctgttttagaattcttacatacggactatgtcctagtcactccaattaaaaaatagataatgaaaaaatattcttaattgcattcctgatgtttattaccatgtcaatagaaaacatagcctattgggtactagccacccaaacatgcacatgatagtcaaaaaaataaactctgtacactagtttccatacacctgactcatcttaattacatagtggtcaaaactaattatatgttaaccaattgcaggtatttaaggataaagccacagatttgactaagcattatcatgaattggttgaacccgcaaatctgatcctaaataagtgcaatggacttccccttgcgatactcaccat

SEQ ID NO: 104216 - DNA, 491 bp, Triticum aestivum
  Clone ID: PAT_TA_104216
gcaagttcagcggacgccacctcctcttctattcgaacccagtaagccctctcgtgagagcatcaggggatgtcgtgccctcaaaatcaggtccattgtgcagattgttattccttgtcagggaggataatattcatttgacgatgtcgtgccctcaacatcaggtccattgtgcagattgttattccttgtcagggaggataatattcatttgaaggacttattaggcccagaatatttagctgggtatttatgattcagaccattctataacaaaatgcatatatgtcctcatggtaggagttcagcttcagagtgcatcaagtttgtgtcaaatttattgttctattttggaacagtatacttccacaagtttttttctaacgattacatataatacttccacatatcatcttacaaaatggaagtacagaggaattagtatatagaagttatgattgttgtgcagggtgatctctgaagatggattg

SEQ ID NO: 104217 - DNA, 668 bp, Triticum aestivum
  Clone ID: PAT_TA_104217
gtctgactcctctttttctctctgtacgcaacctctcctttcctcttctcctagggttgcgccgccgccgcagcccatgccagctactccgacgccatccaccggagaaagcgtcctccccaggtccgcttctcccccaaaccatctcatcttcttattccacccggccgccatgattgttgcagaggaggaggaaggggatggcaaaatctcgggagagaaaaaaaccggcaagcaagcgagaaggatgtcatggtagatgtatgttgacgagccgctgctctgcgacatcgacggccagcgcctcaccgccgccccatcctcggccacgacggcactgcctgggcacagtccgagcccttcctcgaggtcaaacctgaagaacttactgcagtaataaatgacttcgatgaaccacacactttggcaccaactggattattccttggtggtacaaagtcgccatgaaggcagccaacacaggcgacctccctctctctcgcttcctctcccatgtaacccgccaccactagcgacatcacgctcaaggccgtcttcgaggacatcggcaagttctacctcatcatggagctctgcaacggcggccgcttgctggacgagatggccaggtatgttaccttctctgagttgcatgccacatttgtgat

SEQ ID NO: 104218 - DNA, 478 bp, Triticum aestivum
  Clone ID: PAT_TA_104218
tcacccactcaccatttgattcccgttttctgttgggtccagaccgattcacctttgcttgtggggttacaaataggtatgtgatcattgaggaattggactagaatagggctgaaattccagaccgtccgtttcaggccttctccatacacgcaaaaatgaaccgtcagcttggacttttgggcggtacaacttggagttataaagttggcccgcttggtggacgtaataatagtgttcaatttgcctgccatgaggcatgaggtcggtcgtcgcaagttgagtgagaaaagtaagcggtagggtttgaattgcaccattatacatataactgttgaaatgatgtggaagtgctactgtccaaatatctctgaactttgtaggatggtgatagaagaaatctgaaaatgatgtccctgcaactaaatgtagccaacttcatgtcattgcccaaatgaaatagcgaaaatcctctttc

SEQ ID NO: 104219 - DNA, 538 bp, Triticum aestivum
  Clone ID: PAT_TA_104219
ttccagcaggtgggctccaatctgacgcaattgtccgctgtcaatggcagcgtgcgacgcgcagttcacataccagttcgtcaagtggctcatcgccaacctacgaagtggtcaccggccgagctatggtgagggtggtgctggctgtggcctcccgtgcctctatgcgtggtcgtaagcctggctggcatctcgacttcatctactgcctggctcccgcccccagctcctcagcagcacgtacagtcgtacactcgccgtcaccgccctccaattttccaatttctggggcaactaattttatccataatctagcaatgagattctgtgctggcggccttcaagtcaagatgcaaggtaatcaacctgcaagcttgcagcaacatacacaagccctcccatcagcattactgagtcaacttttcttgtgactataggattcagtaacaagccctccgaggaacattaccgaggtcaactttgcttgtaactacaggattcaataacgaatcttggtggaacgtgcattcagagtggc

SEQ ID NO: 104220 - DNA, 487 bp, Triticum aestivum
  Clone ID: PAT_TA_104220
ccatggtacagtctacaaaggaatactatcagacctacatgttgtcgccatcaaaaaatcaaatatcgtggttcagagagagattgatgagtttattaatgaggtggcaatattgtcacatatcaaccataggaatgtcgtcaaacttcatggatgttgtcttgagacagaagtcccaatgctggcctacgagttcatttctaatggaaccctttgtgaacatcttcatcatggatcacctagagcaataccatggggagataggctaagaatcgcaaatgaagtaggcaaagctattgcttaccttcattctgctgtttcaatccctattatacacagagacatcaaatcttccaacatacttcttgatgatgccttgacagcaaaggtatcagactttggtgcttcaagatacattcctattgatgaggtaggggcagcaacaacaactgcagtacaagggactattggatatctagatcctatg

SEQ ID NO: 104221 - DNA, 457 bp, Triticum aestivum
  Clone ID: PAT_TA_104221
cttggtatacaaaattatcttgctttggactcctgtcagaattcagataccaccttttgatgatagagagtcaggaagacccaagctgcgaagcaaatccgcatgaatgtttaccctgcctgcaggttgccatctctgaaagcatccacaaaatgaaggaagcaacgccatgccagacaagcaaagtcagaactccatcaacacggtatgtgatgaatgttgtctgaaagtagatgcaacaatgggaagtggtagatcatgctgtggccgtcgtcgtgttccctacaaattttctccacgtgtgtgtgtccgtgcagacagatgtcttgatccagtttctctacatgtaggagtagatgtcagtgcgaatttgtatttccctgtaaatttgtatctgtctgtctgcctggtaacctgacatgtgagtgagagcgtttgtgtgtgtttgtgtgcgtgt

SEQ ID NO: 104222 - DNA, 320 bp, Triticum aestivum
  Clone ID: PAT_TA_104222
ctgcttatatctgttgccccctgtctgactgtcaaaaggaacaaaatttccctccatttgcacgctagccttttgctgcgatgagctgaaggctatattgccgtcagcctgacggcgccaggcagccctacagctagattagaagaatcactttaagtgcattttgggcatacacaatgaaatactgtaagttattctcacgctgtgggtgtcttttttcatagattcacgattaatttcacagacacaccaacaggggtgccagtattgtgcattgtttgcatgttcttattgtgcaaaagggagtgttactggaaccg

SEQ ID NO: 104223 - DNA, 521 bp, Triticum aestivum
  Clone ID: PAT_TA_104223
tcgcttgccagtatggaaggggcccttgacaccttttttgccgcttcaaacagaacatgcagcacatgtttttccagtgttgtgcatggtggcaataccttgcttagatatccaaggagtattctaacactttgttttttaagtaatctgttgcaccattaccaagtagaattcttgtccttttccatgatagacttctacatgaccgttcttgtactcttttgccacttaccatgattgatagtcttcagtcagaacatgcggtacacgttttttcagtgttctgcatggtggctgctacatcgtccttagatatctaaggactaatctaatactgcaattttaagaaatctgtttcatcgtgactaagtaaaattcttcctgttctttccagatactctaaaattgtgtatactaatttaaaatagattctgtacttgactcctctctccaatcatcatctcaacttgttcggccattccttaggtggatatgttcttagatatggttatgtttctttg

SEQ ID NO: 104224 - DNA, 209 bp, Triticum aestivum
  Clone ID: PAT_TA_104224
gcacttgaacttacacggccatacaatgcccctgccatgcaccgaccaagaagtactcctgtctgctgcgtgagaagtgcaagaggagccaccttgcatgctacatcccatgtacatcacttggggccacacatcttgtaaccgaagaaacatattccgctgagcgtgtacaatggactcgtactctgcgttcgtaaccagacacaagc

SEQ ID NO: 104225 - DNA, 562 bp, Triticum aestivum
  Clone ID: PAT_TA_104225
ctgctgggtagcacatgctacattgagatggatcacaactcaaagagagaggtcgcggtcttctatcccgagggccacccgaatggaaacgcagaatccgtggcgaacgctgcagctgcaaaaaggcgaagcaaacggattctcgagtcggtgaggcggagcttgcacgttgacgacggaactgccgagtactacctgtccgtcacaggtggcgaggcgagagctgctatgatggagttctcggaggaccttaggtgggagcagcgacaaacgggccactagatgcaggctctaatatgcaggggcattggtgtgtaggtgagtatacatatcatttgatgatttccacctacttctctgcttggaccatttttggtttgccctctcttatgtgtaatatagtgtgaaactgtggacctttgtaagatgaaacttatacatgtaagttgaacttaaaagttaataactgtagcaagtactgggtggcatacaagccaggactccaagaacagtcaagtatagcatctgttgttgtattagaagtgaaatcctctcccctaaa

SEQ ID NO: 104226 - DNA, 612 bp, Triticum aestivum
  Clone ID: PAT_TA_104226
caccgtctctacgtaggtgccaagaaggtcgtcgagtgggacgaggaggaggaccatgttcagatcaccctcgacggggtgcccgtggaggtggaggccggcaagaatgcccaatgggtctctagggccatgccgggactctccgtcactcgcaccgacacggtgaacaccgtcgtcgtggagctcgacggcgtgttcagcatatccgccaacgccgtgcccatcactgacgaggactcccggatccacaactacgggaagaccgagaaggatagcctcgtgcacctcgatctcgggttcaagttccacacccttacgaatgcggtggacggcgtgctcggccagacctaccactcaaactacatcagcaaggtcaatgtcacggccaagatgcccataatgggcggcgcgcccaagtacctctcggccagcctcttctccacagactgcaccgtctcccggttccaccgtaatggtgacgccgccatcgagacgttcgcctcataaaccattggttcatggatctacacgagaaataaacaaatatcaaccgtaagggagtgcaatcatctccatcatgctgttgtggagtatatatgcgtgaatctcaca

SEQ ID NO: 104227 - DNA, 359 bp, Triticum aestivum
  Clone ID: PAT_TA_104227
tgcccaagtcatccgcatccagcgctagcgccgcatcctcaatagcgcctcaaggccccccctgcgctccaccagttcacccgcaccctcaacaagaacctcgatgttggccttcattcttcaaaagttgggtgcacaggagctctaggaagaagaatcccgaagaaaaaccacacccaacaatgcgtcttagctcactggagctagttatgtgtatatttagtagtattttatagctgaataccagatttgtactatgtatgattggaatgtactttgcttggctgttgtatgaaatattatgccttattggctcttttttaatcaaattatataattgcaaaaaaaaaaaaaaaaaa

SEQ ID NO: 104228 - DNA, 429 bp, Triticum aestivum
  Clone ID: PAT_TA_104228
aaataaacagcttaccgacagggagatcattattccacctggaggattcaagagtctaaagctgcttcgcttctttgcaactacggtgccaaggctgagctttgcagttacaggaaaagaggtaatgccagcactggagaggattgatatgcggtttggagcctttgaagggatttacggcattgagactctcaagagcctccaagaggtgcatctcagtgttggtaatcaagcagatgaaataaccaagttcttggtacaagatttgaaggacacccccaagtacttggatgaaaagtatgccaacaagtggccaaagataatcaccgagtgacgagattggaatatgtcacattatctttcggttgaccaacaaatcatctgttacgtgttgataattagtggggggtggttcatcaagtctgcgtc

SEQ ID NO: 104229 - DNA, 533 bp, Triticum aestivum
  Clone ID: PAT_TA_104229
tggacagctgccagcgatgacacttctggaggcaatgccagcggaggaggtagcggcaacggtggtggccaaggtggaggcgtagctcaaggtccaagtatgggagttggttctggctctggcattggaggcggacagacaggtagcactggctcctatggtcaaggctatgccactggaaccggtgctggaacaggtggcggtggcggcggcagcaacaatggtgggtccggcggcggtggaggtagcggatccggatctggcagtggcggatacccctaaatttcctcttcgaacaacctagaatcggagcccagcacgcattttttagtctcttcattccactatttcacatcatttgtgtttctcctcattcatagtagggtttttactaggcgcctcctaataaaggggctacatgattctagtggaagtactaagtagttagtggagcaatctactatgatgtaacggcgacctacgtgtatcttatgttatgatttcttatatgtttcaaaaaaaaaaaaaaaaaa

SEQ ID NO: 104230 - DNA, 617 bp, Triticum aestivum
  Clone ID: PAT_TA_104230
tcaggtcagactttggtgcatctctgaccaaaaggctggatccatccgacgctcttccaaatagagtgcagatatgctgacaggtacaacatctaaaccttggctactctagcttgtttttatatctcttagtatcaaaaaataagttggctacattatatacttgaagattgcagcagtcacaaaatgcttggctgaccaccgagttaattgagttgtgcctatgaagggtcggtagggtagttgttttttctaaaaaaatgaggatcagttaggttgccacatgacggtaaggccagaatggtggtaccgaaaagtggttttgtaatggtcatatgtgttgtggagttggaacttgattcttttgaagttggagtggctaggttgtctatacgtacatgctgcccactaaaatcagatttcagtatactgtttaaaacaggggtggatcattgtgttgtgctcagaattagagctagagagaaggaagagttgcgaccataccatttatttatactgcatggtcccattgtcgattttcttaaagtacactagcctttttcttaaagtacattaccctcttgttcttggaagaatagattgatgctgcctacctc

SEQ ID NO: 104231 - DNA, 475 bp, Triticum aestivum
  unsure (1)..(475): unsure at all n locations
  Clone ID: PAT_TA_104231
ccggtgggggctccaacttccggtcgatccacgagccgccctgggtgggaaggtgaacggggatgtggttgcgctcgtcaccgataagccaggctgcggtggcgccgagtacgcaatgtgcaatggcattcccgtggtcgtgtttacgaagtcgaaatcggcaccggagggggtctccacagatgaacttctgaatgttctgagggatctgaaggtggacttcattctacttgctggttacttgaagctcatacctggtgagctagttaaggcatttcccagatccatgctgaatatacatccttcactgctcccggcatttggaggcaagggttattatggtttaaaagtgcataaagcagtcattgcatctggagccagatactcaggaccaactgtgcactttgtggatgagcagtttgacacagggaagaccttancccaaagagttgtgcctgtgttagccaatgatact

SEQ ID NO: 104232 - DNA, 664 bp, Triticum aestivum
  unsure (1)..(664): unsure at all n locations
  Clone ID: PAT_TA_104232
tcggcacgagtggatgttttgattttttgttggattttctagtatgtctattttattcggttagcttggcatgaaattctaataaatattggttgtagttacagcaagcctgtgactttggcattgcggggcaggtgcggcatgtggctagactcacgacgtgccatcggcttgtgcaggtcagagacggcaatgaattcccgtttaatgattttgtaaattttgttcttggaaggttattattataatctcggagttggttaatacctagctaatatataacttacgagatatataagagtatgaatgttgactaaaaaataactattttaaagtatgactaataaatactcacattagtcgaaataaacttcttgggcataaaactatatggaatatttgtgagtctgactaataaatacatacattagtcaaattaaattttttgggcacaaaattgtatggactaagatgtctatgagtactggaatctagtaaaaaatcaatagttntttgtctgatgattatgcatattctgctttcatgtaccagaaaagaagcatagacaactttttatgctcaagtgaaaattgagtctaaacttgttagttgggcatattttggcatgcacatatcaacttatatatgtgatattaattagagt

SEQ ID NO: 104233 - DNA, 542 bp, Triticum aestivum
  Clone ID: PAT_TA_104233
tcggcacgagtgagcattggcagcatggtctactcttttgaggttgctgagttttagccctcgggtaagagaacgaggagtttataaatgttaaggttatatatttttaagcatccgacgtgtatcaatagttaagtcagtatgcttaataataataacttgccatgtcaaatacataatattaggtaagttttggtgtaacctacaagtaatttctatggaaatcggttgcttcttatgcgctaaacctactgtatctttctacaatgcatgttaactgactgaaacacgaggatagagatcctagcctctgttcaacaattttcaaatgtaatttgattgtatttgatatttcgtcgactttaataatatatattggttaaatacattggtttgcttcatttagtgatttagggtaaaccagtgaagaggaatattacatgtgtatattactttttcctctgtagtttgattatattcaaaatatttgtatttttttaaagggttgcatatgcctggctggaactaaacgagcgtgtcat

SEQ ID NO: 104234 - DNA, 605 bp, Triticum aestivum
  Clone ID: PAT_TA_104234
ctctacgacggcatgctcatccgctacgtcaagtcctccacggcgcacctcgggaagccggcggcggccggggagtcggcggacatggtggacttcgacatgacctactaccgcagccgcgacccacggagggcgcggctccacgaggacttcctggaggagatcgagcagatggggctgttcaagtacggcggcctgccgcactggggcaagaaccgcaacctcgccttcgccggcgccgcgagcaagtaccctgggatgcgccggttcctgcgcgtcaagagcgcctacgaccccgacggcctcttttccagcggctggagcgacatgatgctcggtgtcagcggcggcggcgccgcgccgacgacggacgcgcccgggtgcgcgctggaagggatgtgcgtgtgctcgcgggacgcgcactgcgcgccggagcagggctacgtgtgccggcccggcaaggtgtacaaggatgccagggtctgcaccaaagtctagtcgtccatctgaactacagaaagaattaatggtagaatgggctagacacaaaccacacatcgggtcgaatttggaacctcaccaactgctacgtagaattcacacat

SEQ ID NO: 104235 - DNA, 535 bp, Triticum aestivum
  Clone ID: PAT_TA_104235
ttggattgatcggcagcgaggctaccagtgggaagaccacccctgcagcatacagggccgctgctgagaagatttgcacgctgagcttggaggaagcaaaggcggcatacccaaaggcccgagccagcgacgtgccctacctttgcatggacctcgtctaccagtactccttgcttgtggatggttttggtttggagccgacgaaggcgatcacagtggtagagaaggtgaaacacggcgaatacttcatcgaagccgcgtggcctctcggagaagctatagaagctgtgtcgcccaccaagcggctccaggatgcgtgatttagatggtagctagcccctcacaataaggtgcccgtgcccttgcaataagatggatgaatggacggcgccatcccaattctagtcttttttattattctttttcttttatgaaataatgagtaaacggcatagacgatcacaaagatatactcatgtatacaacgtttattcaaaactagagtcgtgatgttgtaaaaaaaaaaaaaaaaaaa

SEQ ID NO: 104236 - DNA, 542 bp, Triticum aestivum
  Clone ID: PAT_TA_104236
ctctctacatttctgcgcagctcagctctctggcattcctcctttcggtgacccatctctgcacgctcccaccgtctgccaacccccgcagatctttgtcttggagttgtacactcttctagccttgtggaactgtctccaatccatccatttacagttgacacatgagggtcttgtgtgctacctttttccagtacataaatctggtgttcttgtgtttgttcgatctggtggtttctagatagttcagattcagattttgatcgtcatttatccaaacttggttcggctgtgaggatcaaaagatcagcatcgataatgatggaataaatgagattcggcgatttcccactgaaattaaggaactttgcaagaataaccttcataccatatcataccagtgcttgtgcagaaccacttcagatcttgggctgtcattaattggtatgcccagcattctccctttgcatccttatagacggctaaaagattacttgtgtaattgttgtaagttctaaactttcagattcaacaatggtttc

SEQ ID NO: 104237 - DNA, 631 bp, Triticum aestivum
  unsure (1)..(631): unsure at all n locations
  Clone ID: PAT_TA_104237
ctccagcctgttgttgatgcttctgggcttgacaaggttggcggacccgaggttgttaagaagcacatgatgccgtcatcttttgcggagtggcctgagagaattgagacccttgaacatgggcaaaaagcagtcgatggagctgatattaccattcaaatccatcagatgaagctacttgactacctgcacacaatcaggactgggcaagtgtttgggacagtgcttgctgttgtccacaccgtggagttccagaaaacgggggtgccccatgcacatatccttgtttggcaggagaagaacgatgatcaggcccctgcacttgctgatgttgatccagatgcttgtactgctgcacctgccaacagcgtggaagcggcggttgctcagccagctaggcttaacaggattgccactactgctgctgctgcatcaaccatttcataaaacaatgataggtccctaagcaatctgcgcttcaaaatgagcgtctatgtgtggggtggntttggcctttactaccttctccttcgctactttcaagcccgcaagaacgagtgaacgctgcatggccaccgctgtcttccggcaacacccttttaaacagtctactgttatgttacttgcatgt

SEQ ID NO: 104238 - DNA, 511 bp, Triticum aestivum
  Clone ID: PAT_TA_104238
acgattatctcgactgttttggtgatccagaagttatgggcaagattggaaccgatatcgaagacttcaagtgctcttggctgtttgttcaagcactagtgcgggtcgatgagaggcaaaaagacatcttatttgaaaattatgggaaatcagatcctgcttgtgttgcaaaagtgaaggcgctgtataaagagctcaatctggaggtggtgttctctgagtatgaaagggagatttacgaaaagctgatatcagacatcgaagcacaaccgaatgaagctgtgcaagcagtgttgaaatcctttttgcataaaatctacagaaggatgaagtaggaatgttcttgcgtacaaagagattgccgggtggaatgagttctttggtgtcggcgcatgcaagatgaatagtagtattaaatacttatgaataagcagtatgactggtcatattgaatagtcagagtttttgctttatattcgcgaacaatatggctgggactgggagcttgtcc

SEQ ID NO: 104239 - DNA, 606 bp, Triticum aestivum
  Clone ID: PAT_TA_104239
agtccttcccccttcatgggacgtgcactgagccttgtatcccatcctcactttactcgtcctaggatgattgtaactgacttccttcctgttcaatgaaaagcaacgcaaggtcttttgcgttttctcgaaaaaaggctgatgagatggtacggcacacacactgctgcctgtgagatccagcacagatggctgaagccccatctgcagccattttttcctcctattcattgatatatgcaactagcttatttttgccatgaaacactagcttatttacatgcttgtaagtaatcaagcagttattccttgaatttctggcgcctacactccttttactgcctgtaagtgatacatgctgctcatgtttcatttttaaaactagcaagactcggtgccattggtgatggaagatatttttagcagttctgttcactaccattgtattatcatctacacctttttttgtgcctactacttactagtgtagatggggggcgtgtctaggcgctaggctgatgaggttacattgtgtgacttgcagaatagattgattgtgcattaccgattggcactctggcccaaagctgacgtgttctctacgag

SEQ ID NO: 104240 - DNA, 670 bp, Triticum aestivum
  Clone ID: PAT_TA_104240
cgcgccctctccctcctcctgctacggcctctccctaggcgacgacctgttttgccacgaccacgaccacggcaggggcttctggatccgcgccgccgtcgagctggacgcgaccatcgacctcggaccacaccgccacagccatggatgcaccatatcaagcactaggcatcagacttatggaggagtagggtcaacaaataagatgctagacccctttgcactggttaaggatgaagtgtcggaaatctcgaacagactgcgtttgacggtggtatctgaggtacctgaattgacatcagcagctggacacttcttcagagctggagctgaagggaaaagaacatgccctactgtaagtccatacttcagggtggtactgaatatcctgttattacatcaaggcacgtgttgctgtttgcttagacacataagcatatacatgatgtatgtacctgtccttatcgcatcagcgtaagttattgataatcggcgtgccaggttctactactgatggcctcggctataagaacagacactcttgattgggttgttgtttcaaggagcgagcttcatgcaagacagatgcacattgctcctgcactgtcattgatgctcctggacaccgtgatttcatcaagaacatgatcactgggacctcccgggctga

SEQ ID NO: 104241 - DNA, 446 bp, Triticum aestivum
  Clone ID: PAT_TA_104241
tgccggcatagggcgtgacgacgcccgtctggcggtaggtgagacggttgtcggccttggtcgggtcgtagaagtcggtgttgtcggtgccgctgaagttgctgacgcgggtacccaggatcaccgacaagtcatcggtgggtttcaagcgcgtggccaggtacgcgccggtctggcgttgcacgatgtcgttctggccgctgcggggaatgtcaggcttcgggtattcgccgcgccagtcgtaaatgctgccacccacgggtgggtagatcgagccgtacatcggcacgtcctgtttggagcgggtggccatgaagcccatgatcaattcatgctcgcgcccgaacaggctgaaggggccattgaggttgatgtccagggtgttttgcacctggtcacccttgtacttgcccatgaacatgtacattccgtcgcccgtgaccggg

SEQ ID NO: 104242 - DNA, 607 bp, Triticum aestivum
  Clone ID: PAT_TA_104242
tcatgggccatcatgatgataatacttaattctttaaacaagaatggtaagaactaaggagggttgtcttgtacaagagctctgccgcgatggcatcaccactcagtgatgccttagtaggaaggccaatcgcggggagggaaatgtaccctgttgcagttcctctgtcttcacgaattactatccaactattaagtctgttctaaactctcagccccatgtaaatctgatggaagattgggccatttaatttgaaacaaaaaggttatcatttgccaacctcttcattatcggactatacacatgtggtgacgtatgcggtcatcgggagcggctgtattgtttggtcctcaacaattttggctgaagactcctgggctttaccattgcgaaatcatgtgagaagaggtgttccaggaattctttgaaaggcatgtgtatacagaccatgtgtctcactatcgtttttttgtctttttgagttgctgaaaagatcttaggatgtttgattagtttcaactcagatgaagttgttaggatgattagtttgcagcttctgcaaaatgtattgtgatggattcagatagattctggagtgatgcaaccc

SEQ ID NO: 104243 - DNA, 627 bp, Triticum aestivum
  Clone ID: PAT_TA_104243
tgcaccgatggcgtcgagcggtggaatgatgttggccatgatgggcctcgtggccgcgctggtctgccctgcggtggcatcagagttcatctccatgcccaccgacgacgtcgtgctccctgatggcctctcctacgacttccacgcccagtcctgccccaacctgcaggacatggtgcgcgccgctgtggtgacagcgcgcaacaaggacatcggcgtcgtcgccggcctcctccgtgtctttttcaacgactgcttccctaatggctgcgacgcgtcgctcttgctggaagaaagcccccactacttgagcgagcggatgattttgccccataacgccgggctgcacgagggcgcgctcaacctcatcgagagtatccgcaataccgtgcacatcacctgcaagaacgtgtcctgcgccgacatcagcatgctcgccacccgggaggccatcatgctgtcaggggcaccaagctacgatgtgccgctcggctggatggacagctttggtccggccacgtttgatgaggtcgacgagttcctgttcatacccaagtattccaagatctttgatctcgtcacggtcttcgggttccgcggcttcgacaggactgacctcgccgcgct

SEQ ID NO: 104244 - DNA, 619 bp, Triticum aestivum
  Clone ID: PAT_TA_104244
ttcagtccacctttactcatggcctccccttctcgtctggtaactcacgtgctcactttgtcctgaagatagcatgaactaatcttttatcaggcaacaaatgccatgtcctagcactggccaaaatccctttttcatgtgtgaaccatatacagaaaactgcatgatacatactggaatctggtgctcacttttagaatagctggttttttcacccaactagagaacttaggaaggctgtttttcttcttcttttgttacgactttttcagtcttttgggttaacaagtggtttttttctttcgcctttaggttgcataagtgcaattgcaactgtatgcgttcactagcgacaaaacccgtagataaatatacatgcctattacatgttgatgctgccagctcttgttatacatttattttgcagcggttgctctgttcaaccgtggtccatgctctgtttaatgcacatgtcggatcaaaatcaaaatgaaattagtatagcttgtctaaccacattcagactcctaattttaagtttttgtcttgctctcaggtggacggccttggcaatctgaacaagctttacgcgactggcactcttgttgatccatatgag

SEQ ID NO: 104245 - DNA, 585 bp, Triticum aestivum
  Clone ID: PAT_TA_104245
tcactattcatacaaaagaactactggtgcatctcccgttcctggaatagaaagaactgcagttaatgaggaggttattcaacctcagcccattgttacggaaagttttgctcatccacaggccagcaccttcggttcggatgttttgcagaaagaccattcatacttacctgctgatatccccaaaccaagcagcgaaccagaagctatcactttgctggacaatttggttgaggcagagcacaacaactccggtttgactcttcttcaaacccaccattcaaacttacctgctgctcagtctaaaccaacaactgaaccaacacctatcactttaccaatagctcaatcatcaccaatggaatgccaagaaatggctcaatctgataaagaagaacttgacaagtgtgtcgaaatgattctctttatgagttcggacatgcccagcaatatgaatgagaaccaagaaattgcctcccatggaattgagaacaacttagccctaagtcatcatatcaaggaagtgctgaccgaaaacttagaacaatcttttgcattagcagaaatgcagactcagtgcactgc

SEQ ID NO: 104246 - DNA, 305 bp, Triticum aestivum
  Clone ID: PAT_TA_104246
ggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttgtaacagcagcgatcatgtctcatacgtatctcatttcttcgctactgccttagcatccttgtaatcgcaagcatcatttcgttgcggtgatctctcatctgatcgattaaaaaaaaaaaaaaaaaa

SEQ ID NO: 104247 - DNA, 411 bp, Triticum aestivum
  Clone ID: PAT_TA_104247
acggccaagtgggtggcgcggctgctggacggcgcgttccgggtgccgggcgtgcggcggatggaggagagctgcgcggagtggggcaggtactacgcgcgtcggagcggcggcggcggggaggggcagcgcccgtggaggccgtgcctcggcgcggtgaacgtgtggtacaacgacgagctgtgccgcgacatggggtgcgacccgaggaggaagaggatgaaggggcaggggctcctcgccgagtggttccagccctacggcgccgtcgactacgccgacatccagtgactacgcttggttgaaatgctacgggcattagacaactcgatcaatgtatctttttattttttgagggatcgatcaatgtaattcaaatcgtcgctctagtcagtcatgtcgttgttgatc

SEQ ID NO: 104248 - DNA, 558 bp, Triticum aestivum
  Clone ID: PAT_TA_104248
gttcctacaccactggtgacagcgggctctgctgcaggatagcaggtctaataatgtacaattttgcagctgctggtttaattgttcaaatgggagcttcgtagggagagtggaagatttttggaatggtgcggacaggttgagagcaatagatgttttttaagtcctaaattgttactaccgagaatggaattcaagaagagatacttttggtgttgtcttattacctctcgtatctgatagataacacaaagttatcggtttagttggaaaaagaaaaagtccagatcaattgtgaggatatgatcattggcatacttaccccctgatgatgcctcatttcttcagaatttgaggttgttcttaatatgccaggacaatttgattttgggaggacaaaggtcagacaaggatgagaatgggataccagattacaacgatggaggctcggacatggatctgctcatgctctcagcgggaatactggatgttctcgaagctttgccatacacacgtggaaccgtgtgctataatgcaccaatgctgctttcggatgac

SEQ ID NO: 104249 - DNA, 316 bp, Triticum aestivum
  Clone ID: PAT_TA_104249
tgtgatgatcacccgctatatgatgctacaacacaaaagctcatgaatacaaacaaggtggaggtacatgcaccggcgatgctacgacttatatgtccaatgctcgtgatggattctgatatatgtatttagtggcatggaaagctttcaaatacagaccgatgggtcccacctgtcatgtaataaatttggattaaaaaactgttaattgctgggccaaggatccaaccagcaacgtgctgctaccgcgcaaacatggatagccatcccacccagtgactattggtgtctaatatgaacaattttacattatact

SEQ ID NO: 104250 - DNA, 546 bp, Triticum aestivum
  Clone ID: PAT_TA_104250
gcgcttcgcgtgatggataagatggcgctctatgatgatgatgattctgacgctgcccgagagatcggcgagttgacgcagttgagaaagcttaatataactgtcaactgctcccaagaggtacttcaagtgctcatcaccgccctgaacaggacatattcccttcgacaactctcaatcttcgaccgcggtgatgggaagataatgaacatcctcggagagatgacctcgccaccgctgctcctccggtccatgaagttgcggggcgaaatcgatgggatgcccgagtggattgggtcactcatgcacgttgtcaagctacatatcacatttagaatgcttagctgcgacgagatacttggcatcctgtgtgagttgccaaacctactgcgcctcaccctcgcgtacaggagctgcatcaatgatgcgctagtcataagcgccaagtaccgattcccagtgctcaagcagctgagtgttgacaaacccttctctcgagaagaaatcatttttgagcaagggtccatggcaatgctcgagaagctg

SEQ ID NO: 104251 - DNA, 610 bp, Triticum aestivum
  Clone ID: PAT_TA_104251
ccatccaaaatcaacaaaaatcctctgttttgtcagaaaagaacactggtttctcttccgtacttgatagagctaaaagttctgctggtcttgaaggtgttgacgctctaacaggtcgttctaccaaaaacgaaggttcacaaaatgagcttcctactgctgaacctaaaaaggttctgtgtggactcagaagtctgcctggagagatcttgtaggaggcatgggggctacatctttcagtatatcgcagatattgccgaacatcagcccagcaccaccaaaacttgaacctgctactgagacctctgtcgcatgcaccgaagccaggagggaagtgacatcattaggtatgacatctttggaatccccggcggctataactcagccctcgtctgagcagaacttactgagctccacgggaacaccatccgctggaacaacaattggttcagctggtcatgaaacccgagggcacgacgagagcaacaaggtagaagaaccgtgtgtggtcccaaagattacaatcagtgaagtctgcccgttcatgagaaacgaagagtcagttcagcaatggtcgaaggcaaagaaggttctaaccgggttcagcaag

SEQ ID NO: 104252 - DNA, 532 bp, Triticum aestivum
  Clone ID: PAT_TA_104252
agcggcggcttccctgcggttgagcccatggacaaggagacgactcccggccatagcaccggccccggtcatggtcaccagggccaggggccgtacaacactacgggtccgacataatcggttggtcaatcatttacgtggttatgtacgtagtacgtggatgcccgggtttcgtagctagttatggtatatcatgaactgtggcgtctggtgtcaatcggtgtcgccttcgtgctacgtgtttgcactagtaggagaataataggttcgagaggtctgctctttcggacagcttcgtcgttgtgagtctgtacaggtattgcgtgttttgtgtttgccagcatgtatgtatatatgattgtgatttactggtgagtggtgagtctgcacaagagttatatacgcatggttgttcacgacaacaaggatgtcagtttgatctttgtctgcactccttctgtctagttgatgtgtctcttgataaggaggtgtaccgcagcagaaaagcgctctatctatcccaaaatgtaag

SEQ ID NO: 104253 - DNA, 572 bp, Triticum aestivum
  Clone ID: PAT_TA_104253
gaggtactcgatgtgtacccgctggagctcaggtttcccttcgtgccaaacaaggagatgcgttgccacttgaccacgaccaccaagacagattgttttgtcttctgtatgctcgtacctggagttccggatagatactcgggtgacttggtaggcattgtacctggaatgtgcacttccgttaccccagtagtaaggcaggcggaagaggagcttccctcaggcacggacgagttggaggtactgttctggctcacagggtgcaatgatcccgacaaactcgcacttcagctatcagcattatcagtgtaccctggttcgccctctcaatatgaattaaaggcggcattccatgagcttgggtgggagctacaccggacgacgttgacagcggtcgtcgtcgcccccgaggatgatgatctagctctagtggtgaatactccgtgcaaagaagaagaatttttttattctatcgattgcatggatgtgcatcctacggagccctgggttgcaatctttgctaaaaatagaaagggtgtttacctttggaactggcagaccaatgagaaaat

SEQ ID NO: 104254 - DNA, 508 bp, Triticum aestivum
  Clone ID: PAT_TA_104254
taactgatcgatctagcttatcaaagttgggggctgaagggttcatcttccccgccgctctctcttccacccggcgccgccacgaccaatgcggcatgaaacggcacctacaaatgcacacgaaacgccaacattcacaacctctcattacctcacccgccattaccctgtaaatacggaggaaattgctagatttaaatgagcagtcgtcgcctcacatctcatattttcaacagttcttatcgaactgcagcggcggggatcgagctccggcgcacgcgacccgtcctcatggcaatatggggctcgatgccgagcctccgcgccgcgcctgcacggaaccgccggaaggacccagcgggtcgccgttgccctgcatcggcttcactcggccgcccgtaacgcatgagttcactcggcagcagcccgcaggtgcagtccacaccccaccccacgccgtcatggcgctaccaagaatcttgccgctggctgtcgtacaacccctcag

SEQ ID NO: 104255 - DNA, 388 bp, Triticum aestivum
  Clone ID: PAT_TA_104255
tctccgccgtggcgctcgtctacctcctccaggacaggtggaaccacgtcgtccggcaagaagaggcggccgctggcgacgagcggcggtcggagacggagacgtccgaggagtctccgtcgtacccggccaacgaccacaaggaggtggccgtgatgccgtagcatgacgatatatgggagctcgcttgggcaaatgcaacacctatctgtacagttcatgtgtgcttgggaatgggattgtgtcttggtaactcgttagccgaagctgcagattgaacagcttacagtgagagtagatagaaaacaaccctcggttctgcattttccctggccggggattgcttgatcaatgaacatgagatttacacaaaaaaaaaaaaaaaaaa

SEQ ID NO: 104256 - DNA, 624 bp, Triticum aestivum
  Clone ID: PAT_TA_104256
tgtacgtcacttatccataattgtagatgataaagatgttgatgatagaatcacttttggcgactataaatatgatttgagtgcattaggtaaaagattaaaagttgaaaacctacgtaccctgatgttgtttgggcgataccatggtagctttgccaagacctttggtgatctgtttaaaaaagctaaagcccttcgtactatttttctatctggagcatcatactctgtggaggacattttgcacaatttttcagaaaccatccatcttcattacctaaggatcgagccattaggtaacgcaggaaacatcaacttgcctaatatgctataccgattttatcatctagagataataaatcttgaaaaatggaaagaccttgtttcaattcgacatatcaccaaccttgtaaagctgcgtcattttctagtgccaaaaggagatcccgatggtcattcttacatatctgaggtgggaaaacttaaattgctttcagaattaagaaagtttgaggttggaaaagaaaatactggcttcgaactaagtcagctagagcaattaacagagcttggagggtcacttagtatttataatcttgaaaagtgcaagaaaggggcacgggg

SEQ ID NO: 104257 - DNA, 638 bp, Triticum aestivum
  Clone ID: PAT_TA_104257
tcccttcagcttctatgcaaggatctgaatggctttagcagcatgaggatccagtccttgccacgtcttaaggaggtcgtccttcatgatggagtgagccaaggaacaaaagaggagtggaaaggagcaacaaagaaccactccagacgtcccaagctcttgtttgtcacgaaacaaatggttgatgatcatttcaaaccgatgggaattgaggctgctccggaaattagccctgcggcgacagctactgacacgatggttgtggaaagcgagcctgcagagaattctaagagccctgtggtaccacctaccgataccacgttattggtgacaacgcagcccgacgctatttctactcgagagtctgtacaagtcgttactacttctgagacggttgatgctcgggacctgataggaactgagtctgctgcggaaaatagtacagtggcaacaactactaatacgaccaaaaagattgatgtggaaagtgagcctgtgggaaattctgagagcccagcagcaccgcctactgatacgatgttatcaatgacaacgccgcccaatgtcatttctactcgggggagtgtacaacttaatggtggttgccaacatgatgatgatgggaaggatctggatga

SEQ ID NO: 104258 - DNA, 564 bp, Triticum aestivum
  Clone ID: PAT_TA_104258
gataagataaattaaaatgacagccacacaacttggcaatatgcagccacacataacaagattaatggatgtcgcttcagttacttgacccatcaccgattaatcggtttgacaaccagttaatcgtctgacaactgattaaatgccagttaatcggcttgaccatttaatgaaccgagtatgtgctattcgcctcagttaggcaccgagtagcgattaaatgggcatttaaatggtaactcgggagttcttgaatagtggctgggacacggccggacaggagaagttcggtggcctccgtgacggatactagtaagttcggtggcctccgcgacaattgcatacatgtttttacctcttgcatatttaacatacatgacagtagcactaggtattgaaatatatgcaaaggtagaagctatcgctgctgcttgtctcttaaataaataaataaattatgtaatcatgatctgaaatctcatgcaagtgatcattggtttcgctgctgccgatgtgccagtcggaggtgccgctgctacatttggcggagctagtgctaccgct

SEQ ID NO: 104259 - DNA, 304 bp, Triticum aestivum
  Clone ID: PAT_TA_104259
gactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttgtaacagcagcgatcatgtctcatacgtatctcatttcttcgctactgccttagcatccttgtaatcgcaagcatcatttcgttgcggtgatctctcatctgatcgattaaaaaaaaaaaaaaaaaa

SEQ ID NO: 104260 - DNA, 610 bp, Triticum aestivum
  Clone ID: PAT_TA_104260
ctgatactatgtttatcagtacatgctattggaattcccaacaaacttgacaggatggatcagtcacatgttggttacatcaagtcttctaaaggtatcccgtaatctattaatcaagatgtttgcagaactaaataatgttgtagtgactgaacgattacctgataaattaaattcagtaagtatatcatttacagtagcatcttattcttatgtgatgtaatatatgatcatatggattgcagtatttgatagctccaaaataacttcaagattttgccacgtgctctcaaacaatcgtagtccgaaaatttggtggccagttgctgctatctctactctgcttcgtcctttcgtaatggcaataagaaatcttgattgctgccgacatgaaattctaactgaatttgttattcagcgggcaaatccaacatctttttgtactgtatttgcatgttccaggataatttggtggcaaaagagctacatcgtttctcactagaccaacagacaatagtagtgatacctttgcatttatatagtaccatatttactcatctatatacactgttcctttcattcctcacaccacaagtatctaacagccgga

SEQ ID NO: 104261 - DNA, 529 bp, Triticum aestivum
  Clone ID: PAT_TA_104261
gcgcgcgacctgcacaagttttggcccttgcatcttttttcttctcgctatccttgcagtagatgttggtgtatgtagtgatgtgcaaccctgggagggaggtcgggacttgggtcaggtggtgcagctgagatctctggtcatgtgatcggtttagtggtggatgatggcttgtagtacgtagtaatgtacttgctcactgggattgtatgcctgaaacacgttcactaatctggagtagtacttagtacaccaattttgttagtacgagtaccagggaagagcgaattctaacttgggcaggttacaaatgagagtcaggtttaagtttaacagaaaattgggattcttcacatatttaatgccatgtgcaaacaatgaaagaaaatcaaggtcggcccctcttttctttcaagaaaaagatagcgaatcaagggctagtaggaaggtaatcaactgcatttattcttgtgaaactgaaatgcatttcaccaaattagcaactatgttcattggcattgtggcgtgc

SEQ ID NO: 104262 - DNA, 609 bp, Triticum aestivum
  Clone ID: PAT_TA_104262
tttaggtcccctgtcgccgcgctagataaaggaacgggagagggttggcagcctgcgcgatcacaattcacgtacggtttcactcccctcccgatattctctcaccccatccgatcagggggagcgctgcagcgacgggaagacctactccagccgctgctgccgtcgccgggcagtgccggtggcgtcctgagggcatcaggacgttgaggaggacttctacctcgactacatcacctctgcatcaagcctgcaccaagcaggcgatcatgtccacttccgtgacaccttccgctccattccggtccgacacgatcgaaccacttacggggagtaacttccctcgttggaagtcccaagtcgaattatgtttgggttgtaatgaatttgactatgccttgagggaagaaaaacctgtggcacctgtggcgggtgtcacagggtatgcagaactcaagaaggagtatgatgttaagatggaaaagtggaataagtccaaccatattgcgcttctcatcatgaaagcgacaatatcgccggacatttctgaagcactccctaagaaagatactgctaaagatttcctcactgaaatggaggagcaattta

SEQ ID NO: 104263 - DNA, 462 bp, Triticum aestivum
  unsure (1)..(462): unsure at all n locations
  Clone ID: PAT_TA_104263
gatgggagtgagttgtacattagctaattcttttggggctccctccctcattgtgtgatgttccattcgttaattgtggtggtcctctgcgattggcgccgaggacgtcgagaaaaactatacatcatgtaatgtcagtagtagtagtagctgcaggtggatgatggagaacagagggaaacaggaaacttatagtagagaggataggtatgcatccaatgatagccaaaattttctttccgccgcacgcgcgtctgccatattgggcgatctgtctccgtcttcggcgtcttgcgcgttttgtgtgtgctgcaaagggagtggggaagaaaagaggtggcgcgtggcttccanggaatgtaccttgttctttattcgcatcgtcaatcaattaggagtagatgcttggtgtgttttcagatcttttcattgttgtgtttcatttccgaattcccaaaactt

SEQ ID NO: 104264 - DNA, 654 bp, Triticum aestivum
  Clone ID: PAT_TA_104264
cacgtgcttcaactttgaccgtaaatttaactgtgaagaccgcagttggtctcgttggttaaatttatagtcaaagttggacctcgaaaagcgcggcgcactatattttagaatggaggaagtatttaggaacggaggaagtagtagtttcttgtttttgaaagcaaaagaaaaaactatggcatatattttttcgtagtacgtgcaattgacgttgatatttattagagagaaaaaatgatactgatattaggtaggatatcaggactagttgctctctttgaacattccacgtggagagagaaaaatgttgaaaccgtgtggttccttgaacgatcttgatggatcggagaccacgtttttggtgcgatcgacagcggtcgtaatgaacctagcagcatgcgcatacatagttgactgacggtgacatctgtatcgacatcgatgaccgatttgatggaccgacacctaccaaatcaaacaccacgattgatctgctcacccaaatcgagcaaagcaggatttggttcgatcgtgtgtatgtatgcatgcacgcagtatcatctttgccttcttctgctcagaacaagtcaaaagctgtagtattacgtacgactccaaatcttttgggttgtacgtatacgtgttgaccta

SEQ ID NO: 104265 - DNA, 554 bp, Triticum aestivum
  Clone ID: PAT_TA_104265
gcggccgtcgccatggtcgagttcgacgtccagcttgtttaagcttggactctcgtcggctcgtctcgcttccttcgactgtactctgctgcgatctattgtggtgacccttgtttgctcgatgggcgacgctggttcagtttgtttcgacttgccgttgtcgcctgcgtcgacgcgtgtgtctttctgtccttcgcgttcaggttgtacgatctcgcccgttgctgcgttcacgttctgctcgttgcttcgtctctgttttactcatcaaggagatggcagcagtatatacaaagtatatcactgattatttgtagagttcattctggataggaacagaactgttatagctgatgtcaacacgtcaaggatattcaagttgtgtgtggcgcccgggagaaagctttgctaatccattcaaccacttacatgagaatccagtgccgcaggtgactcattcatgcaagaactgttgttaagtttttccttttctcctttgattctacaagccgcaaaggagtgaagggtagaaaatatttccattctcgttgaat

SEQ ID NO: 104266 - DNA, 318 bp, Triticum aestivum
  Clone ID: PAT_TA_104266
gcggtggcggcgcgcgtgcgcgactgggtaccggcggcggcggctcgcgttcaaggtggtcgtggacacccacatgggcgtccgggtcggggccgtgcgcaccggcatggtgcccgtgaggctgtcctgcgacgacggcgttatggcgccgcgcggcgtctccgccgggagcccaattatcttgtgccaggtgtacctcctgggagtgacatggtaagctgatcgttcttctaattcatctctctgttaccttgctgccttgcgcttgcacaaactattctcaaaatttgcctgaatgaatatgactttgatacccct

SEQ ID NO: 104267 - DNA, 558 bp, Triticum aestivum
  Clone ID: PAT_TA_104267
aaatccccaccacatccgcaagcgcgaactccctccccggatctgcaactagccggcttccctcccgatccgtctcgccgcggccgagatccttccttcctccggcgagagccaagatgtactcgtgggagatgctgtcgttcaacatccacgacgggttcctggaggcgatcgtgcgggggaaccgctcgggcctcctcacccaagccgattacaacaacctctgccagtgcgagaccctcgacgacatcaagatgcacctctccgccaccgagtacggtccatacctccagaacgaaccttctcccttgcacacgacaacaattgtggagaagtgcactctcaagctggttgatgaatacaaacacatgtatggacacatgatcgataatgttgtacttattgttactgggacattgcatgaaagagatgttaacgaactgttggagaaatgccatccattgggcatgtttgacagcattgcatcacttgcggttgctcaaaatatgcgtgagctttacaggctggttctagttgatacacccttagcaccgtact

SEQ ID NO: 104268 - DNA, 500 bp, Triticum aestivum
  Clone ID: PAT_TA_104268
tgtcatattaggggcaagcaagcaaaagagcaagatactttgtgcatctattgagaagctcacttccctccgctctctttatgtgaaatgctattggacaattggtctcaagtggttgcattctatttcctccgtcccccctctcttgaggtcgttgtctctgtttggtgttcttggggagatgcctggctggtttggggatctggtgcatctggtgaagcttttactatggtcaagctatctagcagaaggaggtaaaagtatggaaatactgggcgcactgccgaagctcatgttcctttatcttggttatggctcttatgcagcagaaaaactagtgttcaaagcagaaacattcttaaacctcaggaaactggaagtttattgtgagaatcaaccgagagagttgatatttgaggtgggcacctcgccccagttggaaaagatagaaatcatacagggcaggttggaatcaggggttactggtatcaaacaccttc

SEQ ID NO: 104269 - DNA, 295 bp, Triticum aestivum
  unsure (1)..(295): unsure at all n locations
  Clone ID: PAT_TA_104269
agccactacctactaacgcctccgtcatcaccgagctagtagctcactgctcacgccgcagcggtcgggcagctactactgctgctgctagtacagccagccgagcgcacgggcgggcggcgaggcctgccatgcgggccccagttgccatccaccggagcgagagcgtccgaacgtgtcctttatgcttgctgagcagagcggagcgggggaggaagcgtgcgtgcgtgcgtgcgtgtnaagagcaaaatgattacacctgcaaccagcagtccaccagactttattttccccc

SEQ ID NO: 104270 - DNA, 515 bp, Triticum aestivum
  Clone ID: PAT_TA_104270
ggtccatgaatggaggtgtgtcagctatcgttgatgagatcccctatttaacctctttcctctctgatcgtcagtacaaaaatgactttaagatgctcgggtgcatatacaagactcctggatttggttttgcattccgtctaggttctccactagtgcgtaacatttcaactgccatcttgaaccttgagggaggggatgagggctcacaaattgaagagaaatggtttggcacaacttcaccatctatgggtgttggtgcagtcctcgatgctgattctgcacctctcacactacaaaacttttctggtctctttgtcatcacaggatccatttcaactctcatgttgctaataagcattgtgagattggtttatgccagatgcatcaagttgggaaaggcgaacatggaaatcattagctatgattttgtggatgagggtgcgttacaaaatggcatggaaaataaccccaaccctagtcaacaacacatccgtgaagctatcactgatgat

SEQ ID NO: 104271 - DNA, 539 bp, Triticum aestivum
  Clone ID: PAT_TA_104271
ataacttccttacataatgtgacgaaggagctagtgcattgcgatttaaggtaaatcgtaccttgccctaagaaattgaaagtgaatctacaatgggcagcttaaaaaagaaacataaaaggtttacaagtgcgtcccagaaaagaaataatgatgaacaggtgcatatctaactaatcgaggggttccaataactttgcttcaccacaatcatcacaaaactaaccttttttttgttttgttgaaaaagctgaaactcggttgcaatatataaggctgcaatggtaaacctatttgatcaaaggaatcaacaaagttgagctgctgcatacaaagctgtgcacgattaggttaaatactacaagtagtgagtaagtttggcattcgttcttggtccagcaaaacagtagcgtgatgatgccggagtacgacctcgctgtgtcatattcattattgatttataccctccacttggccaactttatttatcgtcattctcgttcatccacatacgtactgtagcccatgcatgtagctca

SEQ ID NO: 104272 - DNA, 565 bp, Triticum aestivum
  Clone ID: PAT_TA_104272
accaaacaccacctatatttggcatgaaattaactgcacgctaaacatgttgagcgctcgacattgaagcaggctagctcgttggattgacatgatttgatgactgagattaattggatctgctcatctggatctttttatattggtatagatagatatagatatagatatagatataatcatatagatgcaaaagcagagctcctggctcctgctgcctccattaaaaaaaggttctctcgacccatatgtttaatttgggcagcaattttaccatattcgttgatcaacccataaatgatcgatttggcagcaattttaccacattaatcatttataggttgatcgagccaactgaaatcaaactcctgttgccatatgtttaatttggtttactgaaattgttcaatatttttacctctgaatgagacaatccgaagtgaagatggccttcttaaacccttcttaacgagtgagagcgaccgcacggcggagcgccagtgcctcagcttattccggtgtgatgacctcctcaatacgctcgtggcaagccagcaagcatgca

SEQ ID NO: 104273 - DNA, 626 bp, Triticum aestivum
  Clone ID: PAT_TA_104273
atatcaagggcatatgacaagcacaagagcaagatatcgtccaaacagcgcgtgctcaccttccttcttgtgtccggggactgcgtcttggtcggccttcagcctatcctagtatttatgtgcaaggttgatgggaaatttcagttcagtcccatcagtgttaactttttgacggaagttacaaaggttttctttgctatgataatgctaatgattgagtctagaaaacagaaggttggggagaagtcacttctctcagtttcgacctttgtacaggcagcccgtaacaatgtactcttagctattcccgctctactatatgccatcaacaactacttaaagtttatcatgcaggtaaatgttcattgaactggctgaactcccattcttctgtgcaatgtactcgtattttctccagtaaatattttggtactcctgatatttacaaaagctacagttatttggatgtagtttatcaatttacatgtacgagatgatgcatcttcgataattatgttacagtgtaattaagtctgtcacgtctcaagaaggaaattcattatcaccttcgtttggaaggatcagaccatacattttaattactgaattcaaaaattcacttcaaa

SEQ ID NO: 104274 - DNA, 643 bp, Triticum aestivum
  Clone ID: PAT_TA_104274
cgcaccgggccattcacaatatatgctaatgaccaccaaatttcaccttcatccagtgttgtaaatcaataaaataaatatatgctaggatctgaattttagtcattttggtagggcctcaaaagcattagagtttctcatacaacggttgcatgtcatggaagcaatcttaatgactctcagcccatgaagcggcgtggttgcaaagaatgacaggactgaacggccgatggccatcatacaatctggtaggtctatgcccaatcctgcttcttctatctttctttcttggatagaaactaaaacatttaaatgtttccttttgagaataaatatagcatggtatattatttctttcattatcattggtgcataactttaaatgacttccttggtaagaaactactttgatcccgcaacaactgctctattgttggatagatttggattattcgaatgtctagggaatgcataatggcttaaacaagaaggtaagtaatgaatttgcgcggggtaaatattctggatgtttaaagacgtgacattgtccaataacatgttgaacccaactatcatcttgagggttgtaccaagatcatgtggttttcactttctctcagtttacttatgttactaatgcatg

SEQ ID NO: 104275 - DNA, 578 bp, Triticum aestivum
  Clone ID: PAT_TA_104275
accgcttcgcctggcggatttgaggccggcggcacggctgctgcttctctggatcgcggtcgatcagggcatctcgtgggtgccgagggagtgctgctgccggattcgatatcgccaccatccctattgccaccgatgagatccattttgtatcggcattcttcttacgccctaatgcctccgcctcttgctgtggcatctttggtggcctctcctgtgcgtgcacgtgcctcggcgccggtctttcccacgtcttttgcggttgactgtgcttcgatttcgtccctcagtctcacgaatagctccctgctgctggtccatatgatgttgatgttgatgctcgggaagctgctggttcatccgttcatgttgatgttgatgctcggaggcgtgcgattttgttggccaaatggcctattgattctacggatggtattgtttcttttctttgttttttgtatttttcctctccttttctgttttttctacatttcatcttctgcatttgcttgctactcatattcagagggatactcactgatgcgtatgttatccgattaatacatcatctgtaccat

SEQ ID NO: 104276 - DNA, 555 bp, Triticum aestivum
  Clone ID: PAT_TA_104276
agtcgagaagtgcatgagaaatgctcatcaccttgtcagccgtcttagggagaagggggtgagtgcatacctaaacgatctaaccaacacggtggtgttcgagaggccacggaatgaggcattcgtccacaagtggcaactcgcctgcgagaggggcattgcacacgtcgtggtaatgccaagtgtgagggtggagaagctcgacgtcttcgtcgaagagcttgctgtcggaagaaggatgtggcatgaaggcggagggtttagcatgtcgtgtgttgccgaggacaccggggaaggaaattgcctctgtgatgtgcatgccaagaagtcaatagctgcataagatcgttggaggattggcgactgatattttataaaacttgaatttttcaagggcgcacatgatttatctggctttcataatttggaccacaatgcttgttgttatccttttttttcttttgttgcattatctatgatagtgacatgtatttagttgtacactgattaattgattgatttgggtgttttcaaaaaaaaaaaaaaaaaaaaact

SEQ ID NO: 104277 - DNA, 341 bp, Triticum aestivum
  Clone ID: PAT_TA_104277
aaggcaaaccccttggctacaattctcagtgccgcaatgctactgaaatatggcctcggtgctgaaactgctgccaagagaatcgaaaccgcggttacggagacgttggacaatgggttccgaacaggggacatatattctcctggaacgacgttggtcggatgtaagcgaatgggtgaggaggtcctgaaggctctggagtcgcagaagtaaaccaaccggggggcatcgattgatcagtgatcccagggtagaaagaagcctgtgatgtgtgatggtcgaaagcccgcatagatagatttgatccggccgaagtgtgattttgattttattttttttgt

SEQ ID NO: 104278 - DNA, 328 bp, Triticum aestivum
  Clone ID: PAT_TA_104278
gtcctatccaaagcaagctgtgtatggatagtaaaaagcgggtatattgattattgatacgtctccaatgtatttataattttcgattgctgcatgctatattatctactgttttgtactatattgggttttattttccacttttatattatttatgggactaacctattaaccggaagcccaatccagaattgctgttattttgcctatttcagtgtttctaacaaatggaatatcaaagggagtccaaacggaatgaaaccttcgggaacgtgattttctcaccgaatatgacccatgagatttggaccctacgccaagaaagctt

SEQ ID NO: 104279 - DNA, 353 bp, Triticum aestivum
  Clone ID: PAT_TA_104279
cggcaccacgtggcttgaagtccctcgccttcaccaccgtgcaccgcgccgcgcacccaccgtcgtctgccgaccaccccctcctcggcgcgcaactcgcacggctgcgttaggttcctcgaaggtatcttcttcggccgctccgtggacgaggcgcgcgacgtcctcgccgccgcgtgtccgtccccgccccgtttgctcgccacccactgccactgggcctactcccagctgccggagtgcgtcaccggcagctgccggatcgtgtctatctgccgggagcccaaggacgtgctattgtcgcggcactggttgctcaagaaggtagtcgcctacggcgccaccagcgacca

SEQ ID NO: 104280 - DNA, 442 bp, Triticum aestivum
  Clone ID: PAT_TA_104280
tgctagcaagcattctacttcaggcaaactggagctgccatctgtgtcttctgctttggttttagctgctgctattggtacaatcgaagcattggcattgttcctaggatcaggattgtttcttaaactaatgggcgtgtcacctgtatgtctctcccatgtataaatctgcacgactctttctttcgctgagagccttaggagcacctgcaaatgtgattatgttagcagtgcagggtatcttccgtggattcaaggataccaagactcctgtactttttataggtttgggcaatctttcagccgtggcccttcttccgctacttatatatggttttaagcttggtataacaggagccgcaatttctacagtcgcatcccagtacattattgccattttgcttatgtggtctctaagtaaaagagctgttctgcttcctcc

SEQ ID NO: 104281 - DNA, 657 bp, Triticum aestivum
  Clone ID: PAT_TA_104281
gttttttattgttcaagtgctccatattgcttgctcactgtatattgtaagagggtgataacaagagtggatctctcaagctaattaggcttgatgcttcacacccgccgatacaatttgtttggtttggtaaggccctgaagcattttacaaactacagttacaaaattaatcttggctttgttttctattcttttcgtagccatcttgtcagaatcattcaaacaaaagcaaaatcctttggcctacaaggaatagtaattgatagaatatgcatggttcatgaatcgtgataagcgacacctattatcaaccattgctgttaaatttgagcatcaaccaaaataaggtgacattgccaaagtgcagagtttttccaattcctctttaattacctctggtcacgaaccatttggttttgaagtgcgaaatattgcattgcggatatcccttgtgtaaccggagaatattttgtcttatgagtagtttttttattccaaaccatgcaattagaggattcagaattcctctctagggggaccctcgtttatgtccgtgctatcaattctcttaatattaacgtctaagagaacttctcttgccggaaggggcagagcaaggaattttattaatgggggccaatgaaacatgtaaagc

SEQ ID NO: 104282 - DNA, 483 bp, Triticum aestivum
  unsure (1)..(483): unsure at all n locations
  Clone ID: PAT_TA_104282
tctcgttcagcatctcttttaccactcgctcgatggccggctgtcgcggaaattattaccgatcggagtagatagataactcaagcatctttttgggtattttgactgaatctggatcgagcttgcaacggcaggttagttggtttggttagttgtcagaaaagaaaccgaacgcagaaataaaaccgcgcgtgcgtccgtgttgcatgcacgtctatagctacctagctagcaacgtgccagcagatccacaacaaaaggtagaaataaaaacggccagcacagtgatcatcatgtgtctctcatgtacatacacatctgttcaaacttcttatttgctgttgtaaattacatctgttcaaactcctttttgtattcaaactcgataggtcatgcatgcacatcatatgggtccgccaacgcagctacagagatgtgccaacaaagcacccgtgatcatctcgcanaaaaaaaaaaaaaaaa

SEQ ID NO: 104283 - DNA, 513 bp, Triticum aestivum
  Clone ID: PAT_TA_104283
ccatcttgtgtgccgacgtcgaccacaacctccctctctataatatgaacagcggggggcgtctgagcctgcagtcggagtagtactgacgtaacatttgcagaacaccgacacggcgtcagccacctgcagctgctgggcagacaacatgacgacaaggagcacgcagacagccacaaccttcactctctccttcttcccagtcccctccattgataatggattcttcctcttgcctgtgacaacttttgttgggtcgacggcccctctttataccgaagagatgatcgtacttatggaaactcaaatgcctcgcactgctgccggatcaaggatggagtgaactaaaacactttgctattacaactagccctccctgttccatgaatcgacaggggaagaattggcaatgttaaattggtgagaagagagcaagaggaagatgatgagttcacatggaaaagcgacttgcgatatgttcagcggatcaccatgtcaaggaatgagcagtta

SEQ ID NO: 104284 - DNA, 596 bp, Triticum aestivum
  Clone ID: PAT_TA_104284
tggagtgctctctttactcgcttacagactaggcaagcagtgaagtttgtgaattctcttgtggtggtcatgtccttggtgtcagtcaagtatgggccaggtgtgcttgtcagttctgttgatacgattcagccgaatctcttcaccacaattcttcagcgtttttggattcccaatctcaagttgatcaaaggttctcttgaaatcaagcttacagcagttgcctcaacaaagttgctttgtgagtctgcggtgctgctggatgctgctgcagctcaaacgtggggtaaattgcttgatagcactgtcacactgttgtctagaacggagcaagatggagtacaacaagagcaaaatgacggagctgatgcggtggatagtcagaggacatcaggttattctgtctcatttgtacgccttcaatatgctgggaagagtgaagatgatctgttgaaagacataaatgatccaaagcagtttctggtgacatccttggcctcactttctgcacagtctcctggaaggtttggtcctatcattgagcagcatgtggacccagcaaacaaaagtgctcttcttcaactttgtgctgcgta

SEQ ID NO: 104285 - DNA, 499 bp, Triticum aestivum
  Clone ID: PAT_TA_104285
gtttcagtatttggggttcatctcacaagtttcagtatagactgaaggatttgtatgtgttgtggatctttttcagaagatgggcacagggtctgggagttgatagatggatctaatgattgatggaaggtgaagctactagatcagcaattttaatgataagagataaggaggcaatgctacgtatttcagcaagttcttgagtacaagaggattttggaccacacatcattagaaaactggatgattctttgtgtggtcgtattactgtataatcactgaaactaagaacaagctgcttgagccagttgcatgtggtggaagaataaaaagtttgcccggtgatctggaacgtaaagatcccacaaagattggttatttgcagcacatactgacgaactattcaagggatgaacgacgatggcaattttggttattggtgacttggcagaggttttgacgacagcgtcggtgatccagtgggtatgtcatgatgatg

SEQ ID NO: 104286 - DNA, 142 bp, Triticum aestivum
  Clone ID: PAT_TA_104286
cattattgcctggagatgcttggtcattgctcaagaagcaggtgtgtacttgattaagctactaatctctgccttgagtcaataatcattgaagttaattaaatacaatgtagttacttaagagaaaaaaaaaaaaaaaaaa

SEQ ID NO: 104287 - DNA, 652 bp, Triticum aestivum
  Clone ID: PAT_TA_104287
tttgtacatcgtcgccttgggcaatggcgggacaaagcccaacatctcgaccatgggtgcagaccagttcgacaactttgacgcccgggagaagatccacaagctctccttcttcaattggtggatgttcaccatcttcacgggcatcctcttctcctcaacggtcctcgtctacctccaggacaacgtcagctggtccgtcggctatggcatccccactcttggcctcgtcgtctccatcgtcatcttcctcgttggcacacctatgtaccgccacaaggtgcctcagggcagcgcgatcacgcgcattggcaaagtgctcgccgccgcgctctgcaaacggcgcctgcccttgccagcggactctgatgagctgcatgagctggagcacgaggcatacacaaggaagcgcaagttccggatggaatccacgaacgacatgtggttcctcaacaaggcatctgtgaaggacgtcggtggcgcatcctcgacctcaaaatggagtctctgcacggtgacggaggtgggaggagacgaagcagatcttgaagctggtcccttttgtcgtgaccatgttcataccgtgcacgctcatcgcccagaccaacaccctgttcgtgaagcagggcacgaccatgaatcggcacatggg

SEQ ID NO: 104288 - DNA, 512 bp, Triticum aestivum
  Clone ID: PAT_TA_104288
tctgactacctaaataagatgagtgccagggtgccaaagatcaaacctggaagagcaacagtggattatcttacaaagatacaaacatcgacacgtttctggggaggtctactactgagcttgctggcaacttcctcgttattacttgacagataccttagacaaataaatgaggggttttctataggtttcacatcagtcttgattattgtgggctcaatcattgaacttagaaggtcctatcaagcatataatgtgatgccagcactaagcaaagttttgaagagatatggtgcttaaggttatgcaagcacatatggtgggtgatgacggttccaccctgcagcttgaagtacctcacaagctgctgtcggtttggattgggatgatagagaattggttctggatcggtcttcaaggccatacttcgactaaagaaccaattaggatacagggaggatgaaggagctgtgcctgttttggttgttccggttttagtacagggaggatga

SEQ ID NO: 104289 - DNA, 381 bp, Triticum aestivum
  Clone ID: PAT_TA_104289
gcagcggcccaagccatggcgcagcagttgaggctggatgttgcggagacggggtcgtcgtcgtcggagttggagcgtctcgtccgcttcatcagggagctcagcgtcagatcctcctcaagcccagaattattggaaactagcacaagctgcagaggtctctcatttacatctcactactactactaatttacgagacacgtggtcctgtaaaacgaacacattgtttagtggtatctccaaatcttgagttgtgtagaccgatcatgtttttgttatttgccatccatgcttcctcatggcagtggtctggtggacatggtgttggacttggatcatcacaattattattatttctctcccaaaaaaaaaaaaaaaaaa

SEQ ID NO: 104290 - DNA, 574 bp, Triticum aestivum
  Clone ID: PAT_TA_104290
accgtgctaccaataagcaagccaccaaggtagctgagcaggcagtaactgttgacagcgcacacgacaggatgtcagggcacagcaacctccttcgtgattgggagcacccctgaagatgaggactgcagggaggcctatgaacacgagggacaagacgctgtatgaaggcctgagcaaagaggagtagattctgtagcatctgcaaaacgcagggtcgtaagagaacaacatgcccgcagcaaggagacgctcctaaaacgcagatgaaggaagcaaagtgcagcaacctattgatacggacgatgggatgagaggtaatcggacatgacagaggtaatcggatatatcgacagaatgaaaaatcggcgagccgtgccatgccaaccgaaccaactgaaaaaccagagtttggggagacaagtacccggtttaattattattattaggggagatataagtgcccctatgctttaatacatgttcaacacaacttggcagggtaacatcccagaagaatatttattcagcatggagttaggaaccaagtcaactccatgtgttgtagcttttt

SEQ ID NO: 104291 - DNA, 410 bp, Triticum aestivum
  Clone ID: PAT_TA_104291
agcatctcttcgcacatgcatgtcaattcacttgaaaagccattatcagacttttgtgctgtgccctggctgacaaaccgtgctttgccaacctagtggaggaaaggcaaggttgaccaagtgatgatccttccacctgaagggtgattaatttgcatgcttattatgaaaaaatgaagcccttctgaacattgctttctactacttatcctcgatgtggggaggccggccaaaaggggtatgcttaggtggtgaacttggaatgggataatagaacactacctgttgttacattctgattttagttgcgtttgagttttagattatttttttaccttttagcatggtaatttgctgggacctggcactattgattttgattattgcaaagtgataatcagttttatgtc

SEQ ID NO: 104292 - DNA, 475 bp, Triticum aestivum
  Clone ID: PAT_TA_104292
ctttccggtggcattggcggcgcgggaggcggtgtccaggaagagggcacgccgcgcaagcgtgaccaacggcgcgctcttgcaggaaattggttgcaggtgctgcaggagtaccacctgtgccagaattggtgttcaatgcagcaaaattgttcaacaacctggttcggatgctaataaactaacaagagttgttgatgtgaatggatcctcaacggtcatagaacaggcgagcagtgtgaacggacagttgaagcattctaaaagtcagcagaggaacaaactactagtgggctccaattatcaagcagtggtgccacagtggaccggcgttccgcctgaaaattacggcgatccggaaaccctcaaatggctgggcacaaaaatctggcctccagaaaatgagaagaaaataaccccaacctaccatgaccgtattggcaaaggcagataatatgtctgcagctgccacatc

SEQ ID NO: 104293 - DNA, 167 bp, Triticum aestivum
  Clone ID: PAT_TA_104293
tccatctacagttgagttaaacgttgtggggccttgcagccagtgccatgccgttgagaattaattgtcaaattatcatgattttttatgtttaatcatgtatcgttacatgttcgttttattaagttatctcgccgattatttcatctaaaaaaaaaaaaaaaaaa

SEQ ID NO: 104294 - DNA, 446 bp, Triticum aestivum
  Clone ID: PAT_TA_104294
ggtagtgcttttcataaattggtagtttttgcttcggtggagagcttttgacgaattactgggtatgcaaatcttggtttgatccttctactaatttatactctaatgacatggaagtcgatggcgtgaaatgcctagctgttgacatcccccctcagagttttctagagaggtgagcaatttataataacaaaaacataaactatttttgttgtggttccagtttgttgtaatgagatggctcttgttccattgaactcaaactctgttacaagagtccccttgcataaatttttgaaggaagagtgaatttcgtcctgaacttgactgaaccaaacttccgatcatgtcattccactcctttcattgatgctatttgaaggttttgtgtcgagtcattgacatgtaatgttttagacataatggatgaaatcatgttaattcta

SEQ ID NO: 104295 - DNA, 454 bp, Triticum aestivum
  Clone ID: PAT_TA_104295
catcaccattgtcgatcaaatcaaaccccaacagaagagaaaaaggaaacagattctttcttttgttcagttagtcataaggatttcgtcttctttctccgtccttgtagatcgccattgattgcaaattcgcagcggcgagaaacctgtaaatcccacgagatcgctctcacatcagctcgatcagcagccactcatttgacagttgctgtggagttttcaaccgatcgagaaccaccgacgaacacccggcgacttttgcatgggagcggcagatcggagctgcatgcatcatcaatcatggattctttccggtgaagagcgatcgccaatcaatcatggcgatgcggaggcgggccaagggaggcgctgcgcagttggaaagcgggatttgtttggtctgtcggcgcgtgatcgcacatgtgagcaagtgccaccacagtcctctcctccg

SEQ ID NO: 104296 - DNA, 604 bp, Triticum aestivum
  Clone ID: PAT_TA_104296
ttgtgtacaccgactccaccttgttcaacggaaagtttgagcttaagcccttctccctggtgaatgcacagacgcttcaggtcatcacggtcacgatcccatcaggcagttcacagaaggtggaactgtacagcccgcctagctccccgtgggagctgcagaggttgcagaactggctgcaaaatgcacgcgaggagctgtggacgccggagcaacccaagtcgccggagcccacacgtaccgaaggcttttacagactgtttgctaccaaaaacaatgagaagacagcttttcacctcaacggcctcgggggcggcgtaaaagtcggaacggaggtcgggatctattctggagcatcaaatacagagaacgccctatggcagctgacttcagacaccgccctctgtgccccctgatgagctagaagaccaccccattgtgcttatgtgtttgctgaagaataaattttacattattatccactcccttgtttaatttcctgcgttcgtcaaatttgccttcgtttttaagaactgtaccttcttgttggtcctgtagcaatgtaagcacaacccagtgtcccagttcatccatgatattacca

SEQ ID NO: 104297 - DNA, 491 bp, Triticum aestivum
  unsure (1)..(491): unsure at all n locations
  Clone ID: PAT_TA_104297
agcattcatgtagattttgttttggtagattcttcagaggtcaggagctgggatattcttactgccagaatcatcttgaatacgtgactgatcaatcaattcttggaacaatggatcaagacagaactctttcagtgaaatacttataggctctaggatcctacactatatgtccgtttcccactctaacaatcctatataagtactctgtactgcaaaacagaccaaaccatctaccacttaacttatgtatcctacactattttgctcgtttccaacctcccggttcacaatcttcgaattgctgtttcagagaagacttgtgcaatgtgcagtcttcagcaccgtgcgacatcagcatcttctgttcgcgctatagctgggtgtggtatagtgtctatggtttggttgtaaatactgcattatggctgtttgccttattcctgcttttaatacaaaggttatcctgtnttaaaaaaaaaaaaaaaaaa

SEQ ID NO: 104298 - DNA, 547 bp, Triticum aestivum
  Clone ID: PAT_TA_104298
attggggttaccaaggagtgctgcaagagtttcattgcctacaaatctctccgcaacttgggcacgcagaacctccgttctgtaactgtctggcatggcagcggcttcttactggaaccgtggtaccctgccccgcgtagcctcgagaagctaattacctggcgttcagcagttccttgtgttccagagtgggtgggttccctcgtcaacctgcagaagttacgccttgaagtggagagtcttgggcaacaagatctgtgtatacttggagccttacctgttcttctcactctggatctcgaaaaaacaacaaaatcatcagaaggcaagctcaatgtcagtggaggagatgggttccgattcctgaggaacttgcgttataatatgatgctaatgtttgcacaaggatctatgcccaggcttgaaaggatcaagatttatctagccaaaacagagtctctcattggtgacacctatgacttcgggttggagaatctcccctgcctcatatatgttgaatgcagagtgagtggcaacgcaagcgctc

SEQ ID NO: 104299 - DNA, 480 bp, Triticum aestivum
  Clone ID: PAT_TA_104299
ggtggtatgggtggattggtgagaatgacacggaacctgatccgtcgcccattgaatttaggaggcaagctcaccgattgctctgggacgcgcttgattattttgtttctgttcaagctgatgcattcttccctgggtttcacaatgatgggagtggttggccagactactcaagtttgattatggggcaccggttataccaaaccccatctggtataacctataggcctgacagaaagactgttgctacactgtttgaaaatgtcagtgatcatctgtatcacccaccacggaattggacaatggctgcacgtcagcatctcaataacagtgcaggcatagaaggcatcaaaatgtcagctatgatgtcaaaacctgcatcttttcttgcacacccgttaccggagtgctcttgcagaacggcgaagtcacctgttgtccaaccggtgaaagataagcatggtgcgctcctttttggag

SEQ ID NO: 104300 - DNA, 324 bp, Triticum aestivum
  Clone ID: PAT_TA_104300
aataaataacaataccgggcgcattattgtctggtaattggaatgagtacaatctaaatcccttaacgaggatccgctcgacccctccgagggcttccaccgcaagcccaccgcctgatgaccactggctcttgtcactgacatggtaataaaacctctgaacattcctcattcaatgatttttagcatgctattgagcgagatgtcagcttattgatctcgaactattggaatcggaattcctagtggcaggatcgcgagtgtggtgtctattgaagacaaatgattgacatgtacattctgaagggggggcccggtacccaa

SEQ ID NO: 104301 - DNA, 522 bp, Triticum aestivum
  Clone ID: PAT_TA_104301
atcccatatacttcttctatgaattgttcccaaccattgtttcatcggattcccatgatgccataccatttgttggaacaatcataagagcaatgcaggttatatacgttgatagattctcgccagcttcaaggaagtcagctgtgaatgaaataaagagaaaggcagctggcaatagctttccgcgtgtcctgttgttccctgaaggcactacaacaaatgggagattcctgatttcattccaacatggagcattcatacctggctaccctgttcaaccagttgttgttcgttacccccatgtgcactttgaccaatcctggggaaacatatcactaatagcactcatgttcaagatgttcacccagtttcacaacttcatggaggtagagtacctccctattgtctacccccctgagatcaagcaagagaatgcccttcattttgcagagaataccagctatgctatggcacacgccctttatgttttaccgacttcttattcatatgctgattcaatga

SEQ ID NO: 104302 - DNA, 344 bp, Triticum aestivum
  Clone ID: PAT_TA_104302
gtggtggttggctggctggctggctggtttcgtctcagccatcagtgcggctgcagctgcagctgcatcggcccgcacatgtgcggtgcgcttgcaatcaatcagccagctcgaagttttcttcttcacgtgactcagggataccctgtagtacgtagagtatagtgcatgaggtattcaattgtttgtcaccggtcgtgacaacctttttgtactacacaacttgtgcatttgcaacatatgagctgcaggtgtggccaacatttgtggatggccgtgcgtgtagcttggtttccccaaggataataataagtaaacaacccaacaaaaaaaaaaaaaaaaaa

SEQ ID NO: 104303 - DNA, 542 bp, Triticum aestivum
  Clone ID: PAT_TA_104303
ggtgaagagcggcggggactgcgctccggtcacggtggggtgcagccgcggggaagacgaaggaggtccgccgcctgtcttcgcctcctcgtcgcgtccttgctgcctccatggccaaccgcacatttttttctctgtccctccatggcgctcgttgccgaccggatctcaatgaacaggtgaccaccgtggcacttgctgctagccagtaaggaacaagtgacccggggcaatattcagtgtgctggctgcggcggtggtccgttcctgaaattggcaaggaggggtagatcctgcggctgtgtttccagtgtgctggctgcggcggaggtccgttcttgaacatgatcgcaaagtcccaccgtcaagaacaaggtgaacctcctggccatcgcaagcgggaagaggccgtcaagggaagccgacctgcagctaccacgctccacgacgccctccccaatcagatttctcttcttcctcactcatgccctgccgcgtcgccgccctagccacttcttcacaggacaaccgtgggcagtcac

SEQ ID NO: 104304 - DNA, 556 bp, Triticum aestivum
  Clone ID: PAT_TA_104304
ggccagggtttcctcggcgggcacgcagtgggaggacttcggatctaccagcacccagtaacggaggagtcctcctgctctccctcttccccgcggctgccggcgacgggcgcttccgactgtcacgaatcgagtgcccgccacctgttcgacggaatgctcgagatggctgctgcgagtgacagagacccttttggagacctccctgacgagctcctatcgcgcgtgctgtccttccttccggcagaggatgccctacagacctgcgtgctggaaacccggtggcgcgacctctggaggcgcttgaccagcttgcggttcgtctttgatgggccaacgtttccgcgatacaaccgtttcaaacggttggtgaagctgcttatctgtctccgcgggaactcgcctctcatcaggtgtgagatcgacgcctatcctgacgatgagccggagaacatgttcacaaacaccaggctgttgattgactatgctctggcgtgcgaagctgaggaactcatagtaagagcagctgacatacagtacgacctaccagtgttcg

SEQ ID NO: 104305 - DNA, 471 bp, Triticum aestivum
  Clone ID: PAT_TA_104305
gagcacctaaagaatggaacaatacgtagcttgctcttggagctggttctgtcgctgcgcctcctgatctaccaatatggtattgtgtaccacttgcacatagtgcacgagaacaaaagcttcatgatatatgcactatcgtggctggttattggcatcgttcttgtttcgctaaaggttgtttcactggggagagagaagtttgttaccaagtttcagcttgtgttccgtatactcaagggcattgtgtttcttgtcctcatcggcttgatggtggtcttatttgttggttttgatctcgctgtgtcagacgttggcgccagtgtcttggccttcatcccaactggctggtttattcttttgatggcacaagtgtgtggaccgctgtttcggaggttagtgattgagccacttggcgtgctgtgttgctcctgctgccctggtggagcatgccgagggccttgctgcgcc

SEQ ID NO: 104306 - DNA, 413 bp, Triticum aestivum
  Clone ID: PAT_TA_104306
gaaaacagtctttaactcagctcaagctcaagcacaatctacaatacacttatagcctattataagccatggggaggtgcaattgagcactacagaccatgatggcggtggccacctcaagattagcaagaaagggtgtgactagacagcacaattttcctgtgagcctcctaataattttaatgcagggagcacatcatagggacattttttgggggtcattgtttcctctctttatcattttagaagtgtcaagaaaattaaagttggagatctggtcagatggcccaatcatagttgaattgcatcattctcttcttttttttggcgtcaagttgaattatatcattcatgaatgactgaattgttttaagcgtacactgtactgcaacggggcaggaaacctgaaacct

SEQ ID NO: 104307 - DNA, 615 bp, Triticum aestivum
  Clone ID: PAT_TA_104307
ttcccaagctgcaagcactggagaaattgaagcatgtcaatgtctattgtcagtcatttaacttcctgcaagaatttgagcagatgcagagtctgaaagtattgcaccttcattttgaggattattattttgttgacggaatggacgctgaaaatgagtccaagaaaactattattgccacttcccttacaaacctagggaaccttctctctctaactgtttgtgacggccctgaatttgtaagggagtctttgtgccctatgccacttagcctccagaagctgaaagtcttgaattctagtattccccatgttccaaattgggtgggctcccttatcaacctccagaaattacgccttgaattggtgagagctgagcaggaagatttatatatccttggaggcttacctgttctgcattgtctgattctgagaattgatggccatgaaattagaagtacctcattaacagaagagctcgaagttacaagggtcatagtctgtggtgaagttggattcccatgcttgaggatatttatttttgatagtcagtgtgctgtgatgaatttgacctttgcggctggagccatgcccttggtagatgacctcttgatag

SEQ ID NO: 104308 - DNA, 604 bp, Triticum aestivum
  Clone ID: PAT_TA_104308
tataatcaccttccttcccacgccaagccctagcataacctttagtttatcgaactcttttgggttctcctcccacagatcatccaaaacaataaggatcctcttaccagcaaacagctctttaaggcggttatgaagcatctgtttggtagatatattgctgatcttgtctgttaactgcattattatagagttgcctatcttatgcaagttaaattccggggaaacatatacccacacccgagtgtagtcttcaaactgttggtcattgaataccatttgtgccaaggttgtcttgccaatgcctccaatgccatatattggaaggatgaccattttttctgtgatgtgctcggataaaatagacaatattttctgtttttcctcagtccttccgatgattacttcttccacatctgatgatgtttccctgtcaggaacttgctgcacagcacggttagagctatctgttggcatcgaattgctatgtccgttatcattactgttcagttcagcaaccatcatctccaacatattagactcgctcctgagcccaatagttggacacgggagcacatctatcatctgtctcttgggatatgag

SEQ ID NO: 104309 - DNA, 490 bp, Triticum aestivum
  unsure (1)..(490): unsure at all n locations
  Clone ID: PAT_TA_104309
gaagtcagtgaaagtgggagcaaagaagcgtggtcgacccaaaggcagcaagaacaagaagagtttgcgagttgtgacttgatagcgatgaagatgattggcatggcatgatcataggtcagaccgggttagttcggctattaatttcatcctgttgtcgttgactgaagcatttgctctgttggttggatactactcatttgctgctgacagagtgacagtatctacatgagaagcatggctactttagtgatggaataagttatttgtttaccgggtagtcttttcttagttgatgagttgtgtgaccgttgttgccatttatgctttagatgatgtagctgttgtatgctgtccaatttcatgactctccttgagctagctttgtggatccgagattcctgnggattgctctttgttaactgagcaatgtacattcaaacaatgtgctgcaataatcggacagttgatgttatgtgtttcttctcca

SEQ ID NO: 104310 - DNA, 300 bp, Triticum aestivum
  Clone ID: PAT_TA_104310
ggttctgtcgtttcaagtacacccttgagcaaacgtcaacttatacaatgggcaattttatggattctgtggctctagaacaactaagtttccctcaaatttggtgaaggacccttgtcataatggtagtcatctagcaagcacttattcggcccttgctacgttgaagattgtatgttttgatgtactaaaccttgatagcgaggttcttctattgtcgatgaaaaaactcccgcgccccgatggaagcttcatgcctactcatattggtgcggaaacagacctacgctttgtttactg

SEQ ID NO: 104311 - DNA, 588 bp, Triticum aestivum
  unsure (1)..(588): unsure at all n locations
  Clone ID: PAT_TA_104311
gcaggtcatagtcaaccccatggcagttcatttgaacgaagattgttcgaagatccactcaaatttaacccatggaggtggatggatgagtcaaagcgcagtgcaatgctgaagaatttcttgccatttggggcaggaatcagggtttgtcctgcggcagattttgtcaagctgtttgtaacacttaccctccatattttggtgacggagtatagatgggaagaaatgaaaggaactgacgaattccgaagcgcggatgttatgttcccgcagggctatcacattcgacttcgacccaaggacgatcaaatgaactgatgcagatatcaaatggaacctacgcccgtcagacttctcaaccatgttatggttcagacggacacgacgatggcttgagggcgtgtttcccttcttaaaaatgttgcgaaagaagtctggctcttaaattcatatcatgtaatagttctgccatagttgtccatgttacatactctgtttgttgatgactttgacctcgctgtcatgcatcaactntaataaaaaatgcttgtttgtatcacaaaaaaaaaaaaaaaaaaaaaaaaaaac

SEQ ID NO: 104312 - DNA, 601 bp, Triticum aestivum
  Clone ID: PAT_TA_104312
cttcgcatcgcgatcgcctccgccgccgcgagctcccgtccctggtgggcgcgcccgccggcggctagggctcccgcctcccccacgggctttggcgggactcctcctaaggcggaggagatgagcggggaggtggaatgcagcgtgtgccacgccaaggttgccgtgccggcggcggccgtgtccaaggcctacgacagccaccggagcaccgtgtcgtcgcggcagcgcgcgcttaacgtcctcctcgtatccggcgactgcgtcctcgccggcctccagccgatattggtatacatgtgtaaagtggatgggaaattcaaatttagcccagtcagtgtgaacttcttgacagagattacaaaagttatctttgccatcatcatgctgttcttccaggctaggcgtgtaaaggtgggagagaagccacttctcacagtttcaacatttgtgcaggctgcccacaacaatgttcttctcgcggtgcctgcttttctctatgccatcaacaattatttgaagtttacaatgcagctatactttaatcctgcgacagtgaaaatgctgggtaatctcaaggttctgataattgctgtgctcc

SEQ ID NO: 104313 - DNA, 274 bp, Triticum aestivum
  Clone ID: PAT_TA_104313
agaaggctatacatacgtgtaggtgcaaagcatagatgagaaagtggcagtggcagtgatgctactgtaccgatcatttattgaatgtgcagtagagagggaggggaagatgccaagcccggaattcacactgcgcgcgagatgagattctcaccttgtgcttttgtactggatcctcgcaagtacaatttctggaacaggggctccagcccagacagacccttaaatggaaaaaagaggaggaagctttccctttaaaaaaaaaaaaaaaaaa

SEQ ID NO: 104314 - DNA, 452 bp, Triticum aestivum
  Clone ID: PAT_TA_104314
ttgaaatgaccagcttgtatctattgtaggatcaaaactggttcagcatcatgaggaattcgacttggttaatgatgagcttacgatgttcagggagaaagtgtgcgagcaagagctgctgatcttggagttcaaaggcgaggccagctcgatgaagagctgtctggatgaggccatccatcaaatccatgtgtgcaagcaagagatagttgggctgactgaaagcttagcttccatgtctgttgctttggaggaatcaaaagagcaaaatgccttgctcgacgcgactatctgggaaatgaagagaacagcagcgccacacaccgacggtcatataggagatgatgcaggctccctagagcaattcacccttgttagtatgcagaaattgtctaaagcatacagtgatttcgaaagcagattaacgcaaagtatgaagcaaaatgatataa

SEQ ID NO: 104315 - DNA, 653 bp, Triticum aestivum
  Clone ID: PAT_TA_104315
tgagctacttcgcgtcgaccaaggccgagatggaggccgtgtggggcagacataaagtctccaagctcctcgccagctccttcttcctcctgggcttcggcagcaacgacctcttccagagcagaccaaagtcccaagccgatgttgccggactctatgccaccctcgtctcgaactactccgccgccatcaccgaactgtatgggatgggcgcgagaaaattggggatcatcagccctggcccagtggggtgtgtgccgcgggtgcgcctgttgaacgcgacgggtgcctgcaacgatggcatgaaccgcctcactgtcgggctcgccgcggcgttcaagtctggcctcgctgcagccctcagcccaacgaggctcccaggcctcgcatactccctcgccgactccttcgccggcacgcgggccaacttcgacaacccacaagcggccgggttcgtgaacgccgatagcgcatgctgcgggagcggtaggctgggcgcggagggtgagtgcatgaggaacgcgacagtgtgcagcgaccgcgatgtgtacgctttctttgacaacgtgcaccccagccagcgggccgctgagctgggtgcgcaggcgctcttcgtggacgggccgacacagatcaccacacccatcagcttc

SEQ ID NO: 104316 - DNA, 583 bp, Triticum aestivum
  Clone ID: PAT_TA_104316
agcagcacggcggagctccaagaaagcttgcaataaagcctgaagacaatgagatgacaactaactcagctatttcatctgattgtgcgcggcctcgctgcgaactccatcaaattccacggctgcaacatgaagtcctacccggatagtcgcggaccaccacgcgtcgtgggcggagtcctagcgtggctcactggctcccaggcccaggccggcaaatttcaggacggcgccgaccggctcgagcgcaaggatggatgaggaccgcggcgggctgctctccgcgctcttcaccggcacgagcgctgacggtggcgccgacaaggaggaaaaagacgaagctggcccgccggaggtggcgacggtgcacaaaggcggcaatggccagtgacacagacgacagtggtcggatcgcgtgagggctagtcatgccgtccgccgcggcatccactggccattattggcggggaagtggccttccgacgactgtgacaagatgaccaagaggcccaatggcgtatctgcaggcatcgtgctatgcccaatggcccaatggccatttagtgctgtaacacgatttttc

SEQ ID NO: 104317 - DNA, 485 bp, Triticum aestivum
  unsure (1)..(485): unsure at all n locations
  Clone ID: PAT_TA_104317
ttggctacgccactcgcgtctggtcctcttgacatgccggccttgataagtacacggataccacaccgaggccaaagttcacaaggtatgcaacagctgcactcgataataaaaagcataagatgaattttatgttaggtacggacacatccaacttttaccaagcatagtccgtgttaagcgaagtacattatctcgcggctgtgtgatgtgcagatataggaattagacctttcttcacaggagctgtattcattatttatcaagtaaaccgtattttatagcagatcaaataggcctttcctagcaattctattcataaagatgtttgatgtcttgcttgatactcgtgttgcagtttgtgaggaactacgaanattctttactctttatacacaatttttttccacatatccattggccaaagaagtgcccatgaagatcaggtatattatagtgtctgcagatctcagaataccatactt

SEQ ID NO: 104318 - DNA, 560 bp, Triticum aestivum
  Clone ID: PAT_TA_104318
ggtgtgtgtttacctgctcgacaactgttcaacgaaaatgtcaacgaacctttggccatagcttcttcctcttctcacaacaatatttggatgatcagatgggtcttcttctacatggtgactattaacgcaaaaggattgcacttctatctcaaccactacatttggttactcagattactggattgtaccgtgcaaaactacgccaacagaaccaaatgcttccgctgcaatgcgcccaaatcatactatggttaaaaagacaggcctgaaaagaaaattaaaaaatggaagtattattggtgcaatgaacaatcatgagtcctcaaggatttttccttttttttttctcctaaagaaaaaccttcgccaacccgagggtttagtcatggagtcctgctacacacgacaatttatgcacgatgtttgcacgacgagacaatcaagccgtccatgcatgcagcagacggcagcacagcgttagtcatgtggaagaggagcggtaagccgccgctcagactcagaaaagggagataagtgggcacaagcgtgtacgtgtg

SEQ ID NO: 104319 - DNA, 589 bp, Triticum aestivum
  Clone ID: PAT_TA_104319
agcagtggcgtgctcgttgtgtggggggtgcgcggtccaatggaggtacgggtcgacctcggcctgctgcgtgggagtggctgcaccgggtgaaagcctggccggtgctgaccggccgtcggcgacggcgcctgtgggcgtcgctatcctccttggaggcgttgtcgggaatcttcacagcctctactcccggatcaagtccttcgggtgaaagcccagatcctgctacaaggtcgggcggtgtcgtcgtcttcaacgccgttcccctctttagggcgccgtcttgaagaatttgatccctttggtgcttcctatgactggacgtgcacggtggcttctgtggcaacgacaacggtggtgagcaacgtcggaggcgcggctttggtcgtggtagtcggctcttcttctccggcgtgtccatgggaatgcctcgactgcccggtgccgtgaagtcgaagccgcggtggggggccgctcgtatacgatgacgcgtgtcaggtggctcgttcggtgatccctcgtgacgccaaccttgcctcgtttctttgtggttcatcttcggagtcggagctgcgttgtctaatgtgga

SEQ ID NO: 104320 - DNA, 622 bp, Triticum aestivum
  Clone ID: PAT_TA_104320
acaaacacggacaaccagaaccgacacgaactgtataggttggttcagagaaaccatggtttcacaacccgatgctctcgacccacacacacacaaaaaattgagcatttcactcctcggcagcatttggaaatgaaaaaaagcaaagcctagttatcacggcactactagagccctctctccttcattcagtcccagcagatgcttgatgattccagtgaactcctgcgccgatcagcactcagcgttgtcgtccagctccgcgagcgccaccctgctgccttcatcggcagtgatggccaggttcttcccttccttggcagcaataagaccctcctttaaagcactcttaagcttccttaggctcatgttagtgagggcgacgttttgctttgcgcactcttcattcttctcctcagtgatggtgaacttgtgcagtgtcttgacgatggtctcggcgtgctgagaaacctcactgccctcgctggattcttcaagttcttcgatgatgacagagtcaacagtcttggcttcaagttcttcaagaccctccttcaaagcacttttaagcttccttaagctcatgttagtggtggcagagtcagcagtcttggctgcagat

SEQ ID NO: 104321 - DNA, 400 bp, Triticum aestivum
  unsure (1)..(400): unsure at all n locations
  Clone ID: PAT_TA_104321
cacgtacatcctcaaccgggacatggacaccatcagcaggctggttgagcgggtgcgcgacgagggggagtacatgctcgcgctgctgcagctctgcgtggcggaggaggccgccgccggcgccggcgccgggaaggggaggctggtgcgggaggtgctcangcagctgtgcaagaacgaggagagcttcaggcagcagctggacgagctggaggagcacctcttcctctgcttcatgaccatcaacaaggccaggagcatggtcatcaagttcatggccaccgccgcgagccggtgatcactgatcagcacggcatactacaaactgtacataatagcattctttcttttttttcataaaacagcaaggaaaaaatacccaaaaaaggtgagataaaaa

SEQ ID NO: 104322 - DNA, 354 bp, Triticum aestivum
  Clone ID: PAT_TA_104322
gggccacactacgaggtggagaccgggcgccgcgacgggaacgtctccatgttggaggaggccctcaccaacctgccaccggccgatggcaacgtcaccgtgctcacccagtacttcgccgtcaagaacctcaccatgaaggacatggtcgtcctctccgcggcgcacacgattggagtgacgcactgctcgtccttctccaagcggctctacaacttcactggagccggcgaccaggacccctcgctggagccggcgtacgggaagacgctgacgaccaagtgcccaacggagaagatggcgagcgtggtgcccatggacgatgtgacggtggacaagttcgacctgggatac

SEQ ID NO: 104323 - DNA, 316 bp, Triticum aestivum
  Clone ID: PAT_TA_104323
ttttttttttctttttttttttatcaatcaatttacttcaaatccttgacaaataacaaatcaatattgtttacattttccagaagtccaaaaatatataaccaacatcttcaggcatgtaggcgtgcttttcagttttgctgcagaatacagggaaatgaaaccagaaagaggtctagcttgtgaatggaggctacatggaattacaaagctgccagtgcacaagacatgtgggtacaacttgtgcatacagactggaaagaataggatctgactataacgtaggaaaatgatacaagtttgggttcttctctta

SEQ ID NO: 104324 - DNA, 600 bp, Triticum aestivum
  Clone ID: PAT_TA_104324
agcggcgacgtcgggcctcaccatgcgtgacgggcgcgccgtcgtgaacgacctccagttcaccgacaactcctcctgggtccgctgccgcaagttccgcatcggcgcgcgcgtggtgccgggaagctacgagggcgccagggtcgccgaggccatgaccgaggccttcaacgtccgcgaccaccgcggcgaactttaccggaagcactacccgccggcgctcaccgacgacgtgtggcggctggagaagatcggcaaggagggtgccttccaccggaagctgcggcagaacggcgtggagaccgtgcaggagttcgtgcggatgctcaccgtgaggccggaaatgctgcgcgcgatgatgggcgacggcatgacggaccgcatgtgggaggtgaccacgagccacgccaggacgtgcgacgccggcgacaaggtgtacgcgtacgccgggcagcacggcgccaccgtctacgtcaactccctctgccagctggtccggctcgagttcgccggcgtcgagtgcgcggcgcagcagctcaccagggcccagaaggcgtacgtgcaccagctgtgcgtggaggcgttcgagcagcggcacag

SEQ ID NO: 104325 - DNA, 336 bp, Triticum aestivum
  unsure (1)..(336): unsure at all n locations
  Clone ID: PAT_TA_104325
ttgtggatgatgaatacttagcttaccgagcagtgcttgcngaaaagaaacggtggcacagccagcattccgtctatcaaacagggtgaggtgttgccactacgtgctccagttttctcagagtccttcaagttgctccggcgggctcaagcagtggctgcgaaaagaaaaggtggcacagcaagcaagcaagctatcaaacagcgtgaggtgtcgccaatacctgctccagtaatctctctgtccactgtcttcaacggcctccagcgggattgaggttttgcatggttgcatggtttgactgacaaagtccaccggagtactaatctttttatt

SEQ ID NO: 104326 - DNA, 543 bp, Triticum aestivum
  Clone ID: PAT_TA_104326
tactcttcactggtatagttgattataattaccatgccaagcatgtgacactaaaaaaatggctgccttttcaatgaacattagttggggtaggataggaagttaactacatttgcaaactacttttcctttcttcttccttgggggaacgaactgattcatgtgaaattcccgtgttacaaatcggtgctgaaaccatacaaggacattagttctggtgtgatgtgaaccagttaacactcacatcaatctgccattgttaattgggataactcttacagatgaaaccatatgaggaaatttggcctatgtacctagcagcaccatgtttatgcatcaggaattggatttgcacatatttgcatagatactgaactaagttagcccaaagggagctaaactctgaagtttcatcatgacaacctttgtttgtacctgacgtgaaaaataatttctgaaaatgatgccttcaaactaatctcacattgcattccaggttgccgggaacaggcgagtacaacaagttctacggtgatggggcgt

SEQ ID NO: 104327 - DNA, 422 bp, Triticum aestivum
  Clone ID: PAT_TA_104327
atatataaacaagaaatagtaaataaaatacattttgttcaagccgcgtgggcaagatcgcgcgattcaaggttacaaattactagacgcaaattaagcactccatccaaaccatacgaaacgcaggaacaacgaacgcatgcatgcaccggggaaccgatgaattaaactgatcagttcatgggtcacgacgcgggaggatgtcgacgtcggtgtcgacgtgccagcggcgccagacgggtaggtccatgctaacaccggcgtggatgagctggcggcggccacctccggtgacttcgtcgttcatgtggcccgcgccgcctgccacctcgttggccagcatcctgccggccaccgcggtgggcatgacggagctcagttgcaggacgacgccgaccaggacaaggagcagcaccgtgttc

SEQ ID NO: 104328 - DNA, 396 bp, Triticum aestivum
  Clone ID: PAT_TA_104328
agccgcggcgtcacacaacattcgtttctgctgctttgctcgtaccctctcgtctctctttttttccgggatttctttggttttggatttggaactgctcaaatgacgaggcgaaggggtgttttaagtgttttgcatggcccccctccacgaaaatctcctctcacttggagcaactccattgaggatctggagctgccagaggaagtgtttggctagcctaaaaggttagctattgaagctccggccgtcaacacgcgtttctgatatttttacgaggaacgtcctccagtcatgttgaagcaaaggctgtttcccctagggtctagtgtggtgtattccttttgttttcccaaaactgttctgtatcttcaatggaccgaatgaaccgaaacc

SEQ ID NO: 104329 - DNA, 372 bp, Triticum aestivum
  Clone ID: PAT_TA_104329
gctcgtggtgaccgggtgggttcctcaaatcagcgtgctggcgcacgacgccgtggccgcgttcctgacgcactgcgggtggaactcgaccatcgaaggctgctgttcgggcacccgctgatcatgctgcccatctccagcgaccaggggcccaacgcgcgcatcatggaggggaggaaggtcgggatgcaggtgccgagaaacgagagcgacggatcattcagccgggaagacgtcgctgtgacggtgcgggccgtcaccgtggaggaagacggcaggagggtcttcacggccagcgccaagaagatgcaggagatcgtagccgacggcgcatgccatgagaggtgcatcgacgggtttattcaggggctc

SEQ ID NO: 104330 - DNA, 489 bp, Triticum aestivum
  Clone ID: PAT_TA_104330
aaaagaaattctcatcagttttgatgctgcggcttgcatttcagagccttggggtggtctttggtgacttgggcacatcaccgctctatgtgttctataatgcctttcctcatggagtaaacgacgacgaggatgttattggagctctttccttgatcatttacacccttactctcatccctcttgtgaagtatgtttttgttgtcttgcgggcaaatgacaatggtcaaggtggtacacttgctctgtattcacttctctgccgtcatgcaaagatcagcactatacccaaccaacacaagactgatgaggacttgacgacatatagtcggcaaacttatgaggagaactcattggcagcaaaaataaagagatggctagaaacacgcgcatataaaagaaactgtcttcttattcttgttctccttggtacttgtacagctattggagatggaatccttactcctgctatatcagttctttctgcat

SEQ ID NO: 104331 - DNA, 513 bp, Triticum aestivum
  Clone ID: PAT_TA_104331
cagtactgtaggtataagattctgatgttcctcttgtgacgctcttgcctcattcacacatcaacccgtaccccgtattccgtactcgcccccaatcttacgtcaaccacccctcaatcgacccctcatcagcgcaacaccagcgtctactcacctttcctgtcctacaaacacacacgcatcatgtctggcccttacgatcaatacaaccagggctaccagcaatacccgccccaaggccaataccctccccaacaacaaggctacggacaacagggtggctaccagcaacaaggctacccacctcagcaaggccagggctactacgaccagcaacagcagggctaccaacagcaaggctataaccagcagtatggtgcgcctgctcacggcggcttccagcatggccagcaagtagcgccgtacgaccatcaacagcaaggatacgggccagcacaacaataccctccacaaggccaataccctggtcaagcaccatcaggacagttcccg

SEQ ID NO: 104332 - DNA, 500 bp, Triticum aestivum
  Clone ID: PAT_TA_104332
cgagctccgccgacccgtacgaggacttccgcaagtccatggaggagatgatcgccgagtggccagaaggcagcggcgtcggcgacggcgatggggagcacagcgcggagagcttgctggagacgtacctcgtgctcaactcgccgcggcattacccggtgatcctcgcggccttcgccgacgtgcgggagacgctctgcccctgaactcgatcggatgtccggctgcaccggtgcgatcgatgttgataggattaacattgtggagcgagagcgagattaatggcacacgatcgagttggacatgtgcgatgttgcgcgcttacgtgcgttgtctccatcgttcattcatggctggatcttgaccagctaacttgtgcttagttgggagttccggactccccctctagttctgtcagtgatggtactgtaccttagtttcttcatgttaacttctactagtccagcgttctgctaaaaaaaaaaaaaaaaaaaaactcg

SEQ ID NO: 104333 - DNA, 486 bp, Triticum aestivum
  Clone ID: PAT_TA_104333
acagcttcggggtggtggttctcgaggtcgtgaccggcgcgatggcggtggacatgaggtcgccggaggtgctgctcgtgaggaaggtgcaggtcggccaggagcaggacgtccgtggcgtggaggcgctcgcggacaggcggctggacggcaggctcgatcggcgagagctggtgcggctggcgaagctgggcatcgcgtgcacgcggtcggacccggcggcgcggccgagcatgaggaaagtcgtcagcattctggacggcaacgacgaggtgctgaggaagttcgagcggcggatggagagcagggaggagtgggagaggaagaacgcggcggctctgtccttggtgaggagactgcaggctcttggcatacactgaaacatcaaacatgcatcgcagttaatgtaagctgacaatttacattccagagaagaggctatcgtatgtttctttgttcatatgcaaaaaaaaaaaaagatctggt

SEQ ID NO: 104334 - DNA, 530 bp, Triticum aestivum
  Clone ID: PAT_TA_104334
agttcgaacacgcttcttgtgcaagctgcatccttgtaggatagcaactaccataccatgatcaatcacaggtccttatcggaaaaaaagatcaatcacaggtgggtggatccggcaatcagtcaaacgcttcgagcaagatggattaaagaaagtgattttaatgatctcgttgaggaaacgtggcagcaggcatatgcatcagcgtggagaaagaaaaattatatcaagaaactgaacgatggagatggtaattctgtggaaggtacgacgcctctcagccaacatattcataattactttagtaatttgttcagtttggaagttcagcaggtagaccctgagattatgcaggaagttcagactaaagtgactaatcagatgaatgatttcctgattcaccatatacgcatgatgatgttcgcaaggccgtgtttagtattggtgatttaaaagcaccagggccaagatggactacatgcacttttctttaaaaaatattggcatgtactcggtgatgctatctcata

SEQ ID NO: 104335 - DNA, 191 bp, Triticum aestivum
  Clone ID: PAT_TA_104335
aacgacgtcctcgtggcgccgctgcggtaccgcccgccgctgtcgctcctgttccggagcatcatcaacgggaacgtgtgcgtcgccggcgacgcgctccaccccacgacgccggacctggcgcatggcgcgtgcatcgcgctggaggacgcggtcgtcctcactcggtgcctctgcgacgcgatggacgg

SEQ ID NO: 104336 - DNA, 394 bp, Triticum aestivum
  Clone ID: PAT_TA_104336
acgtgcagtcggaggtgctgatgcgcaaggacgccagcacattcacgttcaggcaggggtgggcgtttccgcggaagatctacttcaacggcgacgagtgccggatgccgccgccggactcctacccttacctgcccaactctgcgccggcgtcgctcgtgagctccgcttccgtcgtcgtcgccgtcgccttcttggttctcctcatggcatgagcgtcagaggcggtcatgatgctttgcctgtagactagaacatcaaagcgcgcgttgccgcgcccgcccatgtctaaagaataagggactgtctattttacatccggatgaaattcaattagctttcatccatattttttagccaaccaaagaatgacaagtgtctcctgtcccgtgtc

SEQ ID NO: 104337 - DNA, 239 bp, Triticum aestivum
  Clone ID: PAT_TA_104337
ttcttcgtggaggcggccgagctggagcgagcggtgcggagcctgatgggcggcgcgtcggaggaggggaggaaagcgaggaggacggccgcggagacgagcgccgcgtgcagggaggccgtcggcgagggcggctcgtcgtgcgccgcgctgcagatgctcgtgcgcgagattttggtttcgccgacggagggaaaccattcccgctaaatttgcagcaagcgccgtggtgatgcact

SEQ ID NO: 104338 - DNA, 427 bp, Triticum aestivum
  Clone ID: PAT_TA_104338
aaactcacggcatgcactgccgttgctgttctagtctcggttgatgtttgtacttgtacaaggtgaacaattttgttactccttactctgtgctaaatattcagggtgacatctgcttgttcttttccttacaaagtttttgaacatactaacccatgggtgattttgcaggctatattaactcaatccatgattggttcacacagtaatgttctttatattgtcatagtaacaactatctggcgaattgtcatacttgtggtaaattttacctgtaaaattaccagaacactgacaccatcagagcaaagatatcatgcttgaacaattctgttgaacaaaatatcacgaaacataaatataatggaatggcagaaaagcaagtgtccagtctgctgtacattttattgactgaacttattacact

SEQ ID NO: 104339 - DNA, 470 bp, Triticum aestivum
  Clone ID: PAT_TA_104339
attggtctgaactgccagtaaatattcacgtgtaagaaaaatcaactcttgggataggaggaggaggagacttaattgcagtaatcagagcatctggaagcataacacgaactcgcagtggcctgagtgtttctagttcgggcattattgccgagcagttaatcaagaagatacgtactgttagagagtcagaaaagtataaagctgttatcctccgtatagacagccctggtggtgatgctcttgcttctgatctgatgtggagggaaattcgactcctggctgagtccaagcctgtggtagcttccatgtctgatgttgctgcaagtggtggatactacatggcaatggctgcgccagttattgttgctgagaaacttactctaacaggatcaattggagttattacaggaaaatttatccttcaaaagctgtatgagaggattgacttcaacaaagaaattctatct

SEQ ID NO: 104340 - DNA, 468 bp, Triticum aestivum
  Clone ID: PAT_TA_104340
acgatggtatccatgaggtagaggtcggccatcagatctggtgtaggctcatctcgggccggcagccacgcagattcggttgtacgaacttctcgcagctcacacggtagctgacctcgagcttgactagtgatcggagttggactatgcagagttggcacccctgcattgacgacttggacgtccgtcgtcgtcgagctccagcaaacttcatcttcctctgtggtgagctagacaatgtggactgcacgcttgccgacagtggcctcaacgacggagccatcatggtaactggtaagaatctctttgatgtgcatagttggcctacattctctcatagcggttagtgtgaatgccactcttgttgatttttgtcctctgaatttgaaaaatacaagaacgtgtgtcactttgtttgctcacgtttggcactgagcccgtatctttgtgcttagatttgtaatgagc

SEQ ID NO: 104341 - DNA, 467 bp, Triticum aestivum
  unsure (1)..(467): unsure at all n locations
  Clone ID: PAT_TA_104341
aatcttcatagctagctagccaagccactagctccttcgtccaaccaacaatggctgcatttccgctcaagatggtggccatatgcgccgtgctggtcatcctcctgtctatcgcggggcagccagcgatggccgacataacaaatggtctagcttgcccgagtgccgatacgctatgccgcgatcgatgcagaccagcgtgcaacttctttgccaatgtcatgtgcaacatgatatgcaccctcacgccacaagtgctcggaggggtggaccaggcctgcgtgaaccangccatcctcccttgcatgaccgcctgcaagaacttgtgtgagcccctcccggtacaaaatccttgatcgccgcctggcaagggtatgccgttgccgtgcttgtttcttcgtagttaatttaccattctacttgcagcgaacgggatggacttacgtatgttggcatgcatggttatg

SEQ ID NO: 104342 - DNA, 486 bp, Triticum aestivum
  Clone ID: PAT_TA_104342
tttgtgattatcttcagttactgtcctgttttcgtcgtcttgtttcacgtgcgatcttggtgatgtttccaaggctgcaaatcttggtgatgtttcagttatcatctggattttttggttttgcttgtatgccctgttatttttgtttgctggctctgtggttcagtgtttctgcacctttttcctcatgtctgtacagtgatttgatgaacacatatgggcttttggctctgctcgaagtgattttgaattttgtttgggtaagctagctagctgaaggtgaagaagcgacatattttgaattctgctctctgtactccactttctcttcttgtctcttcttctctttctcttctcttctcttctctttcatttaaatggagtatatggagtaaaaatgatcaagcctcacaaaatggagaacaaaatacacatacattatttaactgtgatttagagctatgattatctgtatactgctgctgc

SEQ ID NO: 104343 - DNA, 598 bp, Triticum aestivum
  unsure (1)..(598): unsure at all n locations
  Clone ID: PAT_TA_104343
caaccgtgaagcacaacaggagataaagagttcaatgacgaggtagaaacactttctaggatgaggcatccaaaccttgtcactctgataggagtgtgcagggaggccaaagcgttggtcttcgaattcctgtcgaacggaagcctagaggactgcctgcagggcgagcaccaaagagagccgctctcatggcgaatgcgcatcagaatcgctgccgacatctgcacgggacttatctttctccactccaacaaaccaaaaggcattgcccatggcgatctgaagcctgacaatgtccttcttgacaatagctttgtttgcaaactggcagactttggaatctctcgtcccttggatctaacaaacaccaccgtcaccccttaccaccgaacaaaccaaattaaaggcacaatgggatacatggatccaggatacatcgcctcaggggagatcacagctcagtatgacgtctactcctttggtgtagttctgatgcggttgctaactggcaagagccccctangccttccgaatgaggtggaggcagccttgagcaatgacatgttgcaagatataattgatacttctgcaggggaat

SEQ ID NO: 104344 - DNA, 513 bp, Triticum aestivum
  Clone ID: PAT_TA_104344
tcttcaaacttcaatatgccagcaagccactttagagccttggtacactcacgtcaaaatttgtttcatttcaatgcaccatgccacgagttccggaaaattatttcgtcatctgattgatggttttatgactattttcatttaagaacagtgcttacttgtgcatatgtttgttactgaatctgggagatgtagctaaaagctgttcaacttatgctttttaatcttatgtgtattgtatatgttgcgctcatatggtttccacaccacaaaaagtaaactgaaaataagttaacttgtattttgttggaggtttatttagatttcttttttctgtggaaaatccagttcttgatttttatgccatcttttgttgttacaggtacgaaaccttgttttactatcctcaagataaacatgtttcagatgctaaacaagggaatatccattacctttttgtgatcttgaccatcttacgctaggtatggtgacattgctaagcatgctttggct

SEQ ID NO: 104345 - DNA, 445 bp, Triticum aestivum
  Clone ID: PAT_TA_104345
accacccctgcagctacgacgacgtgatcagccctgtctccggggagcaaggcgcgggcttcgagcccagccgcgacgacagcgacctgtcggggacgaggaagaggcgggaccgctccaagaccatcgtgtcggagcgcaagaggaggttccggatgaaggagaagctatacgagctcagggctctcgtccccaacatcacaaaggttagtactactctagttcctactgtacttctaatttgtatcctctcatgtcgtgatcgatagaaacagtttgttacacgagatgccaattcttactgggagcgcgcgtctctttcctctgtacgtacgtgcagatggacaaggcttccatcatcgccgacgcagtggcgtacgtcaagaacctgcagtcgcacgccaggaagctcaaggaggacgtggcgacgctcgaggcgcggccg

SEQ ID NO: 104346 - DNA, 233 bp, Triticum aestivum
  Clone ID: PAT_TA_104346
tagcagctctccccatctgcttggcacgcaccacactgattctttgactgaactctggctatattccatgtaagcccgtggaggagcttgagctcaggccggctccggtcctcccacctacgaaagcaatgcaagaaggacctccatggcagcctctgatttgcatggtgtggcatgctatatatatgtgggagatgttgtggcgggtaaaggcgttacttggcctcacataa

SEQ ID NO: 104347 - DNA, 197 bp, Triticum aestivum
  Clone ID: PAT_TA_104347
tttctagctagggttttagacagcgcgggtcggagagaggcgatgggtgcggcggtcgacgagacggcggcggcggccgcggcggctgtggcggcggagggcggccccgctgccgccgcggcggaggccgactccaaggacctgcagcagcagagcaaggccctcgacaagctcaccgaccacttcgaggatcgcca

SEQ ID NO: 104348 - DNA, 482 bp, Triticum aestivum
  Clone ID: PAT_TA_104348
actctcaccacacataaacatctcagccagctagcgctcgggacaatcccaaacgtcggcggacatggaggccgctatcggtgcggcgaactggcttgtcggcaaggtgctgactaagctctctgatgagttggtggccgcgtacgtggccagctctgagctcggcctcaactccgagcagatcaaaaccaagctcaagtacatgcaagggttgctgcacgcagcgcaggacacggatgtgagcagcaaccctggcttgcagagcttgctggaggacctgagcaagaaggccgatgaggctgaagacgccctggacgagctccactacttcatgatccacgaccagttggacggcacccaagaagccgcccctgagctgggtgatggtcttcgtggtcatgctctccatggtcgccatgctgctcgccataccatcggtaactggcttccatgcttttcttgctcgcgtactcaagccgaag

SEQ ID NO: 104349 - DNA, 597 bp, Triticum aestivum
  Clone ID: PAT_TA_104349
tcttccttttaaatgctacaaatgttctcaaactggatcaaaaaatctgagcccactatataatcaatgatgttttatgaaggccatcttagtccaaatgttaatgcattcattttaaatgctacaaatgttctcaaactggatcatatatgttttatgaaggccatcttagtccaaatgttgactcacgaattgcctatcaggagttcaagctatgctgaattgaaatgaaatttccagtgtatgttaaatggagagcatggcattttctatccagcatttaatcttttccccaaaattaaatgctaatatttgtgtgcttggcaacatgaatagaggccactcataccaagtgctcctcagatatatttaatgaacaatccgagtttgaggaggtgcaatccattgataacccaaactttgaactctctatttgaaacattaaaacttacctctaggccacaacccacaagtataaaatcttgagagtgcctaatgttacatcagcttttattatgttccagatacactattgtgcctgcttaatgatcagtgttaatgctctacggtttcttatgctttttcttgcatatgctc

SEQ ID NO: 104350 - DNA, 142 bp, Triticum aestivum
  Clone ID: PAT_TA_104350
cctcggcgcgatcctcgttgcatctttctacttgctgaacctcccttgccttcttgcctgctcaccatgagggtgagagtgcccatgcacttgagcacgggccaaaaccgggtctttctccacattgctacagatccacatg

SEQ ID NO: 104351 - DNA, 362 bp, Triticum aestivum
  Clone ID: PAT_TA_104351
ttgggaacgacggggctgtttggttgacaccctcaaattgataggtcaatccctcaaatttcgcctgacccatctcgcgagagggaggcgacggcggcgcgcgaggacctggggtgcactcgattgtgcttggtcatagcggtcgcgagaggaaggggcgatcgtgaggacctgggaggcggcggcgcaggcgcgaggagctggccgaagacgccggtgcgaggccccgggctttgtcatagtggtcactccccccacgacctcgccgacactggcgcgaggtcctgaaagcgaacccctggctgggcttggcgtagtggtcaaccaacggagcaagaactatcggacacttatagaatcca

SEQ ID NO: 104352 - DNA, 417 bp, Triticum aestivum
  Clone ID: PAT_TA_104352
ttgttaatcgttctctgcaactatctacagtttagtgcagtgcagtgcagtgcagtgcagtttaacagcaacctgccaccaggcagtctttgccagacctgtctggagttgggcacctggtaaggccggccaacctggatcagctaagacaaacattgtttcgagtttcgaccaggtcaggccaggccttgcttgctagcaggcttataatgttgcacttactctcaccttgatctggcacagggactaagcatatatgggattgcttttgtattttcttcaaaaaataaaaatgatgtgagggcatgcaagtagcataccaagtggtcaactgctaacttatccagctatatcaaacttatcccttactctgtgctaattatgggggatgagcacaatgaacagagcccatgggaa

SEQ ID NO: 104353 - DNA, 608 bp, Triticum aestivum
  Clone ID: PAT_TA_104353
ttaactacatttcatttatatgcatgcttatctttatagtactaggtattgttgtatactactacactctttaaaaaaatcgaatcaacgtattccttgttgatttttccttcatatttcaggtaccacatacaacatttctcctgactcatgcttgcttcctattttatcacatggcatcaaatataacacttcgcaaattacgccactctacagctaatttgtcgatgtctcttcaatggttgtttgaagttgcgtggattttagcactcgcatacttcatagcatacttggagaccttagccatttcaaattttccatattatgaattcatcgatcgggatataatgtacacagtaggctcattgttttatgccttatacttccttgtcagcttcccaatgttctcaaggattgatgaaaaagcagagaagtggagtctgtcgagggtagccattgatgccctgggtgcagcaatgcttgtcacaataatacttgacttgtggcgcatatttctagggccaatagtgcccatccctgagtcaagacagtgtgcccaaccacgtcttgcatggttccaggtgcacacatagcgcatctaatcctct

SEQ ID NO: 104354 - DNA, 408 bp, Triticum aestivum
  Clone ID: PAT_TA_104354
aaatatcgaggatcgaatcctgcttggaatcacttcatgcaaggtgttttcatgttttgcaatcataccttcacaatatatgtaataggtaatatgtggtcaaaagggtgttcgcaaggtgtatggtgttttcatgttggaggtgatttttttaccaataattgagcagcggctgtgatctgaggaatataacagttgtccagcgagggaaaaaaatcttagtgggtgaaagctgaagtgtttaacaaattgacaggaggttcatgtgaattctgtaggcactggtatatacaatggtttagctagataatttataatgttggtaaaatttgtctgtttattcttttgatctgaatggcatggaaaatattgattcgtttcattttgtcagttttttatgtggtgctc

SEQ ID NO: 104355 - DNA, 576 bp, Triticum aestivum
  Clone ID: PAT_TA_104355
ggcggccagctcccaggtaagtgcatgcttcgctaaattgtgagcttcaaaatttgagctccttcgttcatgaactatattacaaaaagtaaaggaaagagaatggcttataatctcttgaactatagccccataactcgacaagtttttcttttgaatatcatcaatcaccaccttgcagtccgatgccacatgaattctttgggcatagagatcatcggctagatccatagcttctctaattgccaaagcttcaagcgttgttgggtccgcaatatatctgaagacaatggcagaagcgcccatatagccaccttgttggtccctgcagataactccaatcgtcccaaaaccacggcgtgacaccgccgcatcaacgttcagctttgcacatccggcctatggtggaatccagcgggccatgtgctgcgatatggcactgctagttcgtgcggctggagctctttctttgatcacctgtaactctgataaataagagttgataaaaccttgtaatgtatgtggtgactgaaatatatcttcatgaatggccaaaaaaaaaaaaaaaaaaaactc

SEQ ID NO: 104356 - DNA, 548 bp, Triticum aestivum
  Clone ID: PAT_TA_104356
atataattggttgtgaagttataagcttggaaagctattacaagcctgagcaagtgagggattataaatatgatgagtatagctcattggatattgctttgctgactaagaatattaaggagattagaaatactcataaagcaaaagtcccttgctttgactttgagaagttcaaaagaaatggattcaaggagttccaagtgtccgaggaatgtggagtggtaatctttgaaggtgtctatactttgcatcctgccataaggaaatcactggatttgtggattgcagttgttgggggagttcattctcatcttattgcaagaatacagagagacaagaatcgtgctggcttttctatttcccagaatgaaattatgaccactgtgtttccgctgtttcagcaatacatagaaccacatcttgtcgatgctcatcttaagattcaaaatgattttgatcctgtgctttctcctgaaagctcgccttttgtattaaaaagcacaaaacaggtatcctaccaagacatactaaaagtgcttgatggtagt

SEQ ID NO: 104357 - DNA, 583 bp, Triticum aestivum
  Clone ID: PAT_TA_104357
ggccgcactgaggatgctttccgcgagtctgtcgcttctctcaagcgcaacaagctcggtctcaagggtatcctccacacccccatcagccgatccggccaccagagtttcaacgtcgccatgcgacaggagcttgacatctatgcttccatcagcttgatcaagaacatccccggctacgagacccgccacaaggacgtcgacctgtgcatcatccgagagaacaccgagggtgagtactctggtctcgagcaccagagcgtcgagggtgtcgtcgagtccctcaagatcatcacccgcgccaagtctgagcgtatcgccaagttcgccttctctttcgccctcgccaacggtcgatccaaggttacttgcatccacaaggccaacatcatgaagcttgccgatggtcttttccgcagcaccttccaccaggtcgccaaggactaccccactctcgagaccaacgacatgattgtcgacaacgcctccatgcaggctgtctctcgtcctcagcagtttgacgttatggtcatgcctaacctttacggtggtattctgtccaacatcggtgccgctctcgttg

SEQ ID NO: 104358 - DNA, 304 bp, Triticum aestivum; identical to SEQ ID NO: 104259
  Clone ID: PAT_TA_104358

SEQ ID NO: 104359 - DNA, 544 bp, Triticum aestivum
  Clone ID: PAT_TA_104359
taggctcaatcccattaagccatgtcccaaataacgcgttaacagaattcggtggatcgatattaaaagtaatgtggaccgtctgccaaagtactttggccaacgggcaatcaaagaagaggtgtttgattttctcatcccgatcacagaaactacacctagtaggtcctgtccaattacgctttatcaagttgtcctttgttaaaataacttgtttatggacaaaccacataaacacttttattttcaaaggaactttgaccgcccaaacatgcttagaggtaggaatggagttcgaattaataacatcaatatacattgatttaacagtgaatactccaaacttagtcaatttccagcgtaattcatcgggttgttgagatagttggacctccatcagtctcctaactaaacggagccagtcttcccaacgattgcccgctagcgtccgtcgaaactgaatattaagggggatagattgaaataccgaagcaacgaacacttcacgtcgttgaacaatacggtataaagatggatattggat

SEQ ID NO: 104360 - DNA, 528 bp, Triticum aestivum
  Clone ID: PAT_TA_104360
agcctcttcgagacctcccatgcacgccagcgctggcgacggtgaggacctcgcactctgttccccggggccgtccactatgcaccattagttcgaccaaggagcgacagaggcagaggcgcagggcgaccagcgccccatgcaggcactagatgcggcgctcctccatctctcctccttctgcgtctattgcaggagacgaacatacgttgctggtcgccggcttggcctgcaagaggatgctctcctgctctaacttgctcacatgttagtgtttcatcaatgaagatgtatattcaagcctatgtcttcataaacagcaactcgtcctcccttccccttgggacctgctggttgtggagaagtctgagattctgactcgggcagtgattctgaaagcgaatcagagaaggttggtagtgcagcaaggcttgcgaaggtaactgacgatagtttactgtcgagtgagtcctttatattctggcggagttactgaggaaggaggtaaatgaagcgccaactattacc

SEQ ID NO: 104361 - DNA, 462 bp, Triticum aestivum
  Clone ID: PAT_TA_104361
cagcacagctagcacaccaccagcagcatgatatatatgggagcaaaagctggatagatatgtagatacgtggatcaagcaaagcatcttagtttagcttaacccagcacccacgcagcacaaaaaagcagcaccactggtagatcgattgctcgatcagctcgatcaatcgaggtgtcttgagttccggctcccatggcgaactaccggctcggcggcggtggcaacgggcactacgagatggcggcagcagcggctgcggcatggagggagccggagagcccgcagctgagcctcatgagtgggtgcagctccctcttctccatctccggcctgcgggacgacgacaccgacctccacctcctcgccggcgcgcgctcgctgccgtccacgccggtctcgtttggcgggtttcctggcggctatgaggtcgacatggagctgcggcagggcggtggcagc

SEQ ID NO: 104362 - DNA, 252 bp, Triticum aestivum
  Clone ID: PAT_TA_104362
ggaatggctgcatgcaagtctgatcgatcggtgaaccaccgaataaacctgaagtgcaatccaattaattacacttatcccaaagcgtggcgatctttacatgtcgaacgacactggcgtacaagatcatatactatcttgacgggacacaaaatctagcctgaccgaaggttctcaccgggccgatgacactgcgagaatatcttcttttttcacgagaaactgtcaatatatttattatcaatcccaaca

SEQ ID NO: 104363 - DNA, 533 bp, Triticum aestivum
  Clone ID: PAT_TA_104363
atttatgcttcacacacagggtctactatctctaggaagcgtgtgcgcacccgcaaacagtttatctatcctgtcttgagacccattgagaacaagcttcagcaaatggaaccgccagaagattcttcaccaatgctgccctccagttctccaaaacgtacaaatttgggagcagatcatatcaagaaactgcagcagacctcttcaaattcagtcactaaggtgggattctcaaaatcagtgccattcagttttcccagtgagaatgcttcataccaagaaaaaggatcacccccttcggaggagtcgaagtgccaaaccagaagcccaaatctgttggatggtggagctctatcaaaatcaaattcagatgaaaagcgtgctgcaatgagtctgactcactggctaaaaccttcatccacagacaatgagaatcaaggtgttgtcacttcatctgcttccgaccaaccgcgtgatgagaacacgcttttcacggagagccccgtcttcacggcagcttctgggatggacgc

SEQ ID NO: 104364 - DNA, 480 bp, Triticum aestivum
  Clone ID: PAT_TA_104364
ttccttttccacagttttttagcttacccttcccacagtttgaagatacggatgtgctcagatttgtttacttccctttacttcccttcatcacaacgtgtggaccttttgcttcctaaccgttttcttttgcttttgctttgtctaattattacacaaatcttttttaggggtagtctaattacacaatttagagatagtgatgtggacctgaattatttctccctgagttcagatgcaccagtgtgaacaatgaaattcaaaaatattaaaaattcttaatttgtttggcaataatcatggctgagttttctatctacgtatgaattttcatgaaaatgaatgaaatttatgttgagctataagaaagttgaactattaagagaatgttaaaaaactatatctacgatcatacacccacatccaaacttgagagaaaacccagagagagagacataagtaaaaaggcgcaaagttaac

SEQ ID NO: 104365 - DNA, 314 bp, Triticum aestivum
  Clone ID: PAT_TA_104365
gacgagcaagcgcgccaagctggagagcgggcatagctcgccgtccgacgacctcatgacccacatgctcgccgaggggctagccgacgaggagatcatcgacaacgtcatgttcatgatggtagcggcgcacgacaccaccgctaccctgctcaccttcctcctccgacacctgggcggcaacagggacgcctacggcagagtcgtggcagagcaacaagaggtcgcgaggagcaaggctccggaggaagctctgtcatgggacgaccttggcaagatgaagtacacatggtcggcggcgatggacaccctgc

SEQ ID NO: 104366 - DNA, 320 bp, Triticum aestivum
  Clone ID: PAT_TA_104366
tacgggccgctggtgtctttgccgagcgggctatcttcgttcagtgtgacacagtcgacgtcgacaagcggctacggcacacacacgtctacttcatccgacgttagcacgatcggttcaaaggattcgtcttccttactcaaacatcagtactcataatttagtatattttattgtacatagttttttgtagtcgatgattcatgattgaatcattgaaagggacagcacagcacatgtgccgttgaattttcttccctcaagatgaccttttctttaacgtaatccgattcgcttagttaaaaaaaaaaaaaaaaaaa

SEQ ID NO: 104367 - DNA, 520 bp, Triticum aestivum
  Clone ID: PAT_TA_104367
tgcccctgctctgttcttcgacttgaccctctaagattgggcgcaaggaggcgaatcaatggcgccgacgctccgccccgggagcctctctggcggacggccatagatcacgagccgctgcagtcgatccattcttagcgagccctgagatcgacggaggggggcggcggccgatttatcgcggcagccaagcatacaggaatttgtacatgtcccaggcgagacgacacaatccaatgaacatatgggactagtaacgcctccggccacattgaggggcgcaaatacctgtgcctacggcccagatgtcaacccagatgtacctgccgatgattctggaagcgttatagtcgtgcctggctggaagaaaagattatcccatgctgcaacaggcgagtgtttggtgcatgtattgagcatctgcagtccattgccgccagagagaataagcccatgtgtaagacaatctttgtaaccagagaactactggagtacgaagtcaagcttgatcatggagcta

SEQ ID NO: 104368 - DNA, 199 bp, Triticum aestivum
  Clone ID: PAT_TA_104368
cggcatcacatcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggagatcctcaccgagatacaggagtttctggagaagggggagatgggtaagggaggtggtggt

SEQ ID NO: 104369 - DNA, 215 bp, Triticum aestivum
  Clone ID: PAT_TA_104369
gctgctgctggtgcttctttggcggaaagcggtggcgaccacgtccgagcagatcttgcacaagacgaagcagctgtaatgcgtgcatgatgtatcgcatcaccgtgattgatatgttttctatttaaccgccattctttttatactatttgttgcacggagcttcgtgtatacaatggtccttggtaatttcatcgaaaaaaaaaaaaaaaaaa

SEQ ID NO: 104370 - DNA, 304 bp, Triticum aestivum; identical to SEQ ID NO: 104259
  Clone ID: PAT_TA_104370

SEQ ID NO: 104371 - DNA, 550 bp, Triticum aestivum
  Clone ID: PAT_TA_104371
tgcaagcgtcggggttctccggggcggcaccatggttgttctcgcatgctcctggaagaaaacgagaaggatgagagggagaaaaaaacaaggtagaaggagagaaacgaggggaggtacggcagggtgagcatggcagaggccgagaacccaagctgctccctccagcgcgccccctccatggctcgtcgtcgccgagtggccagatccaactacaggcgagccctccggacagcacctctcctccctctcgagcagatgttgcagaacgacatcaacctccttagcccgctggctgagctacacgaagaaagagcagggataaacaccatttgttgatatgtatgcttctgctgggtacatgtgaataaagagacaaggaatggaagctgtagcggtagtcggacggtggccacgcattggcaatcactgtttatatacgtgactccagccacctatggtgagcagactttgatcttgatatgttagtccaagtggataaacattattaggtgtttaatgtgatgtgacttcattggttggacgtcta

SEQ ID NO: 104372 - DNA, 517 bp, Triticum aestivum
  unsure (1)..(517): unsure at all n locations
  Clone ID: PAT_TA_104372
cctcatgtatagacaaggcaaggcacgagtttagttcgcacaccgaggtactccattgctagctcggaaagctaatttgtgatgggccgccacagcagcagcagcggcaagaccgaggccggcggcgagcagtaccgcaaggaggagaagcatcacaagcacatggagaagctggccaagctcggtgccgtcgccgccggagcatacgctaggcacgagaagcacgaggcgaggaaggacccggagcatgcgaggtcgcacaagatgaaggagaagatcgccgccactgtcgccgccggcagcgcaggattcgccatccacgagcaccacaagaagaaagaggccaagaagcacgctcgtcatgcccaccaccacagatacaatcatggatgcatatgcacatgtagaccctagctagttatcttatatgtacggccggttatattcattcatttcgctgtattgctgtttggtatgtttattanttttgattcaaaaaaaaaaaaaaaaaaaaaaa

SEQ ID NO: 104373 - DNA, 417 bp, Triticum aestivum
  Clone ID: PAT_TA_104373
ttttttttttttttttttggctctggttatgaaactgtcaacatgttgctctgatctgatgccatttcgacatgtagccaagaggggaaacatatctgaacaagattcatccagaagatttcctttctcttggccgaatgaatactctgtttgattttggttcttcttggcatctctgaagaagcagagcacgcaaggggacgaactaacatcctaatctaatcatcatcatcatctactaggtccccaaaaagttaagctgttgtttgaggcggcagcggcagcggcagcgggcggatctatgtccatgggaaagaacaccgaagaaaaaagaattggaaaatcctgctctacttaagaattaatcctcctcctccgtcgaggcttccggtggctgatcaccggatgcggttgcag

SEQ ID NO: 104374 - DNA, 388 bp, Triticum aestivum
  Clone ID: PAT_TA_104374
gaagcagctggtgctgtccctgtcggcggagacgttggccttcgccgggagatggagacgctgctgagggcctgcacggcgctgtccaatgagaacggcagactagagacaaggtttgagcattcttcctcctcgaacaagcggaagatggtagggtccgaagaggcggagcggcgacaaaggaagccgcagcaagccggtggcggctttgcgctccccgacctcaactttccggcgcaggatgtcgccgacgcaccagcagcggctccctcacggccaacctgacaagtttattaaccgtgtatagggaagaaagctggaggagcgatctcttaccgtgcctggcgtgctaccagggaacgagaggagcccgccggtctcattacct

SEQ ID NO: 104375 - DNA, 462 bp, Triticum aestivum
  Clone ID: PAT_TA_104375
tttaaaatctcactaagcaagcaagcctagtagtcctcttttttttttcatcagcacgacccatgattacaacaatgaacacaaaataaatatcacattagtaggatcagtaggcaatacactttgaaatccttgttttcaaataatcctaagtaaagtggcaggaccaatagaaacaacagcacggtcttttgcccgtataggccggcaacaaagacaccactccacagaaagttttcgccatgcttggtggggtgggaattcttgacaccgctccactcggagtcgcgtgaatccttgaccgatttttggctatatgcaacttaatcacatatattttaggaagttcaattaataaaattatacatttaccaacttaatatatcttacaagaaatggagcaatgcgggtgacaatcttcatgcaagaggtagcccgtcctccgataaccttattcaagct

SEQ ID NO: 104376 - DNA, 577 bp, Triticum aestivum
  Clone ID: PAT_TA_104376
aacttcacagtcagatatgcttatagaatgattgtcaaaacaaaactgagcagggagaattggctggaggaaggtgaaggcacgtttgatggggctgaggagaataggggctggacttccctttggaatatatgggcgccatcgaaactaaaggtctttttatggcggttggcacggcactcaattccgacggcacaactcctccaccatcggaatgtgtctacgatgtgtgtatgttccttatggggagcgaaggatacatggtgacacgcgttgcttgactgctctatggcaagaagtgtatgggctctcccaacggaggaaatggttgagcacatgtgctataactaaaacttaaatgccaagaattggatctgttgtctttgggaagattctggaattctctcttactaccttctacagtctaaaagtatgagtatatacacaagggtgggcctttgggctaaacccatgcacacactacacacactcaacccaacactccccctcaagatgggtgatagatatttatcattcccatcttgttacaagctaaattacattccttaactcctaa

SEQ ID NO: 104377 - DNA, 502 bp, Triticum aestivum
  Clone ID: PAT_TA_104377
aaggtccagttggtcggaccttccgacggatctcctcctcagaatcctccaacgcctccagctccaggaatcccttgcttttgcgttagtatgcacatcatggagctgggctgcagctgctgctggcgtcccatgttcttgcagaccgtggctcatgtcttggacccacctcgttgaggagagtcaacccaagatcaactggagctcaactgtgacctgcaagttccgccatctggtggacgtcaacaagtcttatgatgttgattttcccaagggttgttttgttgcatgtgctggagcttctcatggatggctggttctggtaaatgaactctccaatctccttctcttcaacccctttacctcggacatggtctctttaccaccaattaccgatttctcatttgtggaggcaatatatgataatcaagggacacatagaagtttatcgtttttttaacgatggattctatgatgcaaaatatctggcaacatggttctt

SEQ ID NO: 104378 - DNA, 680 bp, Triticum aestivum
  Clone ID: PAT_TA_104378
ctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggagaaggacggcatcgactatgcggccgtcaccgtgcagctccccggaagcgagcgcgtgcccttcctcttcaccgtcaagcagctcgtcgccaccggcaagcc

SEQ ID NO: 104379 - DNA, 383 bp, Triticum aestivum
  unsure (1)..(383): unsure at all n locations
  Clone ID: PAT_TA_104379
cggagtgggtctgggacgggacggacccgcaggacgccgcggagatggaggagttcgaaagggtgacgcgcgccgccgggctgctcgacgagaacccgggcggttcattataggttcgagagggagtgggaacgtaggaggatganatctaccgccaggtgctcgccatcggctcgttcgggaggttggataatgatggggatggacgtagggaattcggccgtcaaactgcactgcacacctatcttggcgacgttgatgatataccgggcagaaaagctactctcttagatgctggttccatcctcaccttgccaatgctctttcttcatggtgtcatactgtttcctggagctaccttgcctctgaaactaattgaggct

SEQ ID NO: 104380 - DNA, 469 bp, Triticum aestivum
  Clone ID: PAT_TA_104380
tgcagcccacgccgccgttgcggctgcccagcctcctccgtcctaccttgctgccgttagctctgccctaccccatcccgccctctatcaaggatctccaccgattcaagcgggtctctcagatccaaaacaaaattcgtgtgagagatttggggctgattgatcaatccttggttgggatctaggcacgtctatggggaagatagtggtggttgtgtgcgtcgcggtgggacgacaatgtttacgctggtgccagcggtggaaggggtggagcttgtgggctccatggaggctaacttgaagacgaaggtggcggcggtgattaaggaggtggcccgcacgctccttgagctcgattaattcgatgtgtgagtcccatgtgttcatcatcaaactcatcctcccaaagtacaattagtacaagtttatcacttttttctttaccactgaactttatttttctacatac

SEQ ID NO: 104381 - DNA, 535 bp, Triticum aestivum
  Clone ID: PAT_TA_104381
ttgttcatggccaggaaggaactcgagatgtgcattgttcccgatgccctcggggattgatccgtcgaggtggttagctgccagggacaaggtggtcatccaggagaggttcccgagtgacgacgggatggtcctcctggtgaggctgttgttgtagagctgtataacacgcagcgacggcatgtcgccgatctcagaagggcaaggtacctgaggcggcggaggaagccaatgctgggaggtatctcaccgtacaaggaattttccaagggaaagtgatgctcagtgctcatcccctttgaatcagccagagtgtgagcctgaaggcgcggcaagaatctgagccaaggagggatgatgatgcttcaccaattaaagtgggctgcaaatgcaacagaagtactccctcgtcccataatgtaagacttatattatgggacggagggagtagctctgagtgctgtcatatatcacctttttcccttttcttgattatgcatgaaactcatttttcttgagttttttcttctagtgt

SEQ ID NO: 104382 - DNA, 492 bp, Triticum aestivum
  Clone ID: PAT_TA_104382
aacacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaaaggcatcccatacctcaacacctatgatggccgcaccatccgctacccagacccactcatc

SEQ ID NO: 104383 - DNA, 552 bp, Triticum aestivum
  Clone ID: PAT_TA_104383
acccggccgtcgacgccgtctacctgccgctccccaccagcctccacgtgcagtgggccaccgccgccgccgcgcggggcaagcacgtgctcctcgagaagcccaccgcgctctgcgccgccgacctcgacgccatcctcgccgcctgcgacgccagcggcgtccagttcatggactccaccatgtggatgcaccacccccgcaccgccaagatgcgcgacctcctccccgccgacgtcggcgacgtcagagttataaacagtctgttcagcttccgagcaaacgaagatttcctccagaatgacatcagggtgaagccagacctcgacgcgctgggcgtactcggcgatgccgggtggtactgcatccgcgcgatcctgtgggccgtcaactacgagctcccgaagaacgtgatcgcgctccccgaccctgtcaagaaccaagccggcgtgctcatcgcctgcggcgcgacgctctactgggccgacggaaagacggccaccttccactgctcgttcctcgccaacctcaccatggacctgaccgtcgtcg

SEQ ID NO: 104384 - DNA, 456 bp, Triticum aestivum
  Clone ID: PAT_TA_104384
gttgcaacgcaattcaggctcagcactgggcttacaatttctcagtgtacctcccaatcccatgaggcatgaaggctcgttctgaattccactctagtagaaattaagatcagtgtatccatacgggttgatgtcggctcgtgccgaattcggcacgagacttttctcaccttcgaagaagaagcagcagcatccatggcccccaaggctgctgagaagaagccagtggagaagacccccgcgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacatcggcatctcctccaaggccatgtccatcatgaactccttcatcaacgacatctttgagaagctcgccggtgag

SEQ ID NO: 104385 - DNA, 164 bp, Triticum aestivum
  Clone ID: PAT_TA_104385
ccccgcgcgcgcccctcccagatccagctccgagcgcttggatttctgaagaggtcctgccggcggcgtggttcggtgggaagctcgtcggctgctgcttcttgcttcccgcgctctgtagccaaggcggccggcggagatggggctggcgggggagaagttcc

SEQ ID NO: 104386 - DNA, 420 bp, Triticum aestivum
  Clone ID: PAT_TA_104386
tttttttttttttttttttttttttttttttttttttttgccaaaggtggggagttccgggactaccatttttcatgcagggaattgggcactacccaagtacaagtgggtgggcatacaaaccattaagttttcatttcaaaacccaagtaaacaaaaaaaaaactcagggttcaacgcctgaccatttgccaactttgttcaccctgaccaggggaaaacatttcatgtttaaaaaacaaaccactttaacgcatttggcatatcatacatattctggcatcttcattcactttgaaccgcagtaaaaacaaaacaaaacattcctcccccaaattcctccagctcaaactccaaaaaagggacatgctcacattttactcgggagctactgaaacaaaacaacctcaaacttttgac

SEQ ID NO: 104387 - DNA, 674 bp, Triticum aestivum
  Clone ID: PAT_TA_104387
gacatctttcttggagctctgcctgaaggtctggtaatgcgggaaaatgcattgagctggatcctacttatctggtgggttatacatgttgaaggttcaagccctgatgcagaattatgaaagtgctatggcaacatacatagagggtttgaagtgtgatccaaacagtaccattgtaattgatggctttaagaggtagcatcccagtcttctgtttgccttcttgacgttataatgaactaacatttgttttcattgggctagatgtgtgacatgcattgagaggtctaaaggcggtgacgttggaaggatttagaagacattttggttagtctagtttatttctatgcgacaaagcttccatcattatttgtttctgtttaatttttccacacgcatttcttgcatgtgtgatttactgtgactctggtaatccttgtgcagcagggaacaaataaactgtaccttgactggcaaggtgcctacatatggttaagtaccacatagaaatcttaaaacagccaggacatcagaggcaaaacaggttgaacgacagaaggaaactgaggaacatctttccaaaatacaacaagagttgcaacaagttaaagcaacagaaaatgtggtcgctgatgagagcataatgagcatgttcaacatgagttcttggagtc

SEQ ID NO: 104388 - DNA, 293 bp, Triticum aestivum
  Clone ID: PAT_TA_104388
actgtcggaactccaaagaaatcataaaatgcctgaaacacggattcagcttttcagagtgcaactcattcagcactgctaagtgccttgtctgaaaacatgaatttcatggaagtaccgaaggctgatgaatgccaaactccttcagggtctcatcagagctcctatctaccagatgctacaagctcttctaggaatgggtgcgatgcatcaaagcagcatgatactgaacctgtgagcaagagcatagactctgacgctgtgaataatgagcctgtggtcaactgtgggat

SEQ ID NO: 104389 - DNA, 157 bp, Triticum aestivum
  Clone ID: PAT_TA_104389
gcggcggccgcgggtgcgtactggccggccggccggctgcccacggtcccatcgcctcgtcggacgaacagcgcatctgcctcctcgcccggcggccgcgttcccggcgggataacgatgcagggcggaggcgtctccggattccataacgcgccgg

SEQ ID NO: 104390 - DNA, 214 bp, Triticum aestivum
  Clone ID: PAT_TA_104390
gcggcaaggaggatccggcttgcgtacgctgttgagagggcatcggcgtctcagcctgtattagcttgtcactcggaaagcgaagaaggtgagggcgaatcagcaggctgtagcacagagagttcatccagcaaccatgaggaggattatgtcgatgatgccgttttccggcgggggctggagatctgatgcataacatggctcctgctcaagc

SEQ ID NO: 104391 - DNA, 114 bp, Triticum aestivum
  Clone ID: PAT_TA_104391
gcagttgtaccgcatagtagtgtgacacgttgggtatttgtaaggaatgccacattttttgtacacacccaacacacagcataacttgtttgcatgaacttttttatctccaaa

SEQ ID NO: 104392 - DNA, 116 bp, Triticum aestivum
  Clone ID: PAT_TA_104392
gcatggtataacatcaaaagttgtatgattctactatttctcccttataaatcaataggttagtacaaaatctaggagtgagttcctattagcctaccattattcttctgtttcat

SEQ ID NO: 104393 - DNA, 311 bp, Triticum aestivum
  Clone ID: PAT_TA_104393
ttgaatgtctcatgatggtgaaacacaaaaatatagtacggtttctgggatactgtgctgacagacaagggagtatggaaaggtgcaatgaaaaattcatcatggctgacgtacaccaaaggttgctctgcttcgagtatcttcctcatgggagccgttatgagtacatcactgatacaactcacagacttcagtggagagaccgttttcaaattatcacaggaatttgtcaggggttacaccatcttcatcagaataatattgtccacttagatttaaagcccgcaaatatattattggatgctaatatg

SEQ ID NO: 104394 - DNA, 376 bp, Triticum aestivum
  unsure (1)..(376): unsure at all n locations
  Clone ID: PAT_TA_104394
tgtgcctccagcaacctgttatgaggtgtagagcctgatgctggctcaccttacagtgcgacactgtctcctaattcacatgatagtgtcagttgaggaagatgatgatgtgctttggtctccgctggtctttctagttgcttaattattcctatgcccttaatttgtcgatgttattgtgaaagtggctggctggccagttggaatataaaaatgaccattccctgctctgtttatttatcacatgtattatgaatgagcactttaattgtgtgtgtgtgtgtgtgtgtgtgtgntgtgtgtacaatttgatgttgcatttaatacagatggcaccttttatgcgtgcactctagcaaaaaaaaaaaaaaaaaaa

SEQ ID NO: 104395 - DNA, 519 bp, Triticum aestivum
  Clone ID: PAT_TA_104395
cgatgagaaaccaaaggtaaagaaggtggaggccgaggtgttccccgacgccaaggacgccgagctcctcaatcagacggcgacggagccgggctcgtggcgcacccaggccgcggagtccaacacggagaccaacgagcgaacgaacgcgtcttcgagtgtcccggcggcgagccacagctggaagctctgcgacgtcgacgccggagccgactacatcccgtgcctcgacaacgtggaggccatcaggaagctccggagcgacaagcactacgagcaccgggagcggcattgccccgaggaggccccgacctgcctcgtcccgctgccgccgggctaccggagtcccataaggtggccggagagcagagaccagatatggtatagcaatgttcctcataccaagctggtggagtacaaggggcaccagaactgggtgaatgtctccggggagcacctggtctttccgggaggcggaactcagttcaagcgtggtgctcttcattacattgatttcat

SEQ ID NO: 104396 - DNA, 490 bp, Triticum aestivum
  Clone ID: PAT_TA_104396
gcattttgtgcacctcagttgaacgcctgccggcctttcccctcgtctcccattcaacgctcggcctccatctcaccagctcccaaacctcgcgtgcaccactccatgtccggatcagcagcagcaagcggaggagacctcggcggcggccagatctacggcgaccacgtcttcttccagagtcaatcagcatgcggcggtggcgacggtgggtggtgtcatcccgtcgacctactccagcatcaccgactacctgcacgggctcctcgaccccgcggagctcgccaagcacctggacgtacctccgtgctacccgacgatgagagacgcgatcggcgcggtagcgactccggtcacgcccaactcgtcgacgtccggcgaggcggcgggggccgagtcccacgggtgcaagagaggcagtccatcgccggaggagggagacgaggatagatcggccgatcatggcagctgcaggagcgagaagaagaag

SEQ ID NO: 104397 - DNA, 482 bp, Triticum aestivum
  Clone ID: PAT_TA_104397
cacatctagtgctccctccgccgctagggattctcgctgtctgtatgcagatatcacaccgcatcaccgtcgccaggacgcccgcctgcgcgctccacttacacctggtggtgtgttgattccgctgcggcacatccatatggtgtacaggagtagctcgagttggatctcttccaaattgcagatctcggagtactcgaaggcctctctgggcgttggtacacgggccgggcgccgttctgtcgctggccactcagaatcgtagatcgtcgatgaaggtctaacctatgttgcctctgcacgccattgctcagctcctcggacaccgtcggcgtcaacgagcggcgaggagtcggtcttgatcagcgaagacgacttccccgggactccatcttcgtggctggcacaacagttaatcaggtgggcatcgccgcgcttactttcacaagtgagatacgaatacaattgttggttgtttggat

SEQ ID NO: 104398 - DNA, 577 bp, Triticum aestivum
  Clone ID: PAT_TA_104398
tttttttttttttttttttcttcgaatttactgcattcatagtggcgactcacggtctcacccagtttggctgataactgcaaagacaataaaaaccatgtagtagtaagatttttcccaccttacagcggccaggcgtcgacctcatttggcattccgatcatgcgttatcgtcaggttgccactacatgtcgtcgtttgcaacttacaaggaactacggctaaagaagaaaaactagtcttcggtggcgtagtactgcggggcgagctcggccagccacagcgggtcgatgcgggtgaggttcttgacgtagttctgtgtcgtccggaccagctcgttgaagacgacgcagtccggcttggtccggaacagcaccgacgaagggtgcatctgcacgctctgccccgtcgccagcgccctgaatgatccatctggctgtcgcatcgccgcgttcaggaagaaggcggcagtgaggcacctccgaaactggaccatgtcgtctcccacgatgacaggttaagccccatttgttggacatggccctggatttggctgtgaacatcacgagcatgtctt

SEQ ID NO: 104399 - DNA, 628 bp, Triticum aestivum
  Clone ID: PAT_TA_104399
acttgcatgttcaagtttgtttaagatcattgtggagtcacatttgaagggcacaaaccttttcatttgaagttgccctcgaagacattgataattatgcttatagagtacttcatctgttgttctcatgtcatgctgcatactgactgcgcttcttctcttttacatagctgctgctgattctgcatttgaggataatgatgatgctgaatacttccatgtttccgtttcaaagtgtgatgagcaattggccttgtatgctctgattgcacgagcagctgatgacaccatcatacccttgagcaattgttttctgagcgatttgcacggctaagtcagattcctgaagctttagaggacggaaaccaatgtagttgaagtagctcaacatcctgggacacagtgtttttgaacttgagcacacgtgtgctctatatctgggcggttcagtagcgtctagggattcaatgcattaaaaaagtgggccgacttcacgagcggctgaaaatatggaaaagagggaatacacatgaactgtggccaacgacagagacggaggaacggcgggcgtggacggcagcaagctgagccgtggttcaactcgtcagcgttcttgctgacccatgta

SEQ ID NO: 104400 - DNA, 539 bp, Triticum aestivum
  Clone ID: PAT_TA_104400
aggacatttggactatcaatgggtgtgaacggttatactatatcaaaacatgttatcaacatgatgggcaaagctatcatttcagaacagcgtgatgcacatttcttgaagcatgtgttgcattccgagcttggaaaaatgcttcaaggcccctccccatgccgagaaagcatttcaaactacctatctgagcccaaccagggattcaaactcgaaaacatggatgcagttcttgtaccattgctaaattccaagacttggtacctacttgtagcaaatttttggaagagacggttcgaggtattgagcccaatggggtgcactgacgaattgataacacaagcacagtctattgtatgcaacttccgggaagattttcatagtgcatatcctcagctccatagcgtaaaaatcaaagacatggacattaccttccataccatatcaaactcagacaacgaatccgacagtggtatatttatcatgaaggcattagatttatatgatggagaagaacatatcttctttaacgattctga

SEQ ID NO: 104401 - DNA, 584 bp, Triticum aestivum
  Clone ID: PAT_TA_104401
tgagcgatcctagcatggggaaggggccgggtgaggcctcgcgcacctgccggcggccggcaggtcgacttgttgcgccaccgcgtcgtcacctcctctgcaccatgagaggcgccacctctgcctccacacccccccactgggcaaggagctcgaggtgaacaggcggtgtgggaaggcgagaggaaccaggagctcatccctcctcccatggctgccccgtggatctggaggtgcctgttgcaggcggctcgagcgatgcaagccggcggcgaactaggtccatggacattgtcataatggtcaccttatcgcagtgtattatttttggatctcatattcctcaaggcgctccatcctctgattcgatgtctgacgatctgagaaataagaggaggaataatccagcagaagaatttggtgaagaagaacaagaaaagaatacctttatcctgataggcatggaaacaccggttcgcattgagtgcatcatcgctaatcagctactatgtatggtcagcggacatgcttgcttattcctgtaacatatcattactctatctgcttagcctttctaactttta

SEQ ID NO: 104402 - DNA, 625 bp, Triticum aestivum
  Clone ID: PAT_TA_104402
ctacccccgcgccgcccgacgcccacacgcacgccagaccagatcggatctggacggggccgccgccaccaagtgcgcaccaccgccgccatacgcacaccgcccccgccagattcacgggaattcatttcagaagaaactttcacttatgtttggaatgcgttcagagagcgggcctaagggctcaggtgatggtggaccaactcaaagggcatcagcactggccgcactttcatccgcttttaatccatcttcccaggataaacagtctactgataggcctcaaagctctggtgatggtggacctactcagcgtgcttcggcattggctgcattatcatctgcactcaatacgtcagggaaacccaaaagcccacaatcacaatctcgtgcaggtcaagggtctcagagagcagctgctgtttcagcactgtctaatgttttagctgccgaaagtccccgcattgatgcagagggtgaagcagcggggtcctcagaatttgagatggtggatgaggggggagcgaactgagcctgacgtatcacgggaagagactgccaacgaaaatggtggtgaaacagtcttcagctatgaccgtctgatatcaaagtctactgaccctgt

SEQ ID NO: 104403 - DNA, 584 bp, Triticum aestivum
  Clone ID: PAT_TA_104403
aaaaaaaagttggatcggtcgatcgatgcggcgcggcgatggcgaagacgacgccaggcaccaccgccggattccccgcgccgacgagatcgatgctgccaggttccccatgacaatctgttacagcgacgacgacgaggagatcgatctgaagtcgccgtcggagatcgtagccctccacgccgcgtgccgcgaccgcatcaccgagtacgaccccaagaagagagcccgcgtcctcacccgcttctgcggcgtcaacctcgccggcttcgacctcgacagagagtccaaggttggcctcgggccactgcttgaggatgtaacgccgcagctgtggaagttccgggcggagacgtcgtacaatgtcgtttccgtcaagataatcgaatccgatctgggttacccgatcagtgtgttcggtaccgttctcgcgagagataccatcgactacagatgcgtctatttgttcagacgcgagcgagacgatcctcagatcatcagctccaaggaggatatgttagcattggtaggtccacgtcgaggattagtagcatttgatcatatacattttgagttcaacctga

SEQ ID NO: 104404 - DNA, 585 bp, Triticum aestivum
  Clone ID: PAT_TA_104404
aaaattgcccctgccgaacgaaacgttcgtgaggggtccagaccgaacattcgggagatatcggcgtcctatttgttttgtcgctgcgactgggcctgtgtgttctggtcccgcctgtaagttcaaagggtagaagtgggtcggttcatttgaaacttacagcgcctcggtgcctgggtttgtcagggatgcactgtgatcacattcgttgaaccgtcgtggtgggtgggtgcgcagccctcgcagttttctccccccgcacccctctccttgccgatctcgccagtcgcttgtcctcaaccccaccttcagcttgcctctcgaccttcctcgttgctcacttcgcctggctccgccttcccatccccacggtggagtgcgaggacgagatgacgaccgggtcatccgtcagcctcgccgccggggagcagtcggcccgcggtcgcgcggtgctctccggcccgccgaacacggtcctggcatcgtccgcgtcggcgatgggcccgtcgatgtcggccccctcggcgctacgaggggcaagggcagccacggctcgcacgagatgcagctcctgctcgtggagtt

SEQ ID NO: 104405 - DNA, 534 bp, Triticum aestivum
  Clone ID: PAT_TA_104405
ctcttgccgccacgccggccggccggccgccgccgccgccacccatgctgcgcgtcgtctccaccctccgtccgctcctccggagccccctcctccggagccccctcctcccgggccctaaacccctcccccgcccccgccggccgccgcggccgttccgcgccctctcgtccgcagcgccgctcgcagcctccccgcccagcgcgcccgcgcccgcgcccggggaggttgagatcagcgaggagcacctcatccggtgcgcggcagcgaggagggcgccgctgcgggtggcggtgctggtgagcggcggggtcgacagcagcgtcgcgctccgcctcctccacgcagccgggcacagctgcaccgccttctacctcaagatttggttccaggaagatttcaggaacttctggtccgagtgcccgtgggacgacgatttgaagtatgcacacgccgtgtgtgacaagattgacgtaccattagaggtggggcatctatctgatgagtactggaaccatgtggtgtctcacatga

SEQ ID NO: 104406 - DNA, 610 bp, Triticum aestivum
  Clone ID: PAT_TA_104406
caaaaccatctatttactgggttgatgctcaagatattgcgcatgaccatgatattgaatcagaagattggcatatcgcaattgaagcactttgtgaggttcttccatctctagagccagtcattgtctactttccagacagttcccagtggttatctagagcagttccaaaatcaaatcgaggggagtttatccaaaaggtagacaaaatgtttgaccaactcaccggaccagtagtaatgatatgtgggcagaacatgccggcagcagtatccaaggacaaggataaggaacctccgacactgatgtttcagaatctcactcgcctgtcttcactgccatcgtccctgaagcgttggctaaaagtacaaaacgattcaagacccagtgatatatcaaagatcttcacaaacagtttcattgttccccttccagaggaaggtgagcaactaagagttttcaataaccagattgaagaggataggaaaattattatttcaaggcataacctcgttgaattacacaaggttcttgaagagaatgaactatcatgcgtggagcttatgcatgtgaagtctgatggtgtcgttttgacaagcaaaagcggcga

SEQ ID NO: 104407 - DNA, 530 bp, Triticum aestivum
  Clone ID: PAT_TA_104407
cacacatggcggcgacctcgccagcgccgatgagggccgtcgccgccgcgtttaccccgcctccgttatctcagaggatcacccgtatctctaccgtgtctgccgtccaccttcaccaatgccgcgcagctcaccggtggcgccctgcacagtgccgcgggaagccggccgtcagtggcgtggccgaggacgacgaggaggacacttcgcgggaggctttaaatcttgaggaaaaagaggaggagtccgcgggcgcggggagctgggggctggggtggttcaggcttgatgaggttgggatggacatcctgggcatcgccgtgcccgccgtgcttgcactcgccgccgaccccgtcacggcgctcgttgacaccgccttcgtcggacatatcggctcggttgaacttgctgccgttggtgtatccatatctgttttcaacctggtgtccaagctgtttaatgtgccactgcttaatgtcaccacatcctttgttgctgagcagcaagcagtggatgccaagtatagtggc

SEQ ID NO: 104408 - DNA, 597 bp, Triticum aestivum
  Clone ID: PAT_TA_104408
taattgcctaccattttgaagaaactgcttttgctcgactgatactatttttgcttatttaaccattcaagagaaaacagaactgaccagcctatgtgcgcccttttgtttgactagtagcatatttcgttcgtataaaggaaaacgtgtcttgacctatgatcatggatacccattcaggaagtattgcagtcgacctgtcaatgtcatgaatatagtttagctctatgatgcatggtttgattcatcaacgatattattatgaaaatacaagttctcgaaacttgtggtactgatacacttgtttgaataggaaatgttagtctgattgacagctactgatgtagatgtagagttctggttttcttatcgtatacttgacttaacaatgccgtattgacaaagtaaagctgtgggaactggagaaatgataaggcaaggattgatgtggatttgattgataatattttcctacacaggggttaggtggtaacatttaagcggcttaaaatgctttaagaaaactttgaattgatcggccaactgcaatgactttcgctctaatattccatctattgacccaagtgttgtatttgt

SEQ ID NO: 104409 - DNA, 625 bp, Triticum aestivum
  Clone ID: PAT_TA_104409
agtttacttgatgcatgcgcgtggtgagcatgatcacattgcaggaattctcaagtacgacttgggctctaattgcttatcgctgattgacatgcccctgccgggggctgtcaatgtcggcgacgtcatcctcatggccatggaggatggcagcttggggcttgcacatgccagtggatcaaccctctacctgtggtcaagctcaagccagatgggtgttgcgacatggactcagcgtagagccatcgatctcaaaagccttcttcccattcaaaatcccatggaaggacttagactgattggatccatggaaggcagtgatatcatcttcgtgcttacggaccttggcatctaccagattaatcttaactcactacagtggaacaagatatggaagagacagaaattctttgctttgattccgtacatgagtttccacaatccacaagaaaggatgaccccctgaaatgtgaagcactgacaacatatgtttgaacgtgcttaagggcaggaggccacgatcatcaataggaaagatgactacttggagtggaggcgacatgggtcttgtgattaatcgtgtcagtagtcagtagctgtttagtgcactggtgcttgaattctc

SEQ ID NO: 104410 - DNA, 567 bp, Triticum aestivum
  Clone ID: PAT_TA_104410
actatttcccttctatctactttacaaactttaacttctctgttcccttgtttgatggtttgaaatttcttcccagtccctctaattccgatctacgtatcaaagtttgaagcttagttgatactacttcatatagattaggttgtgattatctacatttctttgttgaattttctttgtacatacatggttagttatataccaaactatttacataagacggccttgcctgatttattttgaaaattttagttgatataatcttagtttaaaactgcgacacttattatggatcggagggagttcttcattctcgatagaacggacatactcgctccgtcccatagtaacatcttattttttacatattgactgtaataatatttttatattatggacggagggggagtagaaattaagtgaggcgccccacatttcatttccttttcgatccgaacctagccgattctacggtcaagctgcagtggagaacaggccgacgatggccacacgctgtccggccgggccgatcgaagttgctgtagcaatgtgttgctgtcatgcacg

SEQ ID NO: 104411 - DNA, 504 bp, Triticum aestivum
  Clone ID: PAT_TA_104411
cgaacaggaaagcagaaaaggataaaaattgcgagatggaaggaagggaaacgagatttcgtacgctcaggaggcacgtgtcgagctttgtcttggagaagtttagactttggaactcgccaactgtagatccctgacagccatttgcgtctacattattgtccatgtgtcagcctacgtggcagggcagtcttacaatcatcctccaacttggcaaaaacaacaaactagctgatgcttcgtcatctcaactattgtttatcaagccccctcttattttgggctaaaatttgaccaacaaatttaactaataaaatgtaaaccagatgtcacaaaaattatactttggccaagctctttcaaatacaaatcccagagtgtactttttgtagcatatattcttatttttattagccaaatgaatggtcaaagtttgtcttaaaatactagatggcctgataaacccggacggaggtagtatatgataccattgaattactgact

SEQ ID NO: 104412 - DNA, 444 bp, Triticum aestivum
  Clone ID: PAT_TA_104412
tcaaggccgaagagactcgcccgcaacctgaagctgtggtggaatccatgcccgtgacggatggtgatcatggtgccagtgtcttgcggttcggtttgccggagctggaggcggccacatgccgtttcggcgagtctgccaggatcggcattgccggcattggccgcgccggcgtgtacagagggagcctgcgcggcgtgagcgtcgccgtcagggtcatctcccccgatgccgccgtcggcgaggcacggttcgctcgcgaggccgacgccatcggcaggttaagccacccgagcctcgtcgcgctcgttggcacgtgcccggaggcgcgcgccgtggtgcacgagctcgtgccggccgggagcctggaggaccgcctcgaccaaggaggcgaggggacgctgccgccgctgccgtggatggcgcggtgccgcgtggcacacc

SEQ ID NO: 104413 - DNA, 250 bp, Triticum aestivum
  Clone ID: PAT_TA_104413
tgggctatccgccctgtgtgtcaactctgttgatgttacaagccaataggcataagtagtaagatacaaaaaatgttgtgtgcgtttgcaagaagctattgtaaagtgtagcagttttttgtgtttcaaatgcaacaaataaacagtactccctccgtttcaaaataagtgttgtagttttagttcaaggagtgagtgtgatggactaatattttcttacataaaaaaaaaaaaaaaaaaaaaaaaaaaa

SEQ ID NO: 104414 - DNA, 497 bp, Triticum aestivum
  Clone ID: PAT_TA_104414
aagcaacttcctagccatacatacaagtcaagccatggagtgtggtcactgcggcgagggcctgtccatcccgcgaggagcacgcgctgtgcaatgcgcgcattgccgcggggtgacgcgcgtcgggcggcggcacggcttcgtcggcttcgtcgtgaacatgatcaccaacatggcgggcggcggccgcacgaggccggcaacgccgccgaggctgcgggaggcggtctaccccagagtccaaggcgacaagcgcgccctcctggtcggcatcagctacgcgggcacgcatctccctgagctgagcggccccgtcaccgacgtcaagagcatgagcttcctgctcacccagaagtacgggtttccaagccagtgcatcctcgtcctcaccgatgaggagcgcgacccgtacaggacgccgaccaagtccaacatcctgctggcgatgcggtggctcgtgcacggctgcagctccggcgactccctcgtgttccact

SEQ ID NO: 104415 - DNA, 550 bp, Triticum aestivum
  Clone ID: PAT_TA_104415
ctcggacaatcccccatccaattcgcccaaatccgcatcaggctgctctgagagagagagagagagagagagagagagagagagggatgggcagggcaagaaggggaacggcggccaagggcaagaggaggccgcgtgctgcggcgaaggcggcagccgtggcgggcgacggacacgaggaaaccaaagatggacctgagaaagccgccggcggcgggggtggcttcttctgctgctacctcctccggtcgctctgcccgcgcagcaagagccgcacctacatcgggttcacggtgaacccgcggcggcggatccggcagcacaacggcgagctccgatgcggcgcctggcggaccaagcgcggccgcccctgggagatgatgctctgcatctacggcttccccaccaacgtcgccgccctccagttcgagtgggcgtggcagcaccctaccgagtcgctggccgttcgcaaggccgccgccgaattcaagtcgctcggcggcatcggcaacaaggtcaagctcgcctacaccatgctcaacctcccttc

SEQ ID NO: 104416 - DNA, 456 bp, Triticum aestivum
  Clone ID: PAT_TA_104416
cccaatgcaaaagacaaacgaatcgcctgttgctctgtgtctgtgagctcgcagtacatatatttttgggttgcttcatccaatcccagctctgccccagaacgcacccacactccactgaccactactctggagaatcagggggagtgagaaaccatgaagcctctcgccgctctgctcgtctccagcctccacatccattgcctttgcctactactccggggagcacatgccacggcgccggcgccgggagcccaccacaagtacaacgcgacggtgtacaacgcctcggcagcgcggtgcgcggactgcgacggcgggggagacggcgccgcggccggcgcggcgctcggcggcctcggcgcgtgggcggaggcggcggagttcctctactaccacaacgcggtgcggatggcgcggtgggagctgccgctggcgtggtcgccgcggctggag

SEQ ID NO: 104417 - DNA, 356 bp, Triticum aestivum
  Clone ID: PAT_TA_104417
tcgtcgtcaacctcgccgagcttgatccggggagaccaggcccccggcccgccgtagtgctggacgctgtggctgtctcctcccactggtcggagacgcggggcctgtcacgcgcttacccggggatgtcaccggtcggcacgacctgtactgcttcctgctggcctctcacggcctcctcctggtcacagctactccgcgactccaaattggcggcattgaaaaaaggtgactagccatagatgtggtctggtgtcccaagcttctgcctcgaggtcgcgatgcttcgccaagaatcatgacggtgctgccttgtgcccgccacgcgcagaactgggggtcgtgaggaggaagac

SEQ ID NO: 104418 - DNA, 439 bp, Triticum aestivum
  Clone ID: PAT_TA_104418
aatcgtcccaaccatcttggagacagccaggcaggtgttgcgagctgtgatgcctgaggcacctgccgagaaaatggtgttcgacatgatgatcaaggaagcgcagggtatgctcttctaattagtgaaacatctgaaaaggtgtctgaagaaaggcttatctcacttctgaagcaaatcaacacccacacaagcaaacaaaccaaagtggcggtagagtcactgcacataaggaaatttacttagcttccagtagtgggtttaggctaccttcattaaaacccgatatgatctgaggtgcaaattttcagagtaacatgctcatgtgtaacaccaaactgttgctgacatgctaagttcatgatggaggactggacaagactatgtcgattgaaaaaaaaaaaaaaaaaactcgagtttttttttttttttttttttt

SEQ ID NO: 104419 - DNA, 509 bp, Triticum aestivum
  Clone ID: PAT_TA_104419
acggtgggttaagccttgctttacaggaagatagtgcaaagaccgggaaagttacttctgctgggatgttctttcttggctttcccgtgtaccgttttgaacataataattcagctgctgctgcaaaagatcccgatagtgcattctttaagagattggatggttttcaaccatgcgaagttaatgaactgaaagaagggacccattattttgctgtttatggcgataatttcttcaaaagtgcaacctataccttagaggttgtatgtgctgaacccttttccaacgaaaaggagaagctacgaagcgtggaggcaaagatacttgcaaaacggtccgagctgtctaaatttgagtcggagtatagagaggttttagcaaagttcactgagatgaccagcagatatgctcaagagatgcaaacgattgatgagcttctcaacgaaaggaatgccattcatgcatcctacaccaacagcccaactctaaagcggagttccagtgacagc

SEQ ID NO: 104420 - DNA, 214 bp, Triticum aestivum
  Clone ID: PAT_TA_104420
gggaccttgccttcgggatcaagtacctcatgcgccgccagggcaatctacatgtaggcggtgtatatgctggaagcaattgcattgaacttaaaggacctgaattcatggaagagttgattgttctacgggggcgaattgatttatgctttcttttctctaagaaatcattcccagggttcctagaattggctggattttcacaagtggatgt

SEQ ID NO: 104421 - DNA, 489 bp, Triticum aestivum
  Clone ID: PAT_TA_104421
agcaggtgatctttagacaagtgaatgtctaactgccattgtcaagtgacagtgagaagaacaacgtttacagcctgtggagtatcttccaagttagatataccatcccgctaggtcaagatttactgaaatggattatacttagaggggggacgtcgccttacttttaacatttcaaacagtttcccttctctaggtgtgggtgtttctcaagctgtcgctcgagtttctcatcatgctctgcaattagattttctacctcttcatgatcattgtcttgacaagcgaagtccaagatgggtagattgtcgtacactcgcttggtatctggtacttaattacttgcttactcttattactcttatattaatttaaagagggagtacttggctgctgagctcacaatcagaagttcagaaccacaacttgatgagaacattctgagctaaccaaatatagtgcgcttctctttttattctacattctatg

SEQ ID NO: 104422 - DNA, 446 bp, Triticum aestivum
  Clone ID: PAT_TA_104422
ccgacgacggggatctccagaccgtcgggcgctacgacttcgacgggcagctcgagtgccccatgatcgcgcaccccaaactcgaccccgccaccggggagcttcacgcgcttagctacgacgtcatcaagaaggggtgggggaagtacttctatttcaaggcggacggcaccaagtcggccgaggtggagatcccgctggaccagcccaccatgatccacgacttcgccatcaccgagaattacgtggtcgtgcccgaccaccaggtggtgttcaagctgcaagagatgctccgcggcggctcgcccgtggtgctcgacaaggagaagacgtcccgcttcggcgtgctgcccaagtgcgcggcggactcgtcggagatggtgtgggtggacgtgccggactgcttctgctttcacctctggaacgcgtgggaggaggaggagacc

SEQ ID NO: 104423 - DNA, 500 bp, Triticum aestivum
  Clone ID: PAT_TA_104423
tcccgctcgccgatgaagagcctggcgaggcggccgcggcggccaccggatccgacggcatgcagctgccggaagggccggctccgggaggaaatggcgggatgggtgcggccgtcggcgtgcccggactgccagacccgtcgtcgatgccattctacaacttgccgccaaacctgcagatgcctaatggcggcgggcagatggcgcacgatgtgtttggctccttccggccgccaccgccggccttctagctctagctctagccagcgagcgaggtgtctccactctcgatccccctcttttgtttcttgttcctttctttctttctttccagcttcacaaatcagtgttgtttctgatctccttgttttgttttaggtgctcctatactgtttaattactagttagctttgattgtttgccagtgcgcttaattactcatcatggatcaaggagaaactgcaatttgatctcttgagtacaaaaaaaaaaaaaaaaaa

SEQ ID NO: 104424 - DNA, 509 bp, Triticum aestivum
  Clone ID: PAT_TA_104424
gaagcgccatgggtcaaggcacggaggtgaagacgagggaggaccccaaagtggagatccaggagaagggcgaggtgttcttcttctaccggcccaaggtggacaaggaggaggcgcacagccccgacgacgtgcagcggatgtacgtcgtgctgcgcccggagtccggccccggccgcgccgtcgaggagaagcaggcgccggactccggcaaggagggcaagaagaggaagacccgtcacggcggcgatgagaagggccaggcggacggcggcaacgaaggcggccacgggaaggaggaggttaacgtggaggagaagccgctgctccggctgatcgttatggggaagaagagcctgccggacccggcgaagcacggccggccgttctggggctacgtcgacctcgtcaccaccgacgtggaggacatcaaggacgcgctcaagggggcggagtacgacacggcgacgcgcggcaagcggcacctggccgcggcgagggcgatgggc

SEQ ID NO: 104425 - DNA, 445 bp, Triticum aestivum
  Clone ID: PAT_TA_104425
cggcacgagccgccaccggcccacctcgcccccgctttgccctgccctgctctgcgcgcaccaccaatcatcggcgcgcgcactagctcggcagccccccggcgccgcggctcctgccgtgctgtgctgacccgccgtcggtcctcggccatgaaccgcccgacgccggcgcaccagaggggcatgccgccgccgccgcagctggcgcggtacggctccgcgccgggctccttcctcgccgcgctggccgactccgtcgcgcgcggcgggggcggggggcgaagtgccctcccactcccagccccagctacagcaacatggactcccaatttggctcgtctctggacatgcctggcatggacgactacctgcagctgcagcacgactccgtcgcctgcagggtccgcgccaagcgcggctgcgccactcacccgcggagcatcgc

SEQ ID NO: 104426 - DNA, 447 bp, Triticum aestivum
  Clone ID: PAT_TA_104426
cgagctctggtctgccgccggctgttgcgtgcccccagccaccccaaccaccttctccacgtgccggcgctgccgcttgccgctagatgcagccagtcctggccatgccgccgcctcgcgtgtagtactccaacaccggccgacgcagccgcgctccaccaccaacccgcccgcgcgcaccattctttgacctcccccgcttctacaggcagtctgctgcgtgcggtgctcctccaggttcctccctggcttccccacttgcgtcgcaggccacaacccctcctccctcctgcatcctgccacgcgacagtctgcagcgggcttcctctccacgccattccgaccaccagatccacgcgagctcgccctttagccatggtttcgggcgttgactctcgccactgtgccttcccggccccatcgaagccaggtgccgctgccggggga

SEQ ID NO: 104427 - DNA, 573 bp, Triticum aestivum
  Clone ID: PAT_TA_104427
tatcttctgatgaaacgagaagcagagagaacgtgacgctcgttaagaccgtaccgggcgtggtcactcacgttatcatttaagaggaccgaggcgaggggagagacgatacagagacgtccgcccgccagcatcatggccatggccacctcctctcctacgctcggcgcactcctcctcctcgccctcttctcggcggccggtgtccacggcgccgcaccctcttcgccgctggaccagctctgcggcagcctgggcagcttctacgtcacgccggagctctgcgcgtccacgctctgcgtcgacgcttcctcctcctgccgctccgcgcgcggcgcgccggagctcgcggcgctcgcgaccaggctggcggcggccaacgccacggcggcgaaggccagcatcgagtccgcgctcgccctcgacgcggagcgcgtcccggcgccggcctcggcggcggacgccgacgccaggaagggcatgcggtcgtgcctgcagcctatgccggcgccgtcccggctctgcggtgggcggcgcggtccgtcgccgcggggcgatacagcggcgcgcggg

SEQ ID NO: 104428 - DNA, 532 bp, Triticum aestivum
  Clone ID: PAT_TA_104428
ttcttaagtctcgtaatattcctcacaatgtacttaatgcaagaccaaagtatgctgctagagaagctgagataattgcacaggctggaaggaaacatgcaattacaatttcaacgaacatggcaggcagagggacagacatcattttaggtggcaaccctaagatgcttgcaaaagaaattgtagaagacaatgtacttccatttctatcgcacgacaccccagatgtcgaaactgagggggagtccacatcccacaagggtctttccaagataaaactcgggccatcgtcactagctctgcttgccaaagctgcaatcatggcaaaatatgttcacaaaagtgagagcaatgaatggtcttttcagaaggcgaaatccgctgttatggagtcaattgaaatgagtaatacaattggcttggaaaaactacaagagcgtgtggctgaagtgactgagatgtaccctctttgtgatgcaatagcacttgcttatgccactgtcttaaaggattgcgaaattcattgttttga

SEQ ID NO: 104429 - DNA, 516 bp, Triticum aestivum
  Clone ID: PAT_TA_104429
ccgcagcgccgccactccacccgcagcggcaaccatggcggtcggcaagaacaagcgcatctccaagggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatc

SEQ ID NO: 104430 - DNA, 525 bp, Triticum aestivum
  Clone ID: PAT_TA_104430
cgacacgccgccgctcctacccgactcctctctcctcacctctcccccgccatccaaaccgcgatggcggcgccgcccgccctcctcaccgccgcccgcctcggccgtggcctcggcctcctagcctccgtacgctactacggcgctatccctgttccattttccgtctcctccccacggcgccggctcccggccccgccccctcgccacgtcagcagctctgtccgccgcctggccgccacggccgtctctgagccccagacggattcagagtctggtacagcgacagtaaggaaggggcgcatctaccatgaaacgtacgggtgccagatgaatgtaaacgatatggagattgtgctgtctatcatgaaaaaagaagggtacaatgacattgttcctgaccctgagagtgcagagataatatttatcaacacctgtgcgattcgtgacaatgcagagcagaaagtttggcagcggctcaactacttttggttcctgaaaaggcaatggaaagctaatgttgct

SEQ ID NO: 104431 - DNA, 583 bp, Triticum aestivum
  Clone ID: PAT_TA_104431
tgctccagtggttgatgcatttgagacattgcaaagtggtcatgttttttccgacctcaacttgaaaatgatgttacgtttgggcagacccaaatgtcccctaaggaggccgatgatgctgaaaactatttcaccaatacaattgatgatcctcaagatagtgagagaacatcaactgtagctttggaagatgaagatgatttaactcttcataaggcttacatgtctcctgaagatatcagtgaagtcgaaaattctttggctgatgattctgcttcagatcttcctcacatgccggagaaccattgcttcagcgaaaaagtatcacctgaatctcaggaccccttaagttctgaggtgattttggttcatccagtgggtttgaaaactgaaaatgatttagacgatgcaaagtcatccttgtattctacagaggccaacttggctgaaccttgtggcattgctcatgaaggaactcagcaacaagatgaaaccatgttgggttttgaggaagccaattctgaagatcactatgacaattcagggtccctagatattccagatgtcactgtggcggagagtc

SEQ ID NO: 104432 - DNA, 355 bp, Triticum aestivum
  Clone ID: PAT_TA_104432
cccacccagccagccgcgcgtgaagtcggcactccccacccctccctccgccccaaccccttcccctaggtaacgaaccctaacccgatcccgctagatttcgtcgcgatttggtgctcaatccgtagttctcgtggtgcgacgtgttctggtccgatttgcgtcctgttattcgttaatttccggggggtttcgtttaccgatacttctctagctcacgcggtgattgtgctgtcttgcgattttcgggatctgcgcgaggcgagcgcgctggccggatgtttttctgcgattttgcgcggttttcatccgcgggttcttctgtgcgaggcgatcgatccgtgttccgtttgga

SEQ ID NO: 104433 - DNA, 205 bp, Triticum aestivum
  unsure (1)..(205): unsure at all n locations
  Clone ID: PAT_TA_104433
gtgataatgatagggacagacctttttctggaagatcaggaggcaggtttgattcaaggaacagttctggcggccgtggacgtgggcgtggtcggggccgaggtaactttggcagtgatggtgatggtggcggtggtggaggacngacctaccgtgcccatggacgcatcaacccctacatgtccaacccatgccacattgagct

SEQ ID NO: 104434 - DNA, 310 bp, Triticum aestivum
  Clone ID: PAT_TA_104434
cagcgccgccgcagtttcacaaaaaaccggcggcagttccagttcctcagtccaccgcaagttgcacagccccaaatctcaatctttggcaaaaccctcgcctcccctcccccattctcccgtgagattcccctcatcagatcgagagctgcacctccacagtagcgttccgcattcggatcgagcagccggagggccaaccatggcggcgacgcaccacccggcctccccgaccggcgccggcaagtccccctcctcctccccctcgccgccgacgcctgtgcgcctggcggcggcgcaggcggcggcg

SEQ ID NO: 104435 - DNA, 537 bp, Triticum aestivum
  Clone ID: PAT_TA_104435
gagcccttctccaacctccgcgccgtcaatctctccggcaacttcatcgttcatatctcccccggatcgctgcccaagggcctgcactcgctggatctgtcgcggaacaagatcgcaaacgtcgaggggctccgggaactcacgaagctgcgcgtgctcaacctcagctacaaccggatttcgcgcatcggccacgggctgtcgaactgcacggcgatcagggagctgtacctggcggggaacaagatcggcgacgtggagggcctgcaccggctgctgaggctggcggtgctggacctgggcttcaacaggctcaccacggccaaggcgctgggccagctggtggccaactaccactccctcctggcgctcaacctggtgggcaaccccgtgcaggccaacgtcggcgatgacgcgctgcgcaaggccgtcaccgacctcctcccgcagctcgcctacctcaacaagcagcccctcaagccgcgggaggcggccaccgacagcgtcgcgcgcgcggcgctcggcacggctgggcgc

SEQ ID NO: 104436 - DNA, 192 bp, Triticum aestivum
  Clone ID: PAT_TA_104436
cttccactcatcccgccatgcttgcttcaagctcaaccccacgtccttcgcgctcgccgcagccgtcgccgtcatcctggcggtggcggcgccgcggccggcggccggggcgtcggcgcacctgcacgtgtacatgcacgacgtgatgggcgacagcgcgatgatggtggtgcgcggcccgcggggcaactt

SEQ ID NO: 104437 - DNA, 240 bp, Triticum aestivum
  Clone ID: PAT_TA_104437
cagcgatccattggtaaacaatccagcagcagctcttcgctcacctctccctactcctcgatctatctatctctaggtttcttgatccaccggtctagtctcaagtgtggccatggcgaaggtgcacccgaacttggccgtgccgtctctggggatggtggcggcggcggcccgcgacgatgagccggtgacactgacagtgtggcgcaagacactgctcttcaactgccgggggtgtca

SEQ ID NO: 104438 - DNA, 464 bp, Triticum aestivum
  Clone ID: PAT_TA_104438
gcccacaaaaccctacccgtcgtctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggctgagtcactccgctacaagctcctcggaggccttgccgtccgcagggcatgctatggtgttcttcgctttgttatggagagtggtgc

SEQ ID NO: 104439 - DNA, 465 bp, Triticum aestivum
  Clone ID: PAT_TA_104439
tgcccacaaaaccctagccgtcgtctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggctgagtcactccgctacaagctcctcggaggccttgccgtccgcagggcatgctatggtgttcttcgctttgttatggagagtggtgc

SEQ ID NO: 104440 - DNA, 181 bp, Triticum aestivum
  Clone ID: PAT_TA_104440
tggcggcgtcggcggcggcgggcgggcgatcggcggggcaggtccacggcgtctgtgcaccgggcaggcacacgggagctgccggagcagccgccgaccgataggccgaccgtctggtcaagctgttcttaggatgaggtcctccaagactaatgggagcgtgcagaatgcggggagagtt

SEQ ID NO: 104441 - DNA, 524 bp, Triticum aestivum
  Clone ID: PAT_TA_104441
gcaccagcagtccagcacacactgcacccactgacactgtgacaagccgacgcgcaccaaagctaagctaaagctggcggcggcgatggagatggtcctggactggcgctcggtgggctcgctgatcgcgacggtcatggtgttccggacggccatgcgggacttcatcccgccggaggccgagctgtggctgcgccgcctgctggcgcgcctcgccgccgcgttccgggcgcccacggccaccatcctcatcgacgaggccgacggcgccagctccggcgccaccaacgacctctacgacgccgcgcagctctacctcggctcgcgctgcctcgccgccgcccccgccgtgcgcctctacaagccgcgccagtcggagcgcgccgtcgcctcgctcccggactcgcacaccgcggacgacaccttccagggcgtccgcgtcaagtggaccaccgcagcctcgagctccagttcccgcgccagcaccgcgacttcgtgcacgacacctacatcccccacatcat

SEQ ID NO: 104442 - DNA, 301 bp, Triticum aestivum
  Clone ID: PAT_TA_104442
cccgccgtctccttcggccccgccctcgtcagctgggagtgggggtaccactgggtgtactgggtcggccccctcatctgcagcggactctccagcgtcatctacgcacctgctcttcatctcccgcacccacgaacagctccccaccaccgactactgagcagcgagctcagcgcagccaacctgcttgcttgcgtgcgagcccgccgcctgcctgcccgtccgtccgtgtgatctatgagcgcgtcatctccttccttgccatcaccatgaatcgattaagttagcttactgggtccat

SEQ ID NO: 104443 - DNA, 496 bp, Triticum aestivum
  unsure (1)..(496): unsure at all n locations
  Clone ID: PAT_TA_104443
cgccaccttccatccccatctccggcgaggtctcccgctcatccatccatccccgcctccggccggccggccagcgattctcatccgtccccatctcaatcgccatctgtggtgcccgatttgcggacaagcagtggcgagagggcagaggcaaggggaactgttctgttcgccgttgcaagagggacggggagccggccgggcggcgcancgacaccacgtccacgctcgtctccacgaggagactagttactgaagtccctctgttggatcaaagtctccctctgcagttagtctatcctgtggttactgagtaattggaaagctggatctagtggtgctctgctataaaatcgctaatgggttgccgagatactgcagcactaaatgaccttgagctcatgctactagatgaaacggctgacccaaaggccttaccactatcacttctgaaagacatcacaaacgatttctctaacgatcgacaaatcgggag

SEQ ID NO: 104444 - DNA, 480 bp, Triticum aestivum
  Clone ID: PAT_TA_104444
actatctcggttttttttttttttttttttttggacgcagaacaacagcttactaaaatttcctaaaacacaatcatagcattctaggaagaacaagaggggaaaagagagcatgctcttaagaatgctacttgcatacagattgactgtctttcctcaataagggtaagctcaggtgaagaagttggtgcatggaactcaacaaatgcagtccaaatgacaattcttcaacttagacagagtcaacaggtcttgtttctggcttttctccatctattataaccttggacttcaatgagagagaactctgcctagatgttgatggaatactcttaccaccggtgggtgactcttttagccctaggtaagtgtagactgacatgcctcctagtgcaatgacagctccataaagactggtgagtccaggatcagatttaaataccagaaacccagagagcattatgacaatagtcttgaatt

SEQ ID NO: 104445 - DNA, 466 bp, Triticum aestivum
  Clone ID: PAT_TA_104445
gagagagagagagagagagagagagagagagagagagagagcttatgtttcagttctcctccgcctccggtctcgagagctcgccagaatggtcgcccacaggttccaccagtccaggtggtgggtcgcgcgctgccgacccccggcgatgagcagcccaagatctaccgcatgaagctctgggccgccggcgaggtccgcgccaagtccaagttctggtacttcctcaggaagctcaagaaggtgaagaaggccaacggccatatgctcgccatcaacgagatctttgagaagaaccccaccaccatcaagaactacggcatctggctgcgctaccagagcaggaccggttaccacaacatgtacaaggagtaccgcgacacgaccctgaacggcggcgtggagcatatgtacacggatatggcgtcacggcaccgcgtgcgtgccccctgcatccagatcatca

SEQ ID NO: 104446 - DNA, 487 bp, Triticum aestivum
  Clone ID: PAT_TA_104446
tactgcgtgagggggagatggcggcgcacgtgctggccttcccgtggccgctgcaaggccacatcaaccccatgctccacctcgcctccgccctcctcgacgccggcctccgcgtcaccttcctccacacggagcacaacctccggcgcttcacccgagtgccgcctcatcacccgcgcctccgcctggtgtccatccccgacggcctccccgaccaccatccccgctccgtgggcggcctcatggagctcgtggagtccatgcgcacggcgggcagcgcagcgtaccgcgccctgctgctacggatggtggactcggacgacgacgacgcggtgacgtgcgtcatcgccgacggcgtgatgccgttcgccgtcagcgtcgccgaggagctcggcgtcccggcgctcgcgttccgcacggagagcgcgtgtggtttcctcgcgtacctgtccgtgcccaggctcctggagctcggcgagaagcccgt

SEQ ID NO: 104447 - DNA, 369 bp, Triticum aestivum
  Clone ID: PAT_TA_104447
gtctaagctccagctagcttgcaatggccgccgcactgagcctccgcgcgcccttctccctgcgcgccgtcgcgccaccggcgccccgcgtggccctcgcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctcgaccaggccgaggaggaggggatcgacctgccctactcttgccgcgccggctcctgctcctcctgcgccggcaagttggtgtccggcgagatcgaccagtccgaccagagcttcctcgacgacgaccagatgg

SEQ ID NO: 104448 - DNA, 580 bp, Triticum aestivum
  Clone ID: PAT_TA_104448
ttcccctaattgctttctaaacattcccaatgggaaagttgcatggccactcagttccaaaagaaaacatctgctggcaggccctgttttatgccatggccatcatttgcttgctctcctgacggagttaccctgaagcacacatggatggtaccacaagtcatttatgcgatgaagagtttatctggtaatctgaattctcttagagctttctcaagttattttccaaatctgcaactgaagtccagattcagtcaaacaaatgtccacctgaagcttccatggccatctgattcttgcaattgccgagcagtgcaagtgtgttccgaactgcctaaggtggaatattttgaacaccagtttatgggtgtttgcgagcatcacgtagcggtttgggactatgctgttctgggttgcattcctatttctgacaaattgcaggggataattcatcttatgcatatgtcagtgcgctggatttttttgagtcaagaagaatttaaaggcagtggtcgtgtttcaatcgactttcacactaacaatgcatgggaacggtgctccattttccttgggaattgca

SEQ ID NO: 104449 - DNA, 580 bp, Triticum aestivum
  Clone ID: PAT_TA_104449
cggcacgaggtcccatccacactccccgggcaccctacggagcagccgcgtccacatcgtcgccgacgccgttatccattcacccgcgcccaaggcggcatgctctcgccgtcccgcgctgctccgctcgccggactccgccgcccaccgacgcagccgccggcagggagaccgcggctgctgcttcttgggccggcaagctagccggcgccgtgccatggaaggcggccgtctccggcgcgctcgcgctcaccttgtccttctcctgttgtaagccatcagtctcactcttcatcttccttccgtcgaggcagttgctccttgctcgcagttagcaggcagcacggcaggctccggttaattggaggtctagaacagttccacgtttagtttttctgaccatgccctcatctataacaacgaaatgttgcgtgactcgttgctaaatcaacaaatttgtcatctgatttttattttttttggtgtgctgcatggtaacgctatgcgaatcaatgcaccatcaacacgagaccgaagctcgagtctgaacccgaaaggcgaagctcagtccagttcattc

SEQ ID NO: 104450 - DNA, 380 bp, Triticum aestivum
  Clone ID: PAT_TA_104450
ccatccccgcccgctcgccgccgatggcgaaaccccgccgcggccgctccggctcgcggtcctcgtcgggctcctcctcccgctccgcctcctcgggctcctcccgctcgcgctcgcgctcgcgctccctctcctcctcctcctcctcgcccgcccgctcccggggccgctcccctcccgccgccaagcgcagttcacctggagcaaagaaagggcgaggaccttcaccccctgtcaaaaaaggggcaccatcaagaaaaggccgctcatcatctcccccacccaagaaagcgtcacctcctaggaaagcatctcctcctcctcagtcgggtgttctacatgtggatcatctatccagaaatgtgaatgaggctcatttg

SEQ ID NO: 104451 - DNA, 394 bp, Triticum aestivum
  Clone ID: PAT_TA_104451
cggcacgaggcaacatgcagcacgtgacgtcgctctccttcctcatcctggcctactccaactacctgagccacgcgggcgcgcacgtctcctgcggcgccggcaggtccgcgccgccgacgaagctccggcaggtggctaagcggcaggtggactacatcctcggggacaacccgctgcgcatgtcctacatggtcggctacggcccgcggttcccgcgccggatccaccaccgcggcagctccatcccgtccgtggcggcgcacccggcgaggatcgggtgcaaggccggcgccgcctactacgccagcgcggcgcccaacccgaacctgctggtgggcgccgtcgtcggcgggcccagcgacgccaccgacgccttccccgacgcgcgcgc

SEQ ID NO: 104452 - DNA, 600 bp, Triticum aestivum
  Clone ID: PAT_TA_104452
tagcgtagccacagccagcaaatagtattaatcctagtggctaactaactagcaatagttagagattggccagttgaaggagtgatagtatatagggagggagctgcatggccatggacgcgatgagcagcgcggtgttgcagggggcgtggaggaaggggccatggacggcgctggaggaccggctgctgaccgagtacgtgcagcagcagggcgagggcagctggaactccgtcgccaagctcaccgggctgcggcggagcggcaagagctgccggctgcggtgggtgaactacctccggccggacctgaagcggggcaagatcaccgccgacgaggagaccgtcatcctccagctccacgccatgctcggcaacaggtggtcggcgatcgcgcggtgcctgccggggaggacggacaacgagatcaagaactactggcggacgcacttcaagaaggcgcggccgtccaggcgggccagggcgcagctgctgcaccagtaccagctccagcagcagcagcagcaccgccagtacctccacgcgctgcacctcctccagcagcagcagcaggagatgcagatgcagctgcagatggagc

SEQ ID NO: 104453 - DNA, 588 bp, Triticum aestivum
  Clone ID: PAT_TA_104453
aacacaaccacaccaatttcacgattaccattacaaagcaaataccacaattatcagaaagttttcgagacacttaacatctgatagttactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccccttcaagcttggcagtgaggttcttgatgtagcgcttcatgtgagagataaactgcttcttgtcaaaagcaggttgctcctgaagacggaaggtgtcaacaatgtcaaccaccttcacggcctggtcatcgacaccctcatcgtcaccaccaccctcagcagagggattggctccaatgtccacatcaactgctccttgaacgacccaatg

SEQ ID NO: 104454 - DNA, 622 bp, Triticum aestivum
  Clone ID: PAT_TA_104454
ttcggcacgaggttcatctcactgagctcgcaggcagccctagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccccctcggcgagggcctcgacatcatctacccgggcg

SEQ ID NO: 104455 - DNA, 529 bp, Triticum aestivum
  Clone ID: PAT_TA_104455
ggcgcgaggagggcaaaggacgagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctctttgcgggtggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgca

SEQ ID NO: 104456 - DNA, 641 bp, Triticum aestivum
  Clone ID: PAT_TA_104456
cggcacgagccgtcttctccttccctctggatctcgtcgccgacgctcctcctctcgatttgactccggttcttcaggtgctttccctctacccgccgtcgctgctctcccatcaggcgccgtcggcagtgtaggacgccgctcgcctcgggcgattcggcaggaggaggaggagggccagcgaatccaggctggcactctgctgcttgcgtcagccgctgacgacgacgcgaggagggagaccgtggatggagatcgcgcgggcgcggtccgccgccgccgtgggctgctccaaggagcaccagaggatctgcgtcgactggttcgccctcgccgacccaggtgtgcaggatctggagttgcggtgctcgcctcgcctcaagtgcgtgtgacgtcaccgggaagaccgtcagctgcagctcgcacaacgactctgcctcgaggcgttgccatctactggagaagcttcagaccgtcctcctagcttttgtgcatctctgggaagaagacaacccgagctgagtcgcctccgatctgcgaaaacatctgatgacatggacgtgatgggatatttaaacaagtcaattgccaagctacaaatggggctggcagtgtggcgcaacaagcctgagctttttgag

SEQ ID NO: 104457 - DNA, 295 bp, Triticum aestivum
  Clone ID: PAT_TA_104457
gccgccccgccggccgagttcggatcgaccgaatcaatcagccctgcaaatagcctgctctcttctcccccagattacaacgatcggcgacggaagattggaggaggccgccccaccggccgggctcggattcactgcatcaacccgccccgggagcacccgggtctctttccccccgattgcggcgggcggaccacgactatcggttcagtttaaatactcatgcataacctgggattgtagacgatatgctcactgactatagagatattcgaaccaaggcaaggcacaaaag

SEQ ID NO: 104458 - DNA, 479 bp, Triticum aestivum
  Clone ID: PAT_TA_104458
cggcacgagggagggcaccagcaccaccgtcttcgtcttctaccggcacgccgtcgccgccatcttcttggcgcctttcgccttcttcctcgagatcaggcaggggtcggcgccaccgctgacgttcagactctccgtcaagatctttgcccacgccttctatgggatggctggaacgataaacctgtatagcattggcctgaattatgcttcggcaacctcttcgtcggccatcttcaacatcgtccccgtggttgcattcatcctggccgtcatgttcaggatggagactctgaagttgaagagcgtccacggcatggccaaggcctcggggatacttctgtgcatcggaggcgtggtcgcgctggcgctgtaccaaggcccccagctcaagtccttgaaccaccacccgctcctgcacagcaccggcacggccgtgcacgcgcgcccggagaagaactgggcgctcggcatcttcc

SEQ ID NO: 104459 - DNA, 500 bp, Triticum aestivum
  Clone ID: PAT_TA_104459
catgttctgctacatttcggtgacggagatccatggttttgctggaactggcatttgtttttgctggaaccggctaaaattttgatccaactgactttttttggttttcttagttgctcagattgtttttttgctggaacatagtgctgcaaaattgacgatgacggtgagccggcggcggcgactccatgcttccatggggtgcgcgatctgctggaaccggctttggccgcaagctccagtaggctttcagtggagctgcatctcacagatcgatgggtggcgctgggaacgacggtgagattggaagggcatgtgacaatggcaacggcgagcggcggcgaggtgcagcgagctgtgtggacggacgtggaggacgatggggcggcgaccacgccgtgcgtggagcgagcgggaggctgtgcgcgtgtaaatcgctagttgttttaggatagaaaagaaggagtcaacggctgttagttgccagatcagacgtctgc

SEQ ID NO: 104460 - DNA, 508 bp, Triticum aestivum
  Clone ID: PAT_TA_104460
aggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaaaggcatcccctacctgaacacctatgatggccgcaccatccgctacccag

SEQ ID NO: 104461 - DNA, 279 bp, Triticum aestivum
  Clone ID: PAT_TA_104461
gccttgcttgcttggttgccattgccgtccgctcgcagcctcgcgttcttggatcaattccacgcgcagaccacgccacccgttggaaatccacgagctctctcgacgccgcgtccgggaagccagcaagccaatgccgctgctcgcgccgggcccgcgcgcgctctgccgggacctctaccgcgccgccgcggcgcgggagcaggcggtcccgtcctccgtgacggcctgctcgaccgtcggcggggcgcgggctgtggggctgcggcgaggcggcgt

SEQ ID NO: 104462 - DNA, 500 bp, Triticum aestivum
  Clone ID: PAT_TA_104462
gagggcaaggaccccaacaagcccaagaggcgccctccgccttcttcgtcttatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccatctccact

SEQ ID NO: 104463 - DNA, 375 bp, Triticum aestivum
  unsure (1)..(375): unsure at all n locations
  Clone ID: PAT_TA_104463
cccgtctggcagtcggagttatgtcgggcggcacacgagtgcagtgtgttggtcgggcgagcgtgacctcgaggagcaacacgttgcgacctccacgctgtagggcgggaatcgacacctctccgaccgcctccacgccgccgggctggtagaggaggacggggaccagctggccgccgtcaacgacgggaatatgcatggtgccgggcctgttgccatggtgaccctcctcgccgtcctgcactcgacgcccatcatggagatgtcgccatgacccttctcccttgtgattgaggcacaaagcanaggaagatggggaagaatacgacgtggtgcccatggccttcatcgaacccgacgacgaatcgtcactga

SEQ ID NO: 104464 - DNA, 574 bp, Triticum aestivum
  Clone ID: PAT_TA_104464
ttgctgacattgaaaacacattcattatgcaagacgaatggtgagaaatgtgttattccctatccttccattctatttgcatattcgcgcagtatgcttagttttttcccaagatgaatattctacacatgagagcaatatacttggtattattgatgctcatataattcctggacctggaattgttgatggcttgaggcttaaagtatgttatgtgttgcatacctaataaatattagcaagctaatgttgcagcttgacagatgctgtgataacttctcctttttctgtttttcaatatccacttcgaactgagcagccatgatccggatttcctctgtgtagctatgagatgcctgcagtttgttattgtgtatcgtgtactaaaacattgattatttgacaatgaacacatggaaatgccttaactattcaacttgcctagctcagtattttaaccaatagagaagttttttttgttgctttcccttttgttagatattttgctttttgtatgttgaggggagatggatatggcctcgggactaaacgcacagaccacatgaagtgatct

SEQ ID NO: 104465 - DNA, 464 bp, Triticum aestivum
  Clone ID: PAT_TA_104465
atcagacatgtcgctgtcagtgagcacacagctctccggtggcggcaggtgcgagtggggcagccggaacggcctctcgggcctcctagcgcagaagagcaatgccctccgccctgccttctggcacatgatccgcgagatactcaagttcaaggaggatgccctcaagtacctggaggaccatgagagcaaccctgacctgaaccggcacgagactctggggcagttcatccagacgcatggatactcccagctcttccaggaggcttacctgatcccaatctgtgcaagcatatggtcatgcccgtcgcagggggtgctcggcttctctgctttcttcgttctctccttctgccgcaaccatcacctccttcaaatcttcggtcggccccaatggctcaccgtcaaaggtcgctcgcatacatatgtaaacaaggtaagggaagaactggaaagcatgggtt

SEQ ID NO: 104466 - DNA, 162 bp, Triticum aestivum
  unsure (1)..(162): unsure at all n locations
  Clone ID: PAT_TA_104466
cggcagccgcggcggctccggcggcggcaactggagggagtgaatggtggggcccctanctggccagttatcctagttaccgatccctttttttacctgtctaccaaagtgttatcgctcgctcccgagtaccctagatctcgctccatcgcgtaggttccg

SEQ ID NO: 104467 - DNA, 184 bp, Triticum aestivum
  Clone ID: PAT_TA_104467
cctcaccactatcccccggtgccagtcgccgccatggggtcgggatcttgctgctgcatcggctgcggctgcggcagcgacgacgacggcggcggcggcgatggcggcgtggggctggaccccaaggggttcctgctggccatgctgatcgccctggtgctcgtcatgctctgccacatgccca

SEQ ID NO: 104468 - DNA, 611 bp, Triticum aestivum
  Clone ID: PAT_TA_104468
gctctctcgcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgc

SEQ ID NO: 104469 - DNA, 560 bp, Triticum aestivum
  Clone ID: PAT_TA_104469
accgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatgtctacgttgatggagtgctcatacgatactgagctactaaataataaaatgaagttgcttgcgtgtgtta

SEQ ID NO: 104470 - DNA, 569 bp, Triticum aestivum
  Clone ID: PAT_TA_104470
ccttctccccccttcgttttctctctctaggtttttgcggcgccgaatcccagctccggcgactggcggcgggcgacggcgagaagcgaaaaatgggggaggtgatggagatgacagaggtgctgcagtcggtgagcgacctccccgtacaggaccctcccggggaggagttctcggccgccgacctcatgtgggtcaagtacgcgagctccgagcaccactgcgacgacgttgcgctcatcccctacgaccggatggaggccttcatcagcggcgagtgcaacaaccccgagtaccccaccaggttccacatcgagcgcggccgcaagcgcgaaaggggcaccctcaaggaggtcaggagcgacgactatctcctctacagaatgtattggtgttcgtttggccctgaaaattatggggagggagggacgatcttgcctagcagaaggtacaggcttaacacaagaaatcgtgcagctcgtccgcagtcgatgcgaggttgcacctgccatttcgcaatcaagcggttatacgctcgcccttcgctggctctcattatctaccatgag

SEQ ID NO: 104471 - DNA, 643 bp, Triticum aestivum
  Clone ID: PAT_TA_104471
cggcagcagtactaacatttactactgcaagatctcgatttcaatatcgcgtggtgtgatgaggtacgcatggcatggtttgcaggattctagcttaaattcgtatgggattcgtggaggctttctgtgtttcaaaccataggatttttcaagaacttcacatgaaacatatacacgtcggaaaattcgtatgctccaaacaccaaggggcctcaatgatcatccatcagattttttctttttgcaagctttaggaccactcagatcgatctctcataccttgtacgaatttcctgctggaccagtaggccttttccatctcttatgggagaggccttctattcgtctctgtccgtccatttggttggattgaagtaacttgtggtgccttttcatcagtagggatggagcagaagctcctgttgctatgagccgagaaagcaatacatacctttgtagtacgtagtattgtttgcttgaaagttgaaactgagacgtcaatgtaccttatgttagaggttattttttttaacaaagaacacatctgagactcgtctcaaaagaagggaaaagtaaagtaaaaaagcttatctgaaactgaatctgcgcactgtgatgcaggcagcggcgggatactgaagct

SEQ ID NO: 104472 - DNA, 334 bp, Triticum aestivum
  Clone ID: PAT_TA_104472
ctctgcctcgcggtcgccgcggcctgcctggcgtacctctgctaccacccgcggccgccgtcgttccacctccagccggtctcgacgacgcggttccgcgtcggcaactcctccgcggtgtcggccgtggacgtcacggcggccgtgaaggtggtgtcctggaaccccaacgacaagatcgccttcgagtacggcgacggcgagggccgcgtctatctagccgacagtgacggcgacatcacgctggggtgggcgcccgtgggaggcttcgagcacggcgcccggagggtggcggtcgtcgggttcgtggcggccgcgaagggggtggtggtcg

SEQ ID NO: 104473 - DNA, 577 bp, Triticum aestivum
  Clone ID: PAT_TA_104473
gctctaccgcgcccgacaagccaagctggcatcccgagaagcacttgtcgcgaaggcgggagtggacattgagaagcgggcggaggagctccggggtctcagacaggaagccctccggtccctggcggaggagcgggagcaacttctcgaggagcgtaaagccttcctcctcgcgaaggctgaagttgaagagcaacaacgactcgctgccgagaagctgtctgcgcaggaaggtgagttggcgcagcggaaggtgaaccttgacagccacgaggaggagcttgccgcgcgcgagcaagcaattggcggggctctcaaggaggcaagagatgctgccgcagctgccgaggccgccaagaaggagctggagacgaaggtggcgtagctggaagctgatctcagggcgagcggcgaggagcttgccgcgctcaagcgtgagcgcgagaaggacgctgccgctcatggtgagctgcagggtcttctcgctgagaggagcaaggagctcagcgccgccaaggattccaatgcagatctcgagttgaagctggctactttgactcagacgctggacgacgcc

SEQ ID NO: 104474 - DNA, 521 bp, Triticum aestivum
  Clone ID: PAT_TA_104474
ctgcaactattaggcgttttgatttcaccgaaagaagataggcatcacatggataagaaatggtgggagaggcaggagcaaggagatcaagttgcttcagtacttgacattgggcaagttggaccaagggcaacttgtcgttgtcaggttattagaagtgttggtcaatggtcagctggaaccactcaaattgaaggaagtatccacaatgcctacttttctctaattgaaaaggcagaacactttgtatacattgagaatcagtttttcatatcaggcctttcaggggatgacacaattaaaaaccgtgtgttggaagcattgtacaggcgtatacttcgagcagagagagagaaaaagcgctttaaagccatcatcgttataccccttttaccgggttttcagggaggcattgatgatggtggagctgcatctgtgagggcaattatgcactggcagtaccggactatctgtagaggccctaattcgatactgcagaatctgtatgatgtgattggtct

SEQ ID NO: 104475 - DNA, 561 bp, Triticum aestivum
  Clone ID: PAT_TA_104475
tgctagctacacctctctccaccaagctaataagcctcgcagacaaagaaaaagaagccagctactagctagtcggtggcggagcgatggggcggtcgccgtgctgcgacggggaggccggcgtgaagaagggcccgtggacgcccgaggaggacaagctgctggtggactacatccaggagaagggccacggcagctggcgtcgcctgcccaagctcgccggcctcaaccgctgcggcaagagctgccgcctccgctggaccaactacctccgccccgacataaagcgcggccgcttcaccgacgacgaggagaagctcatcatccacctccactccctcctcggcaacaagtggtcgtcgattgctacgaagctgccggggaggacggacaacgagatcaagaactactggaacactcacctgcgcaagaagctgctcggcatgggcatcgaccccgtcacgcaccgcccccgcaccgacctcagcctgctcgccgggctcccgggcctcctcgccgccgccggtaacttcggcggcgccggctcggccacgggcgcct

SEQ ID NO: 104476 - DNA, 490 bp, Triticum aestivum
  unsure (1)..(490): unsure at all n locations
  Clone ID: PAT_TA_104476
cgcgccgccacacgaaccccccacccaacccgagcgagcaccggccgaggagggcgtcgccccggagaagaacggcgtcggctccggtggcgagaaggaggtcgcctcggaggggagcggcgccggcgccgaggtgggcgctgccgtcgagacgaacggcgtcgcagttgacgtctggatctgccaccagtgccgtcagagaaaaacagggctcacggcagcttgcagagggtccaagaagaatggcaagtgcactctcagatattgcaagaattgcatacgtaacaggtaccctttgattgcggatgaggtgttgaaggaggaagcctgngaatgccccaagtgcaggaatgactgcaactgcagcaagtgcaaaaagaggagaggggaggagccagcaggaccaatggtccattctgtcaagagaccgaagggcgacctgcggagaattgagagcaccgatgctctcaaggatgaaatagtcataccc

SEQ ID NO: 104477 - DNA, 501 bp, Triticum aestivum
  Clone ID: PAT_TA_104477
ctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgaactttacgccgagaaggtcgtcaaccgtggcctctgcgccatcgcccaggccgagtcactccgctacaagctcctcggtggccttgccgtccgcagggcatgctatggtgttcttcgctttgttatggagagtggtgctaagggttgtgaggtcattgtgagcggcaagct

SEQ ID NO: 104478 - DNA, 539 bp, Triticum aestivum
  Clone ID: PAT_TA_104478
ggcctcgcgggcatcgacgcgctcctctccgctcctggatgcgccaacatctccacgcgagcggatttcgatgcccgagtgcctgcctccgcccgcagggacatcaacgccagctgctaccgcgagctcggcgccgttccggtctgcaccacctgcacgacctcgctcagcaagacggccgcagcctacctcctacctggatcccccgacggcggaaacaatgtcaccggctgcgtccagtaccccttcatatacaccggcgccgcggccagcctacgcggccccgacgacccggacacagcggactgcctgtacctccttaaggccaactctcaaccctccaaagggtccggcgcccctgcctggctctacggcgtcgtcttcggatgtgtcgcctttgtactgctagttgctgccgctgctggttcgtgcttcttcgtgtggcgacgccggaggcgggctgccgctaccgcactagccgctgacagcaggagcaagcgctcgcatgcaatggagtccatcaccggcagcaccaccct

SEQ ID NO: 104479 - DNA, 413 bp, Triticum aestivum
  Clone ID: PAT_TA_104479
ccggcctcgccgtcgctatcgctacacttcgccggtgccggtgccgctaccgctgcgtcgtcctcccgccgcgccatggtcgctgtggcgtccgcggcgtccaggagctcgtcgtcgtcctcgttcgacgcgtccgccttcgaggccgagcggctccgcctcgacgccgacgcgcgggcctcgatggtgaccaccgccgcgggagcgcaggcggaggcggacccgagggcgtggaagtggaagatacgaaagcgggtgtgggacgtgctcgaggccgagggcgtcgcgcgcaacccccgccccgtccaccaccgcatccccaacttcgatggcgccgccgccgccgccgattcgttagggaggttggacgtgtttcagaatgcacaatgcgtgaaggtcaatccggattcgcc

SEQ ID NO: 104480 - DNA, 382 bp, Triticum aestivum
  Clone ID: PAT_TA_104480
gagccagtttcaactaaaattcatacctgtgaaataaaaataaaaattgatcgacaggctcttggtagatgattggatagacggggagtaattatctattgttttatcttcgtctcacaacttctcatggttgtatataccatatgatttgtcctcatcttacctgttcatatggttttatttggtcaatgttgactagttcctctcatttaatttacacttcccataaggatttttaaacacaatttcccgtttttccagcaatgaatctaaagcagagcaaattaatgattcctcaaagaggaagcaatatgtcgtcggtacaaaatttgcccctttgtattaattattaaccactgcgacgaataacaacctaataagt

SEQ ID NO: 104481 - DNA, 545 bp, Triticum aestivum
  Clone ID: PAT_TA_104481
gcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgacttgccta

SEQ ID NO: 104482 - DNA, 497 bp, Triticum aestivum
  Clone ID: PAT_TA_104482
cgagcgctcgcgccctcctcaacttcttccagtgaagggcgccgacgcctccgccgccgggaagcacgcctcggaggacggggccgtgtcggccgggcgcggggtcatctactacgaccccaagcccggggacctggtcgtgggcgtcgtcgtcgggggcgacgcgcgggcaatctacgtcgacgtcggcgccggaggcgagccggcgctgatgctgaccaaggaggcggcgcctgcgtcctcggaggagttcgcttacctggcgtgcgacgtcgcgtcgggcggcgcgagggagttcgccgcggaaggcagggtcggcgtcgcggccggcggagtgggcgcgagggttgggaggaccgggaaggagaaatgtgcgccggtggtgggcgttggcacggtggtgttcgccgaggtcctcggccgaacacttggtgggcggccgctgctgtcttcgcgaaggctgttccggcgcgtcgcgtggcacagagtgaggcaga

SEQ ID NO: 104483 - DNA, 519 bp, Triticum aestivum
  Clone ID: PAT_TA_104483
cctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaac

SEQ ID NO: 104484 - DNA, 536 bp, Triticum aestivum
  unsure (1)..(536): unsure at all n locations
  Clone ID: PAT_TA_104484
cgcgccaccgccgacatttctccgcggggaggaggcgtcgtcggggtcttcgtcggcgcgcgcgcggttcgagcgcctgatccggcgggtgcaggcggaggtgtgcgcggcgctcgaggcagtcgaggagggcagcggcggcggtggcgtggtgtttcgggaggacgcgtggacgcgcccgggcggaggcggcggtatcagccgcgtgctgcagggcggccacgtgttcgagaaggccgccgtgaacgtgtccgtcgtctacggagtcatgcccccagacgcgtaccgcgcggcgaggcccgacgcggcggcgggcgtggagaaggccgggcccgtgcccttcttcgctgccggcgttagctcggttatccacccaaacaatcccttcgcgccaacattgcatttcaactacagatatttcgagacagaggcaccgcaagatgctcctgnggcacccaggcagtggtggtttggaggtggtactgacttgacaccatcgtacatcatcgaagaggacatcaaacattttcattctg

SEQ ID NO: 104485 - DNA, 601 bp, Triticum aestivum
  Clone ID: PAT_TA_104485
tttgcttaatgatcgtcttcgtccttgaccttgatgctcagactcccgcttggagggagattgctagcgacggtccgccactgccacggtcctggcatagttcatgcaccctggacggttctaaacttgttgtgtcaggggggtgtgccgagtccggtgtgcttctaagcgacacattcttgcttgacttgacgaaggagaagccaacatggaaggagatcccgacatcctggtcgtcgcgccttggccataccttctctgtttatggtaagactaaaatatttatgtttggtggattggcaaagagtggctcgctccgactgcgctccagtgatgcctacataatggattttggtgaagagaatccacaatggaggcagttggcgacaactgggtttccaagcgttggtccgccgccaaggcttgatcatgtcaccgtgagcctgccctgtggaaggatcatcatatttggcggctcaatcgccgggctgcactcaccagctgagctcttcttgcttgatccggctgaggaaaaaccgacatggagaatcctgaatgtccctgggcagccacccaagttcgcttggggacacagcacctg

SEQ ID NO: 104486 - DNA, 233 bp, Triticum aestivum
  Clone ID: PAT_TA_104486
cgggctcgatggcgccttgttctgagggtgccatgaacaaagacatgtgaagaaagacaagaagagaaggaaggaggagaagaagaaagagaaagaagctgatatgactgagcagaagcagagttttgatactactgttggtaaggagcaagctgaaacttctggcttgatggaggtatctccctgtttggagctcgcccagggcgatatgagcaaagacaaggtgaagaaag

SEQ ID NO: 104487 - DNA, 452 bp, Triticum aestivum
  Clone ID: PAT_TA_104487
ccgctgcactggggcagggtaagaagactcctactccagaacttggggaggttgtgaccagtgatatttctggacggaggaccatgtcaaggtcatctgattcagggagaatgggtaacgacgagaaggaagatttggaattaggtaaaggtgactacatggatgttgatagaggggaggctagtgttaatggttcagctaatcttctatcttctgattcggaggatgaagtgcgcaggtctgaaacccctgagccagtgaagccggctcatcgatgtatcaatatgctgcaaggttgcagaagtgttgatgtgtttgagaggctcaacaagattaatgaaggcacctatggtgttgtatatcgagcaaaggataagaagactgctgagattgttgcattgaagaaggtcaagatggaaaaggagagagaaggtttcccgttgacctctctt

SEQ ID NO: 104488 - DNA, 401 bp, Triticum aestivum
  Clone ID: PAT_TA_104488
tgctgcgtcgatgaggtgggggcgtccaacattgacgcccagtgcgtcgtccactacggccactcctgcatgagcccgacatcgaatttgccagcgttctttgtatttgggaaggcaccattggacatcagtttgtgttgccgctcattgctggattgctcgagagaaagcagtaaacccgttcttgtgttatgtgggttagagtatgcacatgctttggacgatcttaaaagagccactatggaattatgcaaatcagattgtcaaaattccgaaatccattatgcagaagttctgtgttcggaaatgagtccgtcatcaagttctactggagaagagcaatgtccgcaatgcaatggaagcactcataatgatggtttgcctgcggacaatgatgatcc

SEQ ID NO: 104489 - DNA, 318 bp, Triticum aestivum
  Clone ID: PAT_TA_104489
agctccctggcggctccccggcccccaccgcctgctccgcctctcccgccgcctccacgcctccgccggcgccggcgccgcccaaggcaagttccttctgcccggcgcctcggcggcggtccttctcatgctcggcgttctgcacgccaagcggatgtacgatgacaaacagctcgtctaaatgaaggagcagggaatcgagccggaattctcgccagatcttaaggcttcgtttctgaggcttctaccgctgcgttccatgtcgcgtgtctggggatccttgatggaagtggaggttccagtgtttatgcgtcctgc

SEQ ID NO: 104490 - DNA, 286 bp, Triticum aestivum
  Clone ID: PAT_TA_104490
agtcgttgcgtttgcggaaacgtagcataccacagctgagtccatggcgacatgctggctgctgctcctcctctgggcgttcctctggccggcggccagcgcggtgccgtgtcaccccgacgaccttcacgcgctgcggggcttcgccggagacctcagcggcgggggcgtcctgctccgcaccgcatggtccggcgcctggtgctgcagctgggaaggtgtgggctgcgatagcgccagcggtcgcgtcacggtgctgcggctcccctcgcgcggcctcacgggc

SEQ ID NO: 104491 - DNA, 266 bp, Triticum aestivum
  Clone ID: PAT_TA_104491
tgtcaggtcaaatctgtttcaagccttggtggagctggctacagagtctcgcgagaagatggttcagaggaaacatacgacagtgtcatccttggggtccatgcacccaatgctctcaaagtactaggacttgaagctacaaatcgcgaacggagaattctaggtgcttgtcagtatgttcttttggatatataccttcactccgatcaaaatctgatgccccgaaattcgtcagcatggagcgcctgtaatttcctggggacaag

SEQ ID NO: 104492 - DNA, 403 bp, Triticum aestivum
  Clone ID: PAT_TA_104492
gaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccataacacccagggtctcatttttgtcgtggacctcactgacagagagcgtgttgttga

SEQ ID NO: 104493 - DNA, 167 bp, Triticum aestivum
  Clone ID: PAT_TA_104493
ggtgaacgggcggtgggcgatgctgggggtggcggggatgctgatcccggaggtgctgaccaatgcggggctcctgaacacacccgagtggtacgaccccggccatgagacctacttctcctcctcctccacgctgttcttcatcgagtccatcctcttccactact

SEQ ID NO: 104494 - DNA, 454 bp, Triticum aestivum
  unsure (1)..(454): unsure at all n locations
  Clone ID: PAT_TA_104494
aacaacctgttctccgggcccttccccgcggccacattgctcataccgtcgctggtctacctcgacctgcggttcaacggcttctccggcgagctccctgacgaggtcttcgccaagaacctggacgcgctcttcctcaacaacaaccagttcgagggccagatcccggagacgttgtggtcgtcaccggcaacggcgatcaccctggcgaacaaccgcctgacggggcccgtcccgacggcctacggctacggcggcagggtccgtgagttgctgttcctcaacaacaagctgaccggctgcgtcccggaggccctgnggttcctgccttacatcgaggtgctggacctcagcaacaacctgctgtcgggccacctgccgagcacgctgtcgtgcctctccggcatcgaggtgctcaacatcgcgcacaaccagttcaccggcgagctgccgg

SEQ ID NO: 104495 - DNA, 453 bp, Triticum aestivum
  Clone ID: PAT_TA_104495
cagcagctagcagcaatggcggtggtgggcgaggagtactgcgacctcaagagcggctgctcacagtgcgcaagacctcccacttctcccccggcgacggcttcgcggcctacgacaaccgcaccggcggcctcgccttccgcgccgacacctacggccgcggccacggcgggggcgccgcctccccgggcgagctcgcgctgctcggccccgccggcgagcccctcctcaccgtgcgccgccgccgcccgtccctgcaccagcgctgggagggcttcctgggcgcccgcgccgacggccagaagtccctcttctccgcccggaggtcctccattctcggcggcgccgggcgcggcgccgtcgtcgagctcctcccttcccccgcctccgccgctgccgccgagctccgcgtcgagggctccttcggacggcgctgctgccgcgtggtggcca

SEQ ID NO: 104496 - DNA, 503 bp, Triticum aestivum
  Clone ID: PAT_TA_104496
ctcctcttgctctgcacacacaccaagagctcaagtataggaaacagctagctagtgtggtaatcaatggcgctatcgtctgctcctccctgtcccggtcaggaaccgccgtccgggaagcagctcagctaccagcccgccgctgctgtgaggagcatcaactggacttacgccattttctggtccttgtccaccggcctgcgcccacctgggtaataaaccagtaacatacctatacatagctggtcacaagtttgtactttcttgaagcaaattcgaaaagtttgtacttttcatgtccggaacctgtcgctttgtttttgtagagttctgacatgaaagaatgggttctataacggcgaggtaaagacaaggaagatcattagctcgaccatgacagagcttaccgccgacgagctcttcctacagagaagcgagcaactgagggagctctatgagtcgctcttgtccggcaaagcggaccaccgtgcgaagcgtcccgc

SEQ ID NO: 104497 - DNA, 404 bp, Triticum aestivum
  Clone ID: PAT_TA_104497
gcctcaccttgcgcccagcatgtaccagtggcgcaagttcgagttcttcgaggagaagggggcagggcgcggtgggggaggcggcgccccggccgtgccagccgagatcgcgggccgagtgacctgctcctcgggcggccgtggccgcgtcgcgatcggctgcgacgacggcaccgtggggctcctcgaccgcgggttccgcctctcctacgggttccaggcctacgcctcatccgtcctcttcctccagcagctcaagcaaagaaatgttcttgtcacggttggagatgatgatcaagcatcttcacagtcatcggcagtctgtctaaaagttttcgaccttgataaagttcaagaagagggttcatgtacgacaacccctttctgtgttcaaattttgcggg

SEQ ID NO: 104498 - DNA, 617 bp, Triticum aestivum
  Clone ID: PAT_TA_104498
accaatgtcccggtttctcttaaagatgttctcagtcgatgagaaatggtgggtcaaatcaacaccgtggactatgaaccatcaagtagggtgtcttcaccttttttatcagtgatccagtttttaaaagtatagacgtgtaggattcttgcctactcccgcccctccttttgagcagtgagagatactaaagaagttggaaagtctatttttgtagctttaagtatatccctaacattattcacatccttgtgatgttgtaaatatatagcttcattttcctgggatcacctgagaccaaccggaacaataggtaggcaccagaattcacctggaccgaatagggtacaacttgatcaccatacaaaacagtgctatctttttgaaccgaaactgtagggaaggccctgacagtaaaattttgttagaagagagaaaaaattacaaaagagaaactgcacaagggctatcttaatacgaaatatttaatttcttgctttgagttccaactgctcactcggttaaatcctatgtgatgtaacccttcccattggtcctcgacgagagggtactatttatcgatatattctgtttggcaatgaatttttagatgcact

SEQ ID NO: 104499 - DNA, 589 bp, Triticum aestivum
  Clone ID: PAT_TA_104499
acctcgtccctcactcccacttccaccttcgaagctccagcggcagccatggcccccaaggcagacaagaagccggccgccgagaacaaggtcgagaaagcggcggagaagacccccgcgggcaagaagcccaaggccgagaagcggctgccggcaggcaagacggcgtccaaggaggccggcggcgaggccaagacgaggggccggaagaagggcagcaaggccaagaagggcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcccgctacaacaagaagcccaccatcacctccagggagatccagacctccgttcgcctggtcctccccggcgagctcgccaagcacgccgtctctgagggcaccaaggctgtcaccaagttcacctcctcttagactgacgctgcgtcgcttgttatgacagatgtagttggctgctgttttcttctgttagtggtcgctgactctgcttatg

SEQ ID NO: 104500 - DNA, 165 bp, Triticum aestivum
  Clone ID: PAT_TA_104500
tttgttgaacagaaatccgtttgatccccagcagtctactatagcctccaagataacaaatttggctaacaaggtcacaaataaagttcgttcgagggtcaagatggatgagaatggcatggtacgggaaggtggcagtggtgagagtcagtgttctgatcgtga

SEQ ID NO: 104501 - DNA, 498 bp, Triticum aestivum
  unsure (1)..(498): unsure at all n locations
  Clone ID: PAT_TA_104501
gaaacaggcaacgccgcctccggtcaatctccggccaccctcctccagcgcaccgatgcccagcctcctcctccagcgctccacctcctcaagcactcccccatttcttctctttcccatggaggccgaaggtcatggccatgacagtgcgtgcacggggcaaccctgttgacagcggcaacaccgtgcggcaccggaacatgtggtcgaggctgcacttggccgcccactggctcgtcggcatcaacaacgacgaacacggccagaagcagccattccttggctcaggcagcccagcagttaatctaatgttcaagtcttatttataattctttgacgcatggattgaatgattttacatgtatattttgctaaagattatagatacacttttgctttgatttatttcattttttgagcaaatttcagtcaaaattccttcaaatttcaaaattntgtttataaatttcgtccgaaatttccccaaaaaaattccga

SEQ ID NO: 104502 - DNA, 432 bp, Triticum aestivum
  Clone ID: PAT_TA_104502
acaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccatctccactaaagttatcccaagtttcacttcacat

SEQ ID NO: 104503 - DNA, 487 bp, Triticum aestivum
  Clone ID: PAT_TA_104503
tcgggccgcaccgcttctcctacaagatctgttccgcgccacggaagggttcaagaacaagaacctgctgggggtaggaggattcgggaaagtgtaccgaggagttcttccggcgtccaaatgcgagatcgccgtgaagagggtgtcgcacagctcgaagcagggcatgaaggagttcgtcgccgagatcgtcagcatagggcggatgcagcaccccaacctcgtacggttgctcggctactgccgccggcaaggtgagctgcttctggtgtacgagtacatgccaaacgggagccttgacaggtacctgtactctcaacctcaggaggccgacgacaagcacaatggtactctgaattgggttcagaggcttgggatcatcaaaggcattgcatcggggttaatctaccttcatgatgagtgggagaaagttgtcgtccatcgcgacatcaaagccagccacgtgttgctcgacagtggcatgaat

SEQ ID NO: 104504 - DNA, 215 bp, Triticum aestivum
  Clone ID: PAT_TA_104504
accgacagcccgtgcatggccaatgataggaaggggatcctccaggtctgattcgagctgcggttgtatcgccgcccaccagccagggcgcatctcgccgtcgctgagctggaaaggcggagggtggtcgccggcgaggccactggtgccggtacagataggtgattttcttcatattttaattgcttggggaggtggatttgatccttgggaga

SEQ ID NO: 104505 - DNA, 380 bp, Triticum aestivum
  unsure (1)..(380): unsure at all n locations
  Clone ID: PAT_TA_104505
actgtgcagaagttattacactcttatgtaaagaatgaagagacactattgaagactttccccaagatgtcaccagcagcttggaaagccatcataggacatgccatgacgtgcgaagttggcgacactctttacatgcatgaaattaaggaaaccaacatggaatttttctttgatgccatacttcagcttgttggggtgaaatttggtgattgttacaagcccttanataagattcaccaaccagagaagaatttagtcgagactctgaagcaaaaggcgttatgagaatattaaggaggttcagtatgatcatattatgatcaacaactgtcctgtgccacttcataagtttcatgcaaagggggcttctggggtga

SEQ ID NO: 104506 - DNA, 405 bp, Triticum aestivum
  Clone ID: PAT_TA_104506
gtttcaggtacttcattctcctctgctatattgcgtcgtgtgctccacgcctgtgccttctgattcaggagtgcccagtgacaaaatgtgttatatttgtagagtcgatgctgtttaaaaatggtttccacgcaatggtttccagttatgtgaaaccaagccactgatggagctagagaggaagttcagggggggcaaatgataaaacatctagacttgagggggccaaatactagatttatactcatctacaccctctaaaagtatttaagtgtgaatactatattttgttataacacacaggaaacccaaggtttgaggccagagatttaccttggatgttgcatgtgcattacttactttagctaatcgtcctaccgtcgggcttttagttgaaattcactt

SEQ ID NO: 104507 - DNA, 320 bp, Triticum aestivum
  Clone ID: PAT_TA_104507
cctttctcgtggtcgtcggcctgagctgggtgggatgtatgttgcatggtcgtcggcttgagcctgccgcctcgcccgtgctcttggatgggctctgggagaaggccaccagtgcacgcgcgtagtcacggagaacgaggccaacggcagccggctctgcaccatctccagcacgtcgtccgggagcaacatcggggacgacgtcaatcccttcgccactgcatcatcctcaacctccagcgagtgactgagccgcgcgacggcggccgtggagtgcttcttccgccggcccgcaccagagggatggggatgggaccccc

SEQ ID NO: 104508 - DNA, 474 bp, Triticum aestivum
  Clone ID: PAT_TA_104508
caactacatctgttcaaatattggtgaacttctgccaaagttgcatacattggtgctcatgagcaatgatatcacaactcttgcggagattgaccctcttgctgctctcccaaacctgaaatctctctacttattagagaatcctgtcactgagacggcagactaccggttatatgtgatccacatgctgaaacatttgatgtcactggacttcgagaaagtgaaaccacaggagagaaccacagcagaatataagttccactcgaaggaggcacgggaagaggtaaagaagacatctgccaaagcttatactccaatgaagccagtgggtgctcaatatataacagagaagtcatgccctaaagcagtctctccagtaccatctataaaggtattgagcactggccagatggctgctgaatttgctttcttcgagcctgaaattgatatggctgaagccttggagaaaactga

SEQ ID NO: 104509 - DNA, 228 bp, Triticum aestivum
  Clone ID: PAT_TA_104509
tttttttttttttttttttttttttttttttttttgaaaggggcacctctggtttccattcatcaaacagggaaaacatcacccgcccattatgacatgaatctgacaaaaaacatatcttggcacgattcaaaaagaaaataaaaattcacagctcgcaaccatgcatgcatacgtattggatggcatttattctatatatcattacatattaacttcccatatgcc

SEQ ID NO: 104510 - DNA, 469 bp, Triticum aestivum
  Clone ID: PAT_TA_104510
tcgagcatggctctgccgccgccgcctcagcagcagcagctgcgcccccggaggccgccgcggccgcagattcaccggcaaaggaagaggcccagtccgccgccgccgccgccgccgctcccggcggcgaggcggacgcggcgggggagacggtggtcctggacgccgccgcggagggaggcgaggaggaggaggaaggggagtgcgggttttgcgtgtacatgaagggcggcgggtgcaaggaggagttcgtggggtgggagaagtgcgtggagcaggcggaggcggaaggcggctacgtcgtcgagcgctgccacgacgccaccgccgcgctgcgcaggtgcatggacaagttcccggactactacgagcccatcctccgcgccgagcgcgccatggccgaggatctcgaggccttcaaggccagcgaagcctccgagccctcccccgcctcaccgccgcccccggc

SEQ ID NO: 104511 - DNA, 159 bp, Triticum aestivum
  Clone ID: PAT_TA_104511
gcacgctttcgtctccgtcgcttgggtttcggtctccgcaaactcgatcttccgcgagggcacgagccggtgctcttggttttggtgtggcggcctgagagagatgccgcccaagtcggttaagaggggcggcgccgcggcggcgaggaaggggtcggc

SEQ ID NO: 104512 - DNA, 505 bp, Triticum aestivum
  Clone ID: PAT_TA_104512
tctcctcctcctcctgccaccgatcccgaaccaggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgt

SEQ ID NO: 104513 - DNA, 434 bp, Triticum aestivum
  Clone ID: PAT_TA_104513
cctctcccctcgcctcctcgtcctccccctcctagggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagcctgctgatatcgccggtcccagcgaggcggcgatggagaaccccaaaggcccaagccggtgcagcacctgcagaa

SEQ ID NO: 104514 - DNA, 577 bp, Triticum aestivum
  Clone ID: PAT_TA_104514
tgccaaatatcaaggagaacgacgtcatgtcccctgttagttcagagacaggcggtgtacttcatttacacaccaccaatattggcacaatcagggagatactgattgccatccgcaggaaacaggccggagacctgataaaataatctttcatagtgatagggaagatgaagagcatccgagccttctccttgtcagcgtatatggcacgatccgagaagcctgtacatcattggacgaaggttatgttccgttgattgttattgatgattctcaagaaaaaaatcgcagtctgtcccctgatataaatgaaaaaccggaaaataaatcagcttcacaagtaatgacacatctgactgttgactccccaattggacctattccaatgcaaattgatcttaatagtaagtcctacaagcttaaacagaaacttgaagaagtcttggatacttctttggagcacttttatatgcgcggaaacgggataactttgaagaataatgacccgttaaagacatacggtcttagggataattcaacaattcagttactgccaagacttcttgggggctgtcgt

SEQ ID NO: 104515 - DNA, 192 bp, Triticum aestivum
  Clone ID: PAT_TA_104515
ggtggcaatgttctgttttattgctatgacgcttgatgcgaatacagcgatgctgattttcaaaccattgcgcacagattcatttgtagtgtgccgaatcttccagaggctgggcctggtcctcaaaacggggcacagtatggagctcccttcgtcgaggaggagtgggaggctgatgaggatgatgatttt

SEQ ID NO: 104516 - DNA, 122 bp, Triticum aestivum
  Clone ID: PAT_TA_104516
accttgatctctaaacactacaccaccaccagcagtgaaatgaaccttgatttgaactgttccagtttgtctctggctctactctatttggatccaaatcgagtcagaaggaaaaggaaatg

SEQ ID NO: 104517 - DNA, 516 bp, Triticum aestivum
  Clone ID: PAT_TA_104517
gcagtagggttccatccctctcctccttcctccccgcttcccctcccggccccgaccttcctgccacgccgcctcaccgccacccgtcgcctcatcctctccactcccccgcacgccggtagcccgcgcctctgagacccggcgccggcgccggtggaggaggtcgcggccgcagccgtggaggagtacgaggcgcatccactgccatcgggacgagatagagcaagtcgactgggtcgtctccgccatgaacgacaaggcgacccgaaacagcgcacatgtcagctctccgtctgagcaagggagccgtccagtcgccgccgccagggtgccgctgctggtcagtatgcgtgccaccggaacaggtcggggagcttccggttggtgtgtgtgcctccttccttcagcacaagcagcaggcccagggcattagcaccatcccaacgaaattgatggaccaagtaaccagctgccaagttcttcaaggttcgtgaagagagctgatctggttttgtg

SEQ ID NO: 104518 - DNA, 323 bp, Triticum aestivum
  Clone ID: PAT_TA_104518
acccccacgaccaccggcgatcgaccatggcggccgccaacgcatttaccagcgcttccatgtcctgcgctccgagcctgagcggctctgtcaatgtgatcgccgtgtgcccacgctccgtggctgccgcgaggacgttgtcttcgtcgtgcttgcgccctgtgcggtgcgccgccgttgggacagcagcgcccgtggcggcaacggcggagggtgacgagaggcggttcgagcagctggcggtgccgccggagctggtggatgagctcgtggaggaggcgctcgtgtggtgctcgcagcacggcctcgtcgtcggcgacaag

SEQ ID NO: 104519 - DNA, 496 bp, Triticum aestivum
  Clone ID: PAT_TA_104519
aggtgcatgcaggtatgtcgggcactaattgatatgagtttctttgtcagtgcaagtaattcacttacagaacatccccgatgtatataaccaaacccatcctcgaaataggacccatatactagaactaagtacaaccaaagctttattgattgtgaacaacccagcaatgcatatgagagctgcccataaggagcaatttttggcatgccgtctgatttattctagcattgttagtacaattaattgacttatcaccaagtattgagcatctgtgcgcattctattcattcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtgg

SEQ ID NO: 104520 - DNA, 502 bp, Triticum aestivum
  Clone ID: PAT_TA_104520
ccgccttctcgccgaagcaggcccgctacaactaaggcttcctcgcctccacctctacctggttggtgtgccatctggacgcgattcgtttcgtcggtcactccattactagactcccatatagcatgcaaaggttgaagcttgcgatttattgacgatgatttgacttgcagtcatcggccgaagcacattccttgcccttccacttgaagctatagtgattggtgcgcccattgtgaatgacactgcggtcatactgccaagggcgtcccaataagagatggcaaacggtcgtagcgaccgcatcacatcccaagaaacataatgtcttttgaagataaagcaatggctagtcgtatcacctcgccctcatcaaaagctacggtatcagaatcagatcttcggataataaatgttgcatcaaatgtggatcattctcaagcaaataaccaggcaagtgcagtcctcggtccagtggctatcttttgggacattgagaact

SEQ ID NO: 104521 - DNA, 445 bp, Triticum aestivum
  Clone ID: PAT_TA_104521
cgccccaactcaacgcgagcaaaccctagcctagccgccatggctcggcgcctccaccctgctgcaccttctgtgcgcgcctctcatcctagagaagagactgactctgtcggtcgctggctaacgccggacgcctctcatcctcggaggaaacttgcggtgacgcgccatggtgctgggtcgatccggccctccgtatcaggataggcgatttgccggccggcggacgagcaagcagcggccgtagaggagaaagaggaccggatctcccctcccctttgcccactgttcctctctctcataagcctcagtcagatccgtccgtctctcatctgctgttttgctttcgagtcttctactccatgtttctcagatctgcgaacgattctttccttccgacgacttgcatctgggttgctgttattcttcttcttttctctctctt

SEQ ID NO: 104522 - DNA, 220 bp, Triticum aestivum
  Clone ID: PAT_TA_104522
tgtccagcgccggccgcgccgcgccggatttgacatctgcccgtgccggctactggacccgatgtcgccgatgacgacgatgcggcaaatgctggacgcgatggaccggctgttcgatgaccccgtagggtgacgcacagcgcggcgctcgccagcggcggctaccgagatgccgcggatggcgtgggacatcatggaggacgacaaggacgtgaagatg

SEQ ID NO: 104523 - DNA, 510 bp, Triticum aestivum
  Clone ID: PAT_TA_104523
tgccgccgatacctccgccaccgccaccgccaccgcggcctcagctgacgccggcacccagcctgagcgtgagctcaggctcaatgggcctgttcggaagcgcaggcgcgccacctcctccgcccccgcccccgcccccaccgtccaagaggacatgttcgccggtgagatcgggttcatgcgtgaggcgcgtgcctgaggtggtggagttctaccactcactgatgcggagggagtccaagagggacggagggagcggtgccgacgcagcgagcggtggcggcgcggcggcgaccagggacatgatcggcgaaatcgagaaccggtcggctcacctcctcgcgatcaggtcggacgtggagacgcagggcgacttgatccggttcctgatcaaggaggtggagggcgcggcgttggtcaacatcgagggcgtggtcagcttcgtcaagtggctcgacgacgagctatcccgcctggtggacgagcgcgcggtgctaaagcacttcgagt

SEQ ID NO: 104524 - DNA, 335 bp, Triticum aestivum
  Clone ID: PAT_TA_104524
cccccacgtcgcctcccgttctgaaccccaagctccccccccgccgccggcgaaatggccccgaagcgaggcggcaaggcgccggtgccggcgaagaagaagcggcggacaaggtggtgaacccgctgttcgagaagaggccgaagcagttcggcatcggcggggcgctgccgttttttaagacctccaccggttcgtcaagtggcccaaggtcgtgcggatccagcgccagcgccgcatccttttttgcgcctcaaggttcccccggcgctccaccagttcacccgcaccctcgacaagaacctcgccacctacctgtttaagatgcttctcaa

SEQ ID NO: 104525 - DNA, 594 bp, Triticum aestivum
  Clone ID: PAT_TA_104525
cattggcaaggtttacaatataatttgtagtttctttggttcaatgtccaatgtgccattcaccaaaagagtgttgagggggctatgtggcaagatcagccgtgagcaagcagacgatgatgtcaggaagacaatggatgcttttgctgagttgggagcaaaagatattggtctgtactacagagtgcagccggatgaggatagccgcatacggaatttgttatggtcaactggatcaagcagggcccagtaccacttctttggagatgcaataacatttgatacaacataccgtaccgacctctatgacatgccatttggcctgtttgtgggagtcaacaaccacttccagaccatgatatttggtgtcgtcctagtaagagatgagatagtcgagacttttcagtgggttcactgaattcatccgcatgatgggcggaaaacatccacaaactttgcttacagatcaatgcaggtccatggagatagcaatggagaaagtgatgccagaaaccactcaccgctggtgcaagtggcacgtgctgaagaaggcaaaggaatctctgggaccatactacacaaagcgcaacaaat

SEQ ID NO: 104526 - DNA, 583 bp, Triticum aestivum
  Clone ID: PAT_TA_104526
tgtttttctgtgttgcaatgctgtcatatattatcctaacaagtcttctcttggatattctagtagattgtcaaggtaagggtggttcatcaagaaatcgctcatctgggcacaaccgtgaccagagttctcggcagtcttcatcacggaggagttcagtctcaagtggatcccggtatgtttgaccgggatgacatggggaagacaaggggctatgcaaattttggaaggaacaaggataaggagagggagaaggattttgattcccgtgatagggagagtaggtccgttacagcagatcgtgatggctttcaatcatttagctcatgtagacctgaaagggataggttaaatcgtgctcgctcgaaggcagacacatcaagtaagggagtaattagtctaaataatggtagtacatctaaaagcaatactgttggcgttgcctttgagcgagaattcccacagcttagttccgaggacaagaatggaaggcaagacattagcagagtcccatctcctggtatcaccaccccaattcagagcctgcctccatttactccatctgatggctggacttccaagc

SEQ ID NO: 104527 - DNA, 530 bp, Triticum aestivum
  Clone ID: PAT_TA_104527
cccgtctttggccgctgcgctgcagcctactacgccattctcggggtcgtcctcctcgtcgccgtgccggtggagctgctgaccgcgctctgcctgcgccacagccgcgagggccgcctcctcgccttcgcctcctacctgctgccctgtgctcacgtgctcctcctcctcgtcatctcggaatgctattcttggaagttaaatcttggagtagctagcatttcttctttaaggaaatgaagccagtggttatcatgtctttggcgcgcaacttggtttgctgtctctggagctgtagccagtgctgatgtatagctcaagatgtctcacagaatatgcagagcaagacgtgctctgttttctctgttttttggaaaggtgtactctgtgtttttgctcagcgcagccacaatttccacgtggtcagcaccaatgtcttgccgaagcagcgctcagcgtgtcaggtcggcttcctgcagtacggcttctccccacagtggtggagatcctgcagtcacttgacgtgctca

SEQ ID NO: 104528 - DNA, 599 bp, Triticum aestivum
  Clone ID: PAT_TA_104528
catcaatcatattcgcagcctcagccagcacatcagatgccacatggtgctgcaatccagcaccctgtacatgcatctcaccaacagttagttggtcctcagcatcctgcacttgtacaccctcctcaaggtcaatttccgttgcaaggtcaacagccatccatgctggctcctcaaggtagtcagcataccccacaacatcagcaacatgggcatcaggctcagcggccaccaatgcatcccagcatcccttcgcaggcaccaccacaaggatttcctctcagcacacccgttcctccacaaacaggtcaatcataccagcaaggaatgcactcatcacaacaacatatacatcctcaacctttccagccccatggtccacaatatatgcagcagcagcagcagcagcatgttccaacctcgactagcaggtctacgagttatgttgcaacaccgcatcagttccaagaatcaggaaagtcagaaagtgcagctaatgctactggcaatgctgaagtaggtgataatacaaatggaggcggtgaatattctggcataaagccagaatcgctgggtgataaaaatgtgaatggggagca

SEQ ID NO: 104529 - DNA, 160 bp, Triticum aestivum
  Clone ID: PAT_TA_104529
gtcggcacgttcgtgctggtctacaccgtcttctctgccaccgacgccaagcgcagcgccagagactcccacgtccccattttggcgccgcttcccatcgggttcgcggtgttcctggtgcacctggcgacgatccccatcacggggaccggcatcaacc

SEQ ID NO: 104530 - DNA, 277 bp, Triticum aestivum
  Clone ID: PAT_TA_104530
acgcttccccttgtcctcgcccactccactcgtaatcctaataataatgctctgccgggtgccggccctgacgatgatccacccctcaaatctcccacccctctcctccatcgatcgacagcttctctggtcgtcgacgccatcatgactaaccgatctgcgggtgtgtgtctcgatcggtgcatgcatgcatgcgtagatatggaacgggaggtggtgccgctcgcgaacaatggcgctggggctcctgtgtttttggccggtttgctggtgcatg

SEQ ID NO: 104531 - DNA, 234 bp, Triticum aestivum
  Clone ID: PAT_TA_104531
catggcctccaaacaggctgtgcatatgaagcatggccaaggcgaaacaagctatgctcgcaactccagttttcagagagctgagcagaacaggatgaagcccctgatagaagaggtcatcaccgacttatgcagcagcactagtaccttgttgcacggaaagatagtgatcgcagacttgggatgctcctctggtccaaatgctctagcactggtgtcgactgccatcaatgc

SEQ ID NO: 104532 - DNA, 500 bp, Triticum aestivum
  Clone ID: PAT_TA_104532
cccctgttgattacccaacaaagcaccggaatcgtttccttctcacttcagtttctcccccaccataaatctttccccaatcctcgtggtgtggcggctggacggcaatctcctcgcgtcaattccgccgttgttactccccttcgatgcctccctgcgcgatgtgacgcgggcggagctgcggttccatcgccgcccaccgagaacattgagttgcgcaaccaaatcaggttgtgtgcactccatcactctgctcatgaccctcctcgcgccggaagcagccatccctgccgcggcgctcgatctgaaaaatagttcgcgttccggcaggaggagctcgccaaggagaagctgctgggacggtaggcatccacgagggccgcctgttcctcttctacaaggcccccaggagtggtcatcccacgtttaggccgaccgcctccccgcctccttgctgcaggtcataagcctaacccgaacaagaccgtgagcatctcctc

SEQ ID NO: 104533 - DNA, 626 bp, Triticum aestivum
  Clone ID: PAT_TA_104533
atacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtccggcaaggcctaaactatgagttgaaacaatggcctatctcatatgaagatcttttgtgaatttcacttttgtccacgacctctgttgcacgactctgctttc

SEQ ID NO: 104534 - DNA, 458 bp, Triticum aestivum
  Clone ID: PAT_TA_104534
aaacggattgatggtgttggcttagatgtggcaggaactgaacagattcgtgcgaagctggagaaggcaatgagagattcacgaggaattctttcagaagtgaagcaagcacagattgtccaacaatgcaagacggcgaatcttgtctggatcggtcaaggcaagttaggccctctgcagccacaccagatggaagcgatactaggctatccagctaaccacacagatctgccgggcatagacccacacgacaaggttgcttctttgaggtatgccttgcagacagacaccatggcatacattttgtcggtcctaaaggaccggtatcctgatgggctgagggtcctctctattttcagtggagttgggggtgcagaagttgctctacaccgtcttggcatcccgctgagatgcgtggtgtccgtagaggagtctgtggtgaaccgtagagttctaaa

SEQ ID NO: 104535 - DNA, 536 bp, Triticum aestivum
  Clone ID: PAT_TA_104535
cagcgcgccgcaggtcgagctctcgctcaaagcttcgccatggcaactctctcctcttccccgacgattgtgcgtcactcactccgtctccacgaaggcggcatgacggggtgtacgcggcgccgcgctggtgcccggatgatgttcgacgaaatggccgtgagggtcctcgggtgtgagcgagcccgcaccaatcaggtcagcgtgttgtgctgtccctggtctcctaagactgctgccactaattttgaatgctcacgttggttctctcttgttacatagtagtacgtctagaagctggtagttgctgcctgatttggttagcacatatcctgattagctcgcaattttgccacaagaagccttcctgaaaagagaagagcatggtcaaggaaagttgctgagcaaagcaaatgactcccaagtcaccatcatctttccacggtgcatgaaaagaacagctgagctgcccttccaggacattctttcacaggctggaggctggaggtggagtggttcacaacgcaactggtgat

SEQ ID NO: 104536 - DNA, 591 bp, Triticum aestivum
  Clone ID: PAT_TA_104536
gctcaggtactttcaaatcgaggaggaacaccgctgtctagctacatggtggccgctcccctcgaccccctccatcgcctccgccgccgccgccgaggtacgggatcgctgccgagccgaggtacgagatcgcctccatcgcgttccttccctggccacgcccctcccaatttcttcccctcacccagctagggttctcacccgccgccgctcccctgctgctacccggcacccgatgccctccacggacaccaccaccatgatgtcggaaggaagagcaagaggggtcgtcgaggctgggtgccgccgtgaggatgctggcgcccgtgcgcggtgatggcattgtggcggaagaaggtcttcttcctggggagccgcgcgctggccgccgtctccacctgcggccacgccaaccagacagatacgccgccgcgccatcgacatattccctactcccgtgcacgtatggtcaagcatgtagcgcttatcttgccccatgcggccttggcagatctcaatgcttgcttgctaatgtgcgtgtgtggatgttgctggttgctgctgctgtgcacgtgtgcttggtgtgcccct

SEQ ID NO: 104537 - DNA, 469 bp, Triticum aestivum
  Clone ID: PAT_TA_104537
cgcacctacactcacactacactccactccactctccccaacctccactcccaaatctccaaatctctttcttgattctttctccacacgcaccgccgccgcagccagcgagagagaagaggtataaatccaaccatccatccatccgtaggccaacaacgcagacgcacgcaggcagcgccgcgccgaatcccctccgtcccctagcctccttcctctgtctgtcccggcggcggggggaagatggagatattctactacgtggtgttcgggggcctggcggcggtggtggcggggctggagctgggcaagagcggcaaggaccgcgtcgccacccccaccgcattcaacgccttcaagaacaactacgtcctagtatactccctaatgatgtccggcgactggctccagggtccctacgtgtactacctctacacccagtacgggttcgacaagggcgacatcggcc

SEQ ID NO: 104538 - DNA, 604 bp, Triticum aestivum
  Clone ID: PAT_TA_104538
gggttcctgggcacgcccacgctcagcaggctctccagttccttcctcgccacctccttccgggggaagcaaccaccggagatcgtcaagccgctcctgcccaccaccctgatcgccgccaccgaagatgaccatgtcgatgatgcccggaagagctctcaccactacctgccgccgtcgaggaaggcgtcatccctgttcaagatccccgaggaccaaaagcctgctggcggtgggggtggccatgaggtggggccctaccgtcagtgctcctacacccagggcgtcttgaatggagtgaacgtcctgtgtggtgtggggatcctgtcaacaccttatgccgtcaggcagggtggctggcttgggctggtgatactggccgtgctcgccgtgctcgcgtggtacaccggcgtgctcctccggcgctgcctcgacagcaaggaaggcctcgagacctacccggacatcggccatgccgcgttcggcacgcctggccgcatcgtcatctcgataatattgtacatggaactgtatgcttgttgcattgagtatctgatactggagagtgacaatctatcaaagttgttccccaatgcacacctga

SEQ ID NO: 104539 - DNA, 564 bp, Triticum aestivum
  Clone ID: PAT_TA_104539
ggtttcttgtctgtccctgcgtttcgacctcgctgcccgtccactttcgaccttcgcaaccgcgccttcgccgctcggcgcctctccggcctacccacctcccgtcagagttttggtcctaatcctcaaaggaaaccaatatcgtgggttgctccccccagatctctgcctccgcggcgagtggggaataagaggagccgccgccgccggccggcacctccgctccgcagcactggaatggggaactatctgacgagtagaataacggcagagaagcatgcccatgtcaagcagacatccaagaatcgcaatgggaggcctggccttaaatttcatgaccttccagaggtgaatgagaccaaattacgtctcatctagatgagttctaggtactcccttatcgaaattacctgcaaaagaggctgttcggaccagtgttttgtcgactgactggagatgtacatggacagcttgccccagactaagctttggtgtcgatgatgtaagtaagaatgcgaaaaggaaacaccagcacacccagatgtttatcgaccgtgttaatgc

SEQ ID NO: 104540 - DNA, 208 bp, Triticum aestivum
  Clone ID: PAT_TA_104540
ggtcgcctcgtcgcaggccccggctctccaaggtcgtcgcgccttgcacgtactacggatcgccggcgtccaagaaatcagagaagaacaagcctcacctcatgatcgtgttcatcatcgtcccggtcgctccggggaggattcttggtgatgtgggcctacccgaggaacttcggcctctggctgcacaagatcacgccgcggtggt

SEQ ID NO: 104541 - DNA, 564 bp, Triticum aestivum
  Clone ID: PAT_TA_104541
caccaccacgccaccacctattccaccccagcccgcggataggccacagccatccacctcttgagctccggcactccggctcacctgttggacttctccgtcaccactgcagttcctcccttcgaatcgccgtcacgctcacttgcagcacgcgagtgggctgctgaggctgagcaacaccggaaggagcctccgtattgagatgtctgcaccggtggtcagcgccaccatgggggcgatgaaccccctcatcggcaagctcgccgcgctgatgggtgacgagtacaagaagctaacaggggtgaggaaacaggcctcgttcctcaaggatgagctcagcaccatgaaagccctccttgagaagcttgagctcatggacgaactggaccccttggcaaagaactggagagaccatgtcagggagatgtcgtacgacatggagaattgcatcgatgacttcatgcgagaccttggaggtgctgatgccaagatgggctttataaagaagacggctaaacgtcttaagacgctgcggaagcgtcatcgtatcgctgatcggatgga

SEQ ID NO: 104542 - DNA, 365 bp, Triticum aestivum
  Clone ID: PAT_TA_104542
gtctaagggctctgcccaatgctcgagagcctagcctccctctccctgtgacctacagtgttcctcgagtgcggctgcttcccttgtctcataaaatttaacctcacctcatgcctgggggtgacgatgcaaggatttcgcgaatacctgaagcgacactggaagatagaccatgagtcgcttctcgaaaacatgccacaaatatcgagtctgattgtcatgatcagtggaccttacagatggatcgtgccgtccccgtcgacgacgatgttgttgcctaacctgaggcggttgctggtcgccgacgtgccttcgtcctgcgacgtctcatggccccgcctcctgcttgagacggcgccttccct

SEQ ID NO: 104543 - DNA, 608 bp, Triticum aestivum
  Clone ID: PAT_TA_104543
acaaaaaagtaaactttttttttcttgtaaaatgaccacatgttttttgagaaataatcagtaataattaaggaaaataaaatggcacggtactctttgccgcgcgctcactcgtcgctcaagaggtcgcccgccatgctccagcgctcagacatacgtccatagtttggaatagcagccggcaggcttatcatgagccgcttcatgtccgggaccgtgatcagttgatggctaggacagttaggatgggcccagattgcgtgcatcagggcatcctccagcgcatcctccacttgctcggtgtcctctccccaacggatggctgcaacaagaacctcccgaagggaccgcaggttccccagacccaggtcaaaacaatcaccaccattaccagctgctggctcttttgcggcccgcagaccgatactgaacctcacttgtttagccttgggcagagctcctggttgaaacacgatatggcccagaaactcggtaaacagctcgaatgatgtcagacaacgaaacccatcatcaccgacaactagctgcctttggatttccggatcctccattcgcaagctgagacaacgaagagctggtaaccttgc

SEQ ID NO: 104544 - DNA, 478 bp, Triticum aestivum
  Clone ID: PAT_TA_104544
gcgacgacgtccccgccgctgggcaggaagagtgtttccacgccttcaacctccatgtccacgatgtcgtactcgatgcccacctgcaaggtcagcctcccatcctcccggtccttcccagcaaattaatctggacttcaaccatgaattaaacgtcctggtctctaatgggaacttttttgttactgaacttcgtaattggtttgcataaaatctgaggtctgtctgacatattttacttgaccacggttcgcttcagaattctactttatgtgagcattactttcttagtctatctgatttacttggaggagtatttaattacacgtatgtatagtacaagttgttatttcctaataattttgatggcctctaagcatcgttgttcatgtctattattatttatgaaagctacatgtcttggagggaagttgcgacttgagggagtgagctcccattctctcaatttcttggcgtg

SEQ ID NO: 104545 - DNA, 172 bp, Triticum aestivum
  Clone ID: PAT_TA_104545
gttggcgaggtcattgggttgcgtccacaacaggcttttgggcacgcgcctgatgtggagtgcgaccagccagttggggctcggcccgaggcgcctgtgggtcccgttgttgatcagcctgtctcccctgcctcggtccagttgtcgagatgggtgagggcagacaggattg

SEQ ID NO: 104546 - DNA, 567 bp, Triticum aestivum
  Clone ID: PAT_TA_104546
cctcgccgtcggctgcgcccccaaatccctcgcctattccatcctctcgttcgccccctccgcctgattcgctggtcagtagactgaccacccgctgcttgaagtgtcgctggtaatctcccagcgcttccggaggagggccaccgtcaacgaccccgtggccgtcgtccactggaccaccgcatccttccgtgagtggcgccctttccaatccaggttacaggacttctgaagttatttcacttgttgatgagaaagaaaacagagttaaacgacggctgattatcaagtaggattagatcttggatttgctagtggactttgggagtttcttggccagcttggtgactccacatttttcactatttcagcaagcctttggtgctaacttgtccgaggacttctaccaatctaagaaactcttaaaggtgacgggacaactatactatgcaacttggaatcattcttaaatgagaacaccccggcataattgagaagaaggaaggtgatgttgtcattaaaacccgcccagctttggagtgatctgattattatgatgatgatact

SEQ ID NO: 104547 - DNA, 390 bp, Triticum aestivum
  Clone ID: PAT_TA_104547
gctctgccccacccttgtgccacgccgcggccgccattattccatcccactctcacccgatgccgccgccacgtaccctcgccgtcctcctcctcgctgtcgtcgccgtcgcggcccatggccgcctcctcgcctccgacggtctcccggggcaggggagcgcgtccgacgccgccgtgctccgcctctcgtctgcggggcggccggccggggaggcggaggagggcgggtgcgagatgacctacggcttcctgccgtgcactgagacggccgggggcaacctcttcctcgcgctcgcctacggcttcctcatgttcaagtccgccacctacctctccgccggcagcgaactgctgctcgagatcctcggcccggggatcgtcggcggcc

SEQ ID NO: 104548 - DNA, 415 bp, Triticum aestivum
  Clone ID: PAT_TA_104548
gcccgtccccccctccttcgccggaaaggaggtcgaggcggctccgacggcggagtcgtgcgtcaacctcggcctcgagttcttctccaagggcagagtgagggatgcacttgaacaatttgacaatgccctagagctgaatccaaatcctaccgaagcccaagcagcgttctataacaaggcatgctgccatgcgtacagggaagaaagcaaaaaagctgcagagtgcttgagaatagctttgcgagattacaatctcaaatttggtacagtacttaatgatccagacatggcgccattcagggcatcgccagaatttaaggaacttcaagaagaggcattgcgtggtggagaagatattggttctgggttccgaagagatctaaagctcattagtgaagtacaggcaccattt

SEQ ID NO: 104549 - DNA, 460 bp, Triticum aestivum
  Clone ID: PAT_TA_104549
gccatttccctcactcatcgccgtcatcctcagcgctgtactgccgctcccgtgttcttgacctgagagatggatgcggggagcgccggcgaggcgggacggcaggaggggactccgatgggccccgcggcgccgtttggcaggtcgtcgtcgtcgtcgggtctcggcgcgaagggcggcgcagcaccccatatcttcgacggcgcgctcagagttgagtggttcttttcccaaccataccgcgtcaagtgcgcgcctctgattagtgcttgcgggtcggacgtccgacgcgttcgttggggtttgcaggagctcaaggatctgcagtcccagctgcaccaggcggcggactgctgcgagaaggcgttcctcgccaccgagaagaagcagctaatcctggacagtacaaagagctacatctgctacgcggttgtagcggtgattgatcatctggggaccg

SEQ ID NO: 104550 - DNA, 434 bp, Triticum aestivum
  Clone ID: PAT_TA_104550
caattcgcgcccgagagcgcgcgctcttcttcgcctccactaccatgactattggcaatggccaacacaccctgttcctgggaggacagatggataaacgggcgtgcgatccgcgagatcgcgcctctcctttatgctctcatccccaaacggcgtcgcaagtccagaactgtagcggacggccttcatgcgaaccaatgggccacggacatccacggcatgattggcatcccggagattggagaatacctacgcctctggcacatgctcgctgaaacttccctcagcgacgcaccagactgcattcgctggaagtggaccgcgaacggcgagtactccgccaagtccacataccttgccacttttcatggctccaccagatgccaggcttggaagcttacctggaagtgctgggcaccgcctcgggtgcgctt

SEQ ID NO: 104551 - DNA, 350 bp, Triticum aestivum
  Clone ID: PAT_TA_104551
gaacgtgcgcagatataggcgagtcactgacgcacaaattaaagcggcgagagctcagctcactcactcactcacccgcaccgctagctagctccaatggactactccacctccctcctccgaccccaccgacagcgacctcgactcctccagcgtcctttccaatgccaccgcactcaactcctcggaagccgccggcggggtgccgccgccgtgggcaaccacgcgctcggtcccaacgtctctggctgggacgagcagcgccgacggtggctcgcgcagaacaagggcttcccagccactgtccccggcggcaagcccaggatcctgcttgtcacggggtcgcaacc

SEQ ID NO: 104552 - DNA, 332 bp, Triticum aestivum
  unsure (1)..(332): unsure at all n locations
  Clone ID: PAT_TA_104552
attgatctgattctgaatcttcccttcttccggtacttatttcacactctctctgattggtcaatgtgctatgcaaatctgtttgatatatggattaaatttgcttttgtacatgtctgcatcgtacttaatgttattcccttctgaattancaagatttagaggaggattcacaacaatgtcaatgttaggtttgattcaccaccagtgctctttagtttacaaagggttgttaattcagcattcaactctgccttcgtcagtataaaaaattcataaagagatttggtctcttctttattatctcggtgcattatgtactatgcatggca

SEQ ID NO: 104553 - DNA, 416 bp, Triticum aestivum
  Clone ID: PAT_TA_104553
cgcctcgtcgctttttgcattgttgcactcacccctgctcatcctcgccctgcttgtgccaatcgtgtccttcgtcctcttcttcgccaagaaacctcagccttccggaagcaatggcggcccacgtctgcctccgtcgccgtggggccttcccatcctcggccacctccctcttctcggttccctgccgcaccggaagctccggtccctggccgaggcgcacggccccgtcatgctcctgcgcctcggcggcgtgcccaccgtcgtggcctcctcggcggacgcggcgctggaggtcatgaagacccacgacctggccttcgcgagccgccccgcggtgcgcatggcggagcgcctcctgtacggccgcgacatggccttcgccccctacggccagtactggcggcaggcgcgcc

SEQ ID NO: 104554 - DNA, 184 bp, Triticum aestivum
  Clone ID: PAT_TA_104554
cccctcgtgccgccgttgatcgctggcgacgacgccgtctcctactccgtagaataaaaccaagccagggtcttggacggtataaagaaggtcagacccctaccttagcacagtcacacggccagcaaccagggcgttctgggttcgattcccaggtgcgcgcccttttccttttatatgtttc

SEQ ID NO: 104555 - DNA, 264 bp, Triticum aestivum
  Clone ID: PAT_TA_104555
cccacacggggtgatgacaccagaggtagggcagcgcgccgggtcgaggacgtcgcggacagggcgagggcggcgtggcgaggagaggtagggaagcaaggcgggtcgaggatgtcgcggacaccaggggcgagggcggctggccgaggcaaggttcgtggcgtgatggcagcgttgatggtggaggtcgtggcgtggtggcggctttgatcatggaggttctgtttaattccccgggggtgtcatcgctgggctgtcaaatcc

SEQ ID NO: 104556 - DNA, 345 bp, Triticum aestivum
  unsure (1)..(345): unsure at all n locations
  Clone ID: PAT_TA_104556
cgaccgtcctgccgactactgctgcgttgagatgttgcaaggcttcgggtgtgtgacatttcctggctgatgtggtccaagggcaattatcaagtggtcggggttgcggaggagaatttgaggtttcagaataatctcccaccaccaccacgattcatatctggagaagctttgtggaatccgtggtgttgtgcgggtcgtactatggttgctggcctatggggaatcangatggacattgagcaaagtggcancaacgggtggcaggtgttgtggccgaggagctccagcacacacccacatgttcacttgttgacctggcagctcttcactgaggtttgctgc

SEQ ID NO: 104557 - DNA, 393 bp, Triticum aestivum
  unsure (1)..(393): unsure at all n locations
  Clone ID: PAT_TA_104557
gcagttcaaatggtgtatcctccgtttgtcataagttctgaggatcttatgatcaagatagatcatgatgggtttcatacgtgaaattttgcttaatggatgctccaagtttcctctgatcagcatacctatgggatacaggcctctgttttcccctggaactgctgaacttttgtttcctctgatgcaggagcaacactgggcggttgattgcatgagggaagggtctgacttcaattgcttcagggtagtagtacatgtttttctttctttgcgtanaagcgtagtacatggggtaaaacatgtcgagaactgaactttagtaccaaggacaacaaagttatctgaaaatactgtctagatggtcatagaacgccaaacagtaagaaaaac

SEQ ID NO: 104558 - DNA, 471 bp, Triticum aestivum
  Clone ID: PAT_TA_104558
gagaagtgaccttatgaattcaattatcggtactgctgtatctgaagataagaacatcagagccgcatcatttgaatgccttgttgcaatagcatccaaatattatatgcacttgaagccttatatctcaggcatattgaaactgacagctagagctatggaagatgatgaatcagtggcacttcaagctatcgagttctggtgtaatatttgcacttgtgaacaggttgaagtccaagaaacttatgcagaatttgatgatgctaattctgttgtgaactatcatttcattgaatcgacattccgtgaacttgttccaatgcttctaggaactctgttgaagcaagaggaagataaagagcaaaaaggtagtgtaaggaaagtttccacgagtggtatggtgtgccttggcctcattgctagaattcttggggatgaagttcttcctcatatggggaaattcattgatga

SEQ ID NO: 104559 - DNA, 307 bp, Triticum aestivum
  unsure (1)..(307): unsure at all n locations
  Clone ID: PAT_TA_104559
atccatgatgttgtgcttgttggtggttccaccagatccccagattcagcagctgctgcaggacttcttcaacgggaaggagctctgcaagagcatcaaccctgatgaagctgttgcctacggtgctgccgtccaggctgcaatcctcancggtgaggggaacgagagggtgcaggaccttctcctcctggatgtcaccccactgtctcttggtcttgagactgctggaggagtcatgactgtgctcatcaccaggaacaccaccatccccaccaagaaggagcaggtcttctccacctactccgac

SEQ ID NO: 104560 - DNA, 331 bp, Triticum aestivum
  unsure (1)..(331): unsure at all n locations
  Clone ID: PAT_TA_104560
gttgcggccaacgccgttcgaacgctggaagttgcaaccgtgtacgctggagctacaacgggcgactgggggagccgcaagcggggtggctgtattttgctgaacaattttctttttgctggaaccgatgtgtgggggggctggaaccganataaatttttgtttcattggctgcagaggggtcaaatgctcatgtcatttttgctggaacctaagtttggttttgctggaagcgttttttgattttgcttcaaccgaccaccagatttctttaggtacgatgcacatcgacaatggaggcccgtaaagacggcgacgccgtgctacgatg

SEQ ID NO: 104561 - DNA, 438 bp, Triticum aestivum
  Clone ID: PAT_TA_104561
ccagcaaagaacagagaattcaggaagaaatcgtgtaggtagttttcgatataatgatgtggactatagcaaacctactgtaagcaaaagatacggccatgcacatacagtttctgggaattatggtcatcggagtgatagtttggaggggggggaacctgaaacaattcgaatgcacagaggagaaaatgttcaacaggggaagtttgttagaagagattcaaatgctgtcgttgatgatagggctgctttcaagacttttgaggcattcactgatgtcaggaacagaccacgggctcttcaaatggaaatagaagagaggattcagaaattagctagtcggctcaatgctacagatgtaaatactccagagtggaaattctccaagatgattcatgatgcacagatcaaattcactgatcactctatcctaagggt

SEQ ID NO: 104562 - DNA, 135 bp, Triticum aestivum
  Clone ID: PAT_TA_104562
ggaggcaagcggctcggccgcggcaccaagatcacgctcttcctcaagacgaccagctcgagtacctcaaggagcgccgactcaaggacctcgtcaagaagcactcggagttcatcatctaccccatctacctct

SEQ ID NO: 104563 - DNA, 494 bp, Triticum aestivum
  Clone ID: PAT_TA_104563
gttcatgtcacaactcaacaaggcattaggtcatgtttcccctctagctatctgcatagatgcatgtaaaggtttagagaatgcagtcaaaaaatattccctcatgcagatcaaagggagtgttttaggcatctcatggctaacttctctaaaaagttccaaggagatgtgtttggcagaatgtggccagctgctagggcatatgagccataagtttttaactaccacatgaataaaatcctagcagaagcacctgatgtgcatgaatatctttcaaggtaccacaacttaaaatggatgagatgcatgtttgacccctccattaaatgtgattacatcaactataaccttgccgagtcttttaatggttggattaaagattacaaagatttgccacctgatgagctagctgacactcttagagagctagtcatgaaacttcatgagaaaaggagaaagattggaatgaaactgaaaggaaaaattattccagc

SEQ ID NO: 104564 - DNA, 150 bp, Triticum aestivum
  Clone ID: PAT_TA_104564
gctatggatgccgtggtggggggggggggagggttcctgggatgatgagaagatccacctaacatgcgagtggcaatgctccaggacaagcagccggcgatggcataccttcacagaatggagtacggcgtaggtgttcaagggttgtat

SEQ ID NO: 104565 - DNA, 378 bp, Triticum aestivum
  Clone ID: PAT_TA_104565
gcgccgccgactccgcctccgccgacgcagcagcccacctcggacaattcttcttcccctactactcgtatctaccgggaggcgtcggtggagatctcccatccggttcctgagagagcaaaatcaaaaacagaagatcatccaacgaatgtaagggtcctccactgccggggggctggcggtctttcgatttttcttctatgcaaatttgctaagatccatctataagagatggcggaccagattgcaaggaccctgcttaatagatggctgagcagctacagaaagtgctcagactgagagaacaggatgcctcttggatcctataatacatggaaacaatgcaaaagtatggaaaaccctattatgacaatggca

SEQ ID NO: 104566 - DNA, 396 bp, Triticum aestivum
  Clone ID: PAT_TA_104566
ccgctccacccagtcgcgggcgtaccagccgcctccccgagccgttcgagcacaggcctcctcgcagaggcacctgttgccgcccccgccgccgccaagcacgagacgtctccttgttgtgggcctgctcacgggcgaacacagggaagcgtggggggggtgaagaggggcgcagggggagacaggggcatgacggagaggcaggacgaccacttggtcgccggtcgccatcggtgtcatctgccaggagagggagcagaacaggctgtttctagctaaatccaacgaattggtgcaatatcacgtcatggaggggagtaagaacatgcaagagtcacacactgcatctgttgtcaaagtgtccagggagcctgttatcattatcaatggtgtccc

SEQ ID NO: 104567 - DNA, 138 bp, Triticum aestivum
  Clone ID: PAT_TA_104567
ggggggaggtaaacaaacaggagcgccgcgtccgcgacagcgatgagcgacgacccaggttctcctctcccatggcaggggtcggcgagtggcaacagatgcgggacaccaactggtggcgcaacggacagcgagagg

SEQ ID NO: 104568 - DNA, 175 bp, Triticum aestivum
  Clone ID: PAT_TA_104568
cctcggccattctagccaccatgccggctcctgcgccttcggtcagttcgagactccttcagcttggcctctttcaaggcctacatcgctgagttcatctccaccctcatcttctcttcccggcgtcgcttgccatcgcctacactaagtgagcggcggcgcgccccttgaccca

SEQ ID NO: 104569 - DNA, 271 bp, Triticum aestivum
  Clone ID: PAT_TA_104569
gcctctgttcaccattttggcacctttctggctgaagctattagagattatctctctttttcaacatgaaactattaggaacttgagaactgtttccatgattgaactttgaagttttcttaagttctgatgttctgtacatgatattttgcaggatagattttattttgcttttcacattttggtgccttgctgaaagctagatgggggactatgttgcagttttcttaaattctgatgttctgtgcacgagttggatcacttctgctag

SEQ ID NO: 104570 - DNA, 257 bp, Triticum aestivum
  Clone ID: PAT_TA_104570
tggacgaccatgtgagtgaagccccactctcacctacttgcccttttcagcaaattgttccactaatacaagaattttgggacggagggagtacgaaactgcttccagacgaactgatacttagtgcacagttttgttatgtcctcttgttctggggagtctgaactgatcaggtgtggggtgtaaccaatcatagaattaacagcttcaatgatgctaactaacatagtggcgcattatcgataggcttttttttt

SEQ ID NO: 104571 - DNA, 185 bp, Triticum aestivum
  Clone ID: PAT_TA_104571
cgtgcgtgcgtgctctcgtcgaccgacctctggccatgggtgctcttcgacgtcaacaatggctcaatgccgcatttgtgctcgccgtgctgctcctcgcccaggcggaggcgcgcggggtgacgagcgcgtaccggcggaggctggaggcggccgaggacatgccgctggacgccgacgtcttc

SEQ ID NO: 104572 - DNA, 512 bp, Triticum aestivum
  Clone ID: PAT_TA_104572
cgcatacgctgccaccgccacttctgccatcagaaacccccgcgtcttctccttctccaccgccaacgcgtcgccgcgccgcctccccgtcggcgtccgcaaaaagcccctgcgggtggttgtcaccggcggcgccggcttcgtcggcagccacctcgtggacaagctcctcgcccgcggggacagcgtcatcgtcgtcgacaacttcttcacgggccgcaaggaaaacgtcgcgcaccacctcgccaaccctcgcttcgagctcatccgccacgatgtcgtcgagcccatcctcctcgaggtcgaccagatctaccacctcgcctgccccgcctcccccgtccactacaaattcaacccaatcaagaccatcataacctttttttccatttccactgtaaatgttcgagtttgtttgcttttatgtattcagttgcgtatatagaaaggattgcttaaatactagtaggtcaataatggcataggaaaattgaaatgttgtgcctgcattg

SEQ ID NO: 104573 - DNA, 327 bp, Triticum aestivum
  Clone ID: PAT_TA_104573
aagaagacccggatctcgccgcgccacatccagctcgccgtccgcaacgacgaggagctcagccggctgctcggcggcgtcaccatcgccgccggcggcgtcctgcccaacatccactccgtgctcctccccaagaaagccggcaagggcgccggcaccggcgggtccgcttcgcagtcccaggagttctagagtaccagagatctgagtatggcgtggtgatggttttaggttggtagattagttcttggccaatgttcttgttggtacatgtatcgagggtggatctggttggaatggaatgcatctggttctgctgtctgtgat

SEQ ID NO: 104574 - DNA, 270 bp, Triticum aestivum
  Clone ID: PAT_TA_104574
ctttgtccgatggaggcgaccgactttgctccatctcgagctgcttgttctctcctctcccctgacgaccagcgcaggagatagaagataagagaggagggaaagggagagggagagagagaaggaaggagaggagggagaaagagagaggaaagagaagagggaggtacgatggcggacggtgtaggttcaccggccggcaccggcgaggtcgggcgtggtctcccggtcggtggtggctcaatccgctcctggatcgggggcctcccg

SEQ ID NO: 104575 - DNA, 284 bp, Triticum aestivum
  Clone ID: PAT_TA_104575
ccccggccgcatattcccccgccgcccatgcctcaccccccctctcgtcgccgccgccagcctccgctgccgcctactcctctcctcgccgctcgcctcctcccgcacccgctgcttcctcccacgcgccatggagtcctcctcctccaccgccgccgccgctgcggagcacgcaggtggcgcggcggcgggggagtacgaggaggtgctggcccggctctcctcgctcatcacgcagaaagtgcgcgcggacaccggcaaccgcggcaaccagtgggacctca

SEQ ID NO: 104576 - DNA, 627 bp, Triticum aestivum
  Clone ID: PAT_TA_104576
aaaacaagcctcaccacttctccctcatcacagttacacccgtgctctatttgctatactaccacaccacactccccttgagttgtctctcaccacaccacctcacaccacggcagcagtgtgagtgcgtagatcccaaaggcagcggcgaaaacggccacacgcgatggaaaatctggcagttctcaaggagctgacggtccgcacacctcagcactccaagcgccttctcacgcttaattcgttggagaagttggaaatcagtaagtgtgaaaatataacacggctggcggtgggggtgcatgtgcaacagctggagcaggggcaagaagaagatgggttgctgctcatcccagcccatctctgcgactcgctgcaggagttggtcatttacaaatgcccaaatctagttttgatggacccattgagttttcttccggccgatggagaagggttccaagccctgcggttcctccagaggttaaaaatttcagaatgccccaacttgttatcccccggctcgttttcccggtatcttttcccgtcctctctgcagaaactctttcttcacggtgtggaaggcatggggacactggagcccctctcaaacctcacctctctcatgcg

SEQ ID NO: 104577 - DNA, 385 bp, Triticum aestivum
  Clone ID: PAT_TA_104577
gcggcggactggggcacctactggtgttcgccttcctcttctgcgtgggcgccttcatggtggcgccggtgatcaccgacgtgaccatggcggcgctctgccccggccaagaccagtgctccctcgccatctacctcaccggcctgcagcaagccatcaccgggctgggtgcgctggtggtcacgccggtcatcggcaacctctccgatagatacggccgcaaggcgctgctcgctctcccggcgaccctgtccatcgttccactggccatcatggcttttaaccagacgaggccatacttctacgccttctacatcgccaagacgctgacggcgatggtctccgagggcgccatgatgtgcctctcgctcgcctacgtggccga

SEQ ID NO: 104578 - DNA, 612 bp, Triticum aestivum
  Clone ID: PAT_TA_104578
gcatacgccgtcagccaagagcagggaggccgatgcccagctgccggagcgcaagaggaagaccgcgccatcagcagatctgccccagaagaaaggcaagacgacatcgacgccggcggccgagcccgacaagaagcctcttcctctcccgtccgagcacgcgtggacgcccggcgacgaggtcaaaatactcgaggccctggcggcgcatcgccaggagcacggcaagctgccgagaaccaaggtgctcttctcctccctccaactccaaggccgcctcgacaacaacggcttcagcatgccggacctccggcagaaggtgcgcagtctcaagggccggcacgaccacgaggccatcaacgccgtccctgccaaagaaagtgaatgcagcctctgccacctctccaagaccgtctggggcaccattgctaggagcggtggtgaagcaagcgcaaaagtaccaaatgcgggcaacatgttcgatgaaatgtgccagttgtatccttgcctcactgatgaggtgacgcacattgtcgatgaacccgcagtcttggagagactgctcttggactttgatggtaccaaggcacgtgcattggactccaaaatcgt

SEQ ID NO: 104579 - DNA, 444 bp, Triticum aestivum
  Clone ID: PAT_TA_104579
gttgacttcatcttcgggtctgcatgatcgttgtatgaagactgtagtatcatctctaataacaaggatatcaccgacatggaagtggcacaagagggccgggccagcgagagccgtatcaacagtgagagcagtttctccttcaagaattgcaccatcaagggtgaggggaaaccagtattcttaggaagggcatgggggaacttctcgcaggttgtgtactcttccactgagatggacagtgaaatcgttcccatcagatggggaaaggggaatatgcaaaaaaaacatgaaaaggggattatgcaaaagcctaagaggcacttatatccctttccccatccgacgacgggcatgtgtacggtttcacttttgtttctccgccctcgacatccgcaccgagcccctctccctctaccatctcttcgccctcatgtccagctt

SEQ ID NO: 104580 - DNA, 455 bp, Triticum aestivum
  Clone ID: PAT_TA_104580
gtgctccgctcctgcgccgcgctcgtcgagtcgctcgacacgcccggcgcgtcgctggacgtggcggccaaggtggagcagttcatcctgcggccgagggcggagcgcctggtcaccggcggcgagaagctgcccccgtggcggtccacgttcgcgtcggccgggctcacgccgctgcagctcagcaatgccgcggaggcgcaggccgagtgcctgctccggcgcacggccaaccatggcttccacgtcgagaagcagcaggcggcgctggcgctctggtggcagcggtcggagctggtgtcggtgtcggcatggcggtgctgatccatccccttgcttgcagagcctgagcagcccggtacagttgtagttcatcttgttgccaaaacttgaatctttctcaagtattactactgtagtagccaatcttggtgtgtgatatattacttactact

SEQ ID NO: 104581 - DNA, 559 bp, Triticum aestivum
  Clone ID: PAT_TA_104581
gtcgtccccctctcgcccaccctctccttcgctcgcgatggggtccgcggcgtcgaccgacagggccgagcggcggaggcgggaccgggcgccggggcacagcggggcctccgatcccccggcggcgcctccgcaggatccttcggcgtcggcgtcggcatcggaggtggatgtgagcagaaaggggtgtaaggtggcgccagagcccaaggatggggaagagacggcgccgctgccgggctctcccagcttccggatctactgccagaaggcggcccgggtcgacgctctggtggcagaggaagccgatgaaaacgcggacgacgacgggtttgccagtgccgaggacactactatggcggtcaggaaggacgatcctccacactgctccggcgacgccctactccttgcagacactactctggcggtcaggaagaacgatcctccacactgctccggcgacgccctactccttgcagacactactctggcggtcaggaagaacgatcctccacaatgctccggcgagttgcccaaatgtaaggatgggtggctgaag

SEQ ID NO: 104582 - DNA, 507 bp, Triticum aestivum
  Clone ID: PAT_TA_104582
cccaggcgaggagctagcgtttcccgcaccgatcgatggccgtcgccgaaatgtgccgccctcgccgtcgccgcagacgccgccgacgccgccaccgccgccgcggatcgtcgtcgcggcgctggcgctcatgcgctctgccctcgtgccgatgctggcggtccggcgcgccctccgcatcgcggccagggtcttcccctacgtggcattcgcgctcgcgtgggccatctccgcggcctcggctgccaagatcgtggcgcgccgcgcctggggcgagggctccgcccccttcctcttcctccgggcgctcacgtccgctgcctgcaaggtctgcacctacggcttcctcgtcctactcgtgctcgccgtcctgctgttgtgcggcctgtgcgtggcgtacgtaatcgcacttctatctggacgcggtacagaattcaagaagcgtgccctgggagcaatcacgtgggattcggttgcgaactcgtttaggctaccccgcatggcggt

SEQ ID NO: 104583 - DNA, 486 bp, Triticum aestivum
  Clone ID: PAT_TA_104583
tgcccggcaacactgcggcaagcgcgccgccggtggccggatcgtcctcggcctcgctgcagctggttgtgtcgggacagcagggtaacccgggtgagcagccgccgcggccgttagtgtcgatgaccgagcgcgcccggatggcccgcgtgccgctgccggagcccggcacgctccggtgcccgcgctgcgactcggccaacaccaagttctgctacttcaacaactactcgctctcgcagccgcgccacttctgcaaggcctgccgccgctactggacgcggggcggcgccctccgcaacgtccccgtcggcggcggctgccgccgcaacaccaagcgctccagcaagaagtcgtcgcgccagggccagggccagggcggcggcggtgccgtcgcggccgccacgtcgtcctcctccaccacctccacctcgaccaccacaagcgccgccgcggcgaccgcggccgacgtcatcgccagcatgc

SEQ ID NO: 104584 - DNA, 553 bp, Triticum aestivum
  Clone ID: PAT_TA_104584
ttcgacaagtttgtgaaccatctcatttccctccgtggccatttacctcttgtcagctgcgagatccaagcctatccaaccagtgatgattatgctggtgaacctgatgaacccttgccaaacatatactttgattcgtggatccaatatgctctattgtgcaaggttcaggttctcaaaatcattggtgatgatgtgggagcggaaactgagctcatcgtgcctctcatctcccagcacctgaggagcctggaagttcatcatgttctggtggaaaaggattttgttgatttttcaagctgtccaatgttagaagaactgaagatgcagcactgtggcctttgggtgcgcaagatgtcgtttccatcgctaaagcgtttgtggcttactgaatgcaacttccctgaggcgtatcgtgtttgtatttctgcacccagtcttgtttcactgcgtctgcatgacagtggaggcaagactcctttgcttgaaagcatgccattgcttgatacagcgtcccttgacctttctggtcgatgcaatgataagtgtcggg

SEQ ID NO: 104585 - DNA, 346 bp, Triticum aestivum
  Clone ID: PAT_TA_104585
gccgtctccgccctcctcgacctcatctccgcgctctccgccttcgtcgcctccaccccgccgttcccgcacagctcccgctacgggaaccccgccttccgcctctggcacgagaagctcggcgactccgtcaacgagctgatcgcccccatcacagccaccgccacgtccccctcggacctggccggcgccgaggtcgagctcgcgccgtacctcctcgactccttcggcaacggcacccgcatcgactacggcacggggcacgagaccaacttcgccgccttcctctactgcctggcccggctcgggctcatcaccgagcccgattaccccgccgtcgtgctac

SEQ ID NO: 104586 - DNA, 353 bp, Triticum aestivum
  Clone ID: PAT_TA_104586
ggcgtcctcgtgtcgggctcgtgcgggtgccagcgcgtggtccgtcgcgcgggctgcgctagtgctcgggagctcccaacctccggcggggcagcggatccggggcccccgcgcccggatctggtgtggtgctgagtgcgcggccgcaaggggcggcgtctgccggagcggcagcttgcggatctggcaggggcggcggcgggtctgcacggctcttcgacgtgtggctcgatgtgcgcgcgagggtgcagtggctgatgttgggaggcacggagcaaagggtgcaggtgtggtggatctgaggcttccggtctccggcaggcttgtttgcattggcgcgtctggttcatggc

SEQ ID NO: 104587 - DNA, 487 bp, Triticum aestivum
  Clone ID: PAT_TA_104587
gcagcccgcacgacccctgcagcagctcactcatcgataagtttaaagcgacacgtgatatgcccgccgtgaccatgccggcgtcagcgcccgcggataaaggcaccaaaggtgacggggacgacggcggccagaccaagaaacaggacaacagcaaggagggtgccgtcatggctgcgcccaaggaccagaaccagaccggcgtgcagcatggtctggaggagatcgagaagttcatcggcaacacccccatcatgaagcacctaatgcggcgcggcccgagccagcaccaccagcccatgccgccggctgcagctgcggcaccgcccaagggcgacaagtcggcgggcaagaagaagggcggatggctcaagaacatcaagtcggtcgccaccaccatcggcttcatccaagacaatggcaagccggtccccgccagcatggccacaggcgcagcccccagtacgggccccgccagtgcagccgt

SEQ ID NO: 104588 - DNA, 531 bp, Triticum aestivum
  Clone ID: PAT_TA_104588
gccacacacatgatgcaaaattaacaaccaggactttgaaatatggatgacgatgtttattatgtgctagaaatcaaatatgaaaaggagaagataatgcttgcgaaggtgtgtatactgaacaagcaccttgactgttgttccttgatgtgctctcatgcagctgtgtccatatatactggttgttatacttgttgtcctgcgagttgcaggagaggggagagacatatgggttgggattctgggtaaactttactttatttgttgcagaaaatgctcgatagatctcatgtatggatgcggttgtggcagtagttctcgggtgcagtctctatcttgataaagcgatcgatcagtgcgcattagaggctgaagaagagaaaacatttggggtttctatggcgttgaacattcagcgtttatgtactgtgtacatgcatggccggttcagtaactagatggccttttctactgtagtggttctgctacttttcacatgctggcttctttgaaaagcacccaacagtgtgt

SEQ ID NO: 104589 - DNA, 493 bp, Triticum aestivum
  Clone ID: PAT_TA_104589
tgtgatgtaattggaatattttcaattgcaaatcattccctaatattatggttataagtctttttttcgtcctgatgttctcaatatttctagataaccatgttttgttggacttattgataaagtaaattttctggtacaagtttggctccaaggaaagttattgtatttactaatatttttttaatttaacaccatgactatgcctcgatattacaattgtcgtaatggtgtggattgctatataaagttctatgtttgaagggatgtgttgtcagaaattctcatacacgattctttagtaggaagggaatttcagtccttcaaaagtgaagatgatcatgcctttctgttggatttggttttttggtttaagcaatcattcaggttattgaaacacccgtgtgcctcttttcttgtctgatatgaggaaaatggtttagagtaattaccggcaggaggatcgctgggtggtagctgagtgggagggttc

SEQ ID NO: 104590 - DNA, 350 bp, Triticum aestivum
  Clone ID: PAT_TA_104590
cggcacaaggccccgatcccatccctcccctcgtctctccttgctgtctcacccgatggagagagagcgaacgagagctcgcctcctcccttccagatcaccgccgccgcctccctccgacggagctcaccgccgtccatggccttccccacgccctccttctctcgcccctcctcttccctcaccagaagggagagaagaacccgagggagggagatccaacgcgatccagcctcggtccacacttgggaaccaatgctgaatacgtctgaatggagaacgcccgccctcgcctcgctcctccggcccgcccaccaacctacccgggccccgatccgcgcggagggggg

SEQ ID NO: 104591 - DNA, 246 bp, Triticum aestivum
  unsure (1)..(246): unsure at all n locations
  Clone ID: PAT_TA_104591
ggcgacgtcgacgtcgccgtcgacggcgaggagctggtcccggcgctggtctcgctggagccggtgtacggcgcggggtcggcgctcgacgaggcccgcctccgcttcgcccgcctcgccgaccgcttccgcgccctctacgccgccggggccgccctcttcgcccgctccccaggtgcgtccgtcggttggttggctggttngcgtggcggcgccggcgatttgggagtggttgattggctgact

SEQ ID NO: 104592 - DNA, 360 bp, Triticum aestivum
  unsure (1)..(360): unsure at all n locations
  Clone ID: PAT_TA_104592
tgcaccgggacttcgacgacggatgggtggtggagctagcgctggaccgggagacggggtccaggctggagtccaaggaccggtacctcttcgggcggttcgatctcgacatcaggctcgttgccggcatgtccgccgggacccgggaccatcgcttccttcaacgtaagtgtacatggatctctctggtcgactgcagtttcgttctcgtttctgactgcctaattaaccggcatctccgcacaactcgcccctgctatggcggcggtgctgccgaacatcaccagcctcctctgatgagggaggtggctcggcccanccatggccctggcacttgccatgggagagtagggcggcacc

SEQ ID NO: 104593 - DNA, 539 bp, Triticum aestivum
  Clone ID: PAT_TA_104593
tttggttatgcccttattatttggtctagaggtatgcaatgacaaccatggctttagtattcaggtgagtttcatttatagactgaagaatccttggcatattatccaaactctttcatcctagatattatgtctgcccagttaagtaccttataccagtgccttaattagcctcttccggctattgactgtatgaattgttctattaggactcagtttttcaaagttattaggatgtgggcatgtttttactttagtttgtatagttttgtgttcttttggcttcaggttactgctgcacagaaagtacagctaactcagatgatgcatggaaaaaactgcagatctagcatagtttttgtattcagattttgtaactaattgtgtgatgaccttatgttaaaatgcttatttgttctccaactaggccaacaacgactgctagcaatgatatatacatatcaacaattctaaggaagtgcatgtgtccggatgcatatcatgatatatatatatgtgtgtgtgcttgagcatgtgac

SEQ ID NO: 104594 - DNA, 405 bp, Triticum aestivum
  Clone ID: PAT_TA_104594
ctgtggcgagttcaatgattggcttgttcatatcagaaggatgtccaagcagatcgggcaggtctcgataagtcacgcctctttggctcgccaaaaagaggaggaaatgcgtgcgcggcagagagaggctgaagggcatggccatactggaccagatcagcacatgtataccttggatgcagagaatacagatgaggaaacagcactagattttgatctcacacctgtttatcgaacgcatcacatccatgtctgcctcggtattggagagaagttcagagattattactacaagaacaggcaaatgcaactcagcctggatatgcaaatttccacttcgcaaccgttcctcgagtctcatcagccctttcttgcacaggtagctgggtttttttattgttgaac

SEQ ID NO: 104595 - DNA, 573 bp, Triticum aestivum
  unsure (1)..(573): unsure at all n locations
  Clone ID: PAT_TA_104595
cgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccanatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctca

SEQ ID NO: 104596 - DNA, 570 bp, Triticum aestivum
  Clone ID: PAT_TA_104596
cagtggcgccggttcctcgccttccgaggcatgcaggctgagcttttcctccctctggtcaacgcaagacggaacgctaaccgtcatctcatgctcagcggtggcctgccggcatatctagaccacctcctcgacgcccgcgtccccgtcgacgacgacacagccgacggcaaggccctgcgccctctcacagacgacgagctggtgagccttctctcggagttcctcggtgctgggccagggaccgtggtatccagcatggagtggaccctcgcccacctcgtgctccagccggaggtccagaacaacatccgacgcgaggtccacgccgtggagggcgcattgtccgagacacgcgtccggcagatgaagtacatgcacgccgtcgtgctagagagccttcggctccacccgccgattccggtgttgctgcgcgacgtgcctgatcaggcggtcgccgaaatcctgggatgcgccgccgccgccgtgccgacggaggggatgcgggcgcacttcaacctgggagagatcggcagggacaagaatgcgtggacggacccggacgcgttc

SEQ ID NO: 104597 - DNA, 605 bp, Triticum aestivum
  Clone ID: PAT_TA_104597
aaatagtgaactttgtagttaaaccaaacaggttttctgccctgaaggaaacttctgtcaaggattaccaaaattttaacttcagccaaccatactctcaagcttcgtattatctctcattaatattggaagagaaaaaatggcctttggcagagaaacttcaagctctttctaagcttgagtcagattctcttgcgaagtttgtgccgcacttgctatcgaagacgtacttggaatgctatgttcaaggaaacattgagccaggtgaggctgagtctattgtccaggagatcgaagatactatatttaatacccccaattctgtattcaaacccatgtctccatcacaatacctggtcaagagggttatcatgcttgaaaaagagataaaatgttgctaccaaattgagggattaaatcagaagaatgagaattcatcggttgtccaatatattcaggtccatcaggacgacgccctctcaaatatcaaactcgagttgttctctctaatttctagtcagcctgctttcaaccagctgcggactgttgagcaacttgggtatataacatatctttctctgagatctgatcgtggagtctgggca

SEQ ID NO: 104598 - DNA, 529 bp, Triticum aestivum
  Clone ID: PAT_TA_104598
gccaacaccctccgctccgaggagagggcgacatcgtgtccctcaaaaactacatgaacgcgcagtacttcggggagatcggcgtcggcacgccgccccagaagttcaccgtcatcttcgacaccggcagctccaacctctgggtgccctccgccaagtgctacttctcgattgcgtgctacctccacgcacgctacaaggccggggcgtccagcacctacaagaagaatggaaagcctgctgccattcagtacggcactggttcaattgctggatatttcagtgaggatagtgttacagtgggtgatctagttgtgaaattatttttggaggaatggatcctaaacactacgtgggtgaacacacatatgtcccagtcacccagaagggatattggcagtttgacatgggtgatgtcctggttggagggaagtccacaggattctgtgctggcggttgtgctgcaattgctgattctggaacttcactgcttgctggccccacggccatcattactgaaattaacgag

SEQ ID NO: 104599 - DNA, 189 bp, Triticum aestivum
  Clone ID: PAT_TA_104599
gcccggggaaaggaggaacgggcagtgatggcggcgccgataccccgtgagtgggttggtctgcagcagttcccggcggccacccagaccaagctgcacgagctcctcggcaagctcaaggaggagaatgtgagcacattgacgattctggtgatggggaagggcggtgtggggaagtcatccactgtc

SEQ ID NO: 104600 - DNA, 617 bp, Triticum aestivum
  Clone ID: PAT_TA_104600
acctccacgggcagttctacgagggccggctcggcaccaacgtgtcggcggaggtgtacggggaggtggccaagatcgacacgaacgcgacgctgttcatgaacgagtacggcacgcttgagtcggccttggacctgaccgccatggccagcaagtacgccgccaagatggagcagatccgctcctaccccggaaacgccggcatcaggctcgccgtcgggctcgagagccacttcgagacgcccaacctcccgtacatgagggcgacgctggacatgctcgcgcagctcaaggtccccatctggctcaccgagatcgacgtctcgcccaagactgggccgtaccaggcggagtacctggaggacgtgctgagggaaggctacggccaccccaacgtggagggcatggtgctctgggcggcatggcacaagcacggctgctgggtcatgtgcctcacggacaacaacttcacgaacctcccaaccggcaacgtcgtcgacaagctcatcgccgagtggaagacgcaccccgtggccgccaggacggacgccaatggcgtggccgagctgaaccttgtccatggcgagtacaagttcacggtgactcacccgtcgctg

SEQ ID NO: 104601 - DNA, 198 bp, Triticum aestivum
  Clone ID: PAT_TA_104601
gtccccacgtcatgttcgtgacggcggatccggccggcgctggcgccggcgaccgtttccgtggcggctggtccttctggaatatgcagaggaaccagagcctcttggccgcctcgacctccaccaactggggcctctcaacctccaccacgaagaacgagggctactccatctggacctccgcgggcggggagtggc

SEQ ID NO: 104602 - DNA, 434 bp, Triticum aestivum
  Clone ID: PAT_TA_104602
acttctccaggctgcagcagcagcccgctccacgtcctcatcttcctcctcctcctcatcatcatgctgctgcctaccatgaccacgacgactccacggcaccagcgccggacgccggccccggagatcttggcagcgaggaggagaagcgagacgaggagccggcagcgtcagcgccctctccccttcgtgctgctgctgcttaccatgaccccgacgactcaacggcgccagcgccggacgccggctcgggagatgtcggcagcgaggaggaggagcaagacgaggagctggcagcgtcggcgcccgcgcccgctccggcatcggacggcgacggcgacggagagggaagggagtgcgacctgttcgacgggagctgggtgcgcgacccggcgaggtacccgctgtacgaggcggcggagtgcccgttcctc

SEQ ID NO: 104603 - DNA, 542 bp, Triticum aestivum
  Clone ID: PAT_TA_104603
ctcctcctcccctccggcgcatcgacgacatggcccgcaccaagcagacggcgaggaagtcgaccggcggcaaggcgccgaggaagcagctggcgaccaaggccgctcgcaagtccgccccggccaccggcggcgtgaagaagccccaccgcttccgccccggcaccgtggcgctccgcgagatccgcaagtaccagaagagcacggagctgctcatccgcaagctccccttccagcgcctagtgcgcgagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgcacctgcaatccgtgttaggctgagttcatcggtggaaaatagtggtgtttcagaatgtgcgtcgtgttagatccatgttagatccctgttcctc

SEQ ID NO: 104604 - DNA, 540 bp, Triticum aestivum
  Clone ID: PAT_TA_104604
aattctgaatcactctcaacaaagtattgctctggagaggatgctgacgctgatgctggtctaaactctgatgtgtatcaacttatccacgagttactgttgcacatacaccgaagtgatccagaccttgaaaatagtattttggttttccttcctacatactatgcattggagcagcagtggatccgtctgtcgtctgttaggtcggttttcaaggtgcacattcttcatcgtagcattgacactgatgaagcacttcaaactatgaaggtttcaaagtcttgccgaaaggttatactggcaacaaacattgccgaatcatctgtcactattcctggagtggcttatgttattgattcctgtagatcattgcaagtctattgggatccaatcaggaaaacagactcagctgggcttgtatgggcttccaagtctcaggctgagcagcggaaaggcaggacaggacgtacctgtgatggtcaaatttatcgcctggtgactggaccattttacaacagtttagatgatcatgaacatcct

SEQ ID NO: 104605 - DNA, 546 bp, Triticum aestivum
  Clone ID: PAT_TA_104605
tagcaagcaaccatggcttgtgaagaaccatcgaagatagtcaacataccctcgattgtgcaagagctggtgacttgtgtacaggagccaccaagccagtatgtggttcctgagcaaaaccgcccgggcgtggcctgttccgagatgcctgagccgatcccaatcattgatctcagccgtctgcctgcccctgggaacagctctgatgaggttgccaagatgcagtccgccttggagaactggggcctcttcctggctgttggacatggaatagagccaagttttcttagtgaggtgatgaaagtgacaaaagaattttacaagctcccactggaagagaagcagaagtactcaaacttggtcgatggcgaggagttccgtatggaaggatacgggaacgacatagtcgtatcagagaagaagaccctggactggagtgaccggttgtaccttgtagtggaaccggagtcccggagaatctatagcttgtggcccgcgcatcctccttctttcagagatattatgtgcgagtacacagtaaggtgc

SEQ ID NO: 104606 - DNA, 517 bp, Triticum aestivum
  Clone ID: PAT_TA_104606
cgccgcgcagctggctagggtgatcattgggattgtggaggcttgccattctcttggggtcatgcacagagacctcaagccagagaatttcttgtttgtcaaccaaaaggaggactcgccactcaagaccattgatttcgggctctctatctttttcaaaccaggtggaatttattcagatgtcgttggaagtccttactatgtcgcccctgaggttctgctgaaacagtatggctgcgaagtggatgtttggagtgccggagtaataatttatatcttgttgagcggggtccctccattctgggatgaatctgagcaagggatatttgaacaagttttgcaaggtgatcttgatttttcatccgagccctggcccagtatctcaaagagtgcaaaggatttggttaggaaaatgctgaaccgtgatcccggaaagagattgactgcacatgaagctctatgtcatccttgggtttgtgttgatggagttgctcctgacaagccacttgattctgct

SEQ ID NO: 104607 - DNA, 474 bp, Triticum aestivum
  Clone ID: PAT_TA_104607
ggtctcttgcaacaatgccgttggcggcatccacagcgcgcttcttgctgctcagcgtgctgctgctgtcgtcgccggcggtgacggtggtgcgggcgcgggtgacggcgctgatcgtgttcggcgactcgacggtggacgcggggaacaacaacgccgtgcccacggcggtgcggagcaacttcccgccctacggccgggacttcccgggcggccgcgccacgggccggttctgcaacggccgcgtcgccaccgacttctactccgaggcgttcgggctccggcccttcgttccggcctacctcgacccggactacggcatccaggacttcgccgtcggcgtctgcttcgcgtccgccggctccggcctcgacgtcgccaccgccggcgtcttctcagtgataccattgtcgaagcaagtggactatttcagagactacaaagcccggcttgcggagcacctcggcgcggcgg

SEQ ID NO: 104608 - DNA, 505 bp, Triticum aestivum
  Clone ID: PAT_TA_104608
caggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatgggtatgctctaatcttgtaacagaattaattgtatcctatgtgaattcacattctgcaaagattgttaacgtcacttgattgccgatatcttcatttttgtctattagacatcatttccattcccaagactggtgagaactacaggcttctgtatgacaccaagggccgcttccgccttcactctg

SEQ ID NO: 104609 - DNA, 567 bp, Triticum aestivum
  Clone ID: PAT_TA_104609
cgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtgttcaacgctgttggaggtggaactggctctggccttggctcgcttctcctggagcgc

SEQ ID NO: 104610 - DNA, 485 bp, Triticum aestivum
  Clone ID: PAT_TA_104610
tccagcaaacctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctc

SEQ ID NO: 104611 - DNA, 574 bp, Triticum aestivum
  Clone ID: PAT_TA_104611
gatcttttcatttcatagatcatatcaattgttgattcaaagtcacccgataaaattattttttttccttttttatttatgaaatgaattttttcctatgctgaaacttctttaatatgattgatttttcccttgtgaatcatagtgaaacttctttttggtgtcttattgattttattaacaagtctcgcttaatttttttttcaacatttttttgtaagtttattaattatttttaaaaaatttaatgtgtgttgagcattttagcatccgagttttggttttaaaagtgttttaatttttttcccaaaatgaatctattttcgttcataacttcataacttttcaatttttttctgtaatttaattatgtgcatcttttataagcaatactgcattttatttatggattttgtgataataattagtgctgtgagattcctgtattttttctatgttaatatcgatagccaaagagtcccgttgaatcagttttgaaagcaggccgttcgttcactgctttgagattcgtgttaagtttcttgttttcttagtgtgcacgtttggcccattt

SEQ ID NO: 104612 - DNA, 588 bp, Triticum aestivum
  Clone ID: PAT_TA_104612
gacctttctttgcggagtgcttagatggtggttatgttaaggatgttgtcttctacaagcagcaagcaaaattagtcaccttgcctctcttgcacttagcattgtctaattagacttttcaaaatgattatccaggactgcttggcctctcgtttcgattagcctatcatttaagttggaaacaccagaattgacgcttgcgtatgagtaggtaccaactctcttctttactctttcatggtgaatccatttttattatcccctgtttgatagttttttctcctcttgacccaaataaagagatttgatgtgatgattgaggtagaaggctagctgaacatattgatcaaatgtctgctgatgtactttattattctttgttttttgtatggtgaccgtgagctctataggtagaggagcagaggacataaaggtgcatagctattttgtcactactaatatatatgactaattaatgcccacaaagttttaatgagataataatgagagattatcaaagaacagagctctctggtacttcatatatgtgatccttttagcagcccacaagatgtctctggacatgct

SEQ ID NO: 104613 - DNA, 553 bp, Triticum aestivum
  Clone ID: PAT_TA_104613
tcttcctcaccaccgccgtgctcatgctcgtctggctcctccgcttccgcggcggcatcaacatacagtccgacgaccctgagcagatcttcaacgtccatccctttgtgatgacatgggggttcattcttctcatcggcgaagccatactggtgtacacgacgatcccgatgaaccaccgggcgcagaagatggtgcacatgctggtgcacctggtggccttcatcctcggcgtcttcggcatctacgcggccttcaagttccacaacgtggccgtggtgccggacctgctcagcctccactcctggatcggcatcggcgccatctccctcttcgcgctgcagtggctcatcggcttcgccgtcttctggatgcccggcacgcacgagcacacgcgcgccgccgcggcccccgtgcacgtcgcgggagggctcgtcatcttcctcctggccgtgtgcgccgcgcagacggggctcgtccagaagagcgccagcgccacgcccggcaccgaggccaggctcatcaacgtcaccggcctcttcatcgtcttcta

SEQ ID NO: 104614 - DNA, 512 bp, Triticum aestivum
  Clone ID: PAT_TA_104614
gctcctccgtcaagtggatttgaccggcgggtactacgacgccggcgacaacgtcaagttcgggttcccgctggcgttcagctcgacgatgctggcgtggagcgtgctggagttcggcggcatgatgaagggcgagctgcagcacgcccgggacgccgtccgctggggcgccgactacctcctcaaggccaccgcccaccccgacaccgtctacgtccaggttggggacgcgggcaaggaccacgcgtgctgggagcggccggaggacatggacacgccgcgcaccgtgtacaaggtcgaccccagcacccccggctccgacgtcgccgccgagaccgccgccgcgctcgccgcggcctccctcgtcttccgcaagtccgacccggcctactccagccgcctcgtcgccagggccaagagggtgttcgagttcgctgacaagcacaggggcgtgtacagcgccaagctctcgtcctacgtctgcccctactactgctcctgctccggatacc

SEQ ID NO: 104615 - DNA, 531 bp, Triticum aestivum
  unsure (1)..(531): unsure at all n locations
  Clone ID: PAT_TA_104615
cagtcaggtaccctgatgatccatttgatagaaatgggaatccgactctttgaggagagcgaattaccttgttgatgttgctccagggactgaaagaataacaaccacaaaacctgtattcgtcggtactgaattagaaccacctgaaaaggtcatgcaaacagcagtggttggccaaaatggatccttgaactaccggcttgatttggaagggttcccgggaaatgcatgggcagtctcatattttgcagaaattgaagatttggccccagatgaaactaggaaatttaagttagtggttcctggcatgccattattcagtaaaccaaccgttgacgtggaggagaatgcgcaggggaagtatcgtttgtaccaaccaggttacacaaatgtgacacttccatttgttttctctttcgagttcaagaagacaaatgattcttcaaagggacctattttgaatgctatggaaatntacaaacatgttcagattaccatgggatctcaagatgcaaacaccatgtctagctt

SEQ ID NO: 104616 - DNA, 427 bp, Triticum aestivum
  Clone ID: PAT_TA_104616
atttaagtgggaaccattcgggaatgttcaagggttctttttcattaacgggaagtgatttatgctatttagccagtgtgatcttccctaagaaagagggctcatatataatacttctcaaatgcattactgttagcttgaatacagtttgtgtaacaaggctgagccacgagcccaccggctcctcaaaatccagaatgtcttgccttgcccctgtggttggcgttccatggagtacgtagtagctgaaaacagcctgacactggactctgcttctagtgctgatttcatgatctgctgggaagacgtgggagagaaatcaagcacagtgtgggcgagtatccgagtttctccatgttctcgtggaagttatatatgacagggaatctccctggccttgttttgggtggcgccgcctcgcccgttt

SEQ ID NO: 104617 - DNA, 495 bp, Triticum aestivum
  Clone ID: PAT_TA_104617
ggtggcttggggaggtgcgggatgaacaactcggaccctgtccgcgccgaggagaagacgatcaccgaggacgatgctgcgccggctgtaaagaagcaagagtcgatgcgccgtgacggcgtcgactctcctaaggtggcgcacgacaaggtcgaacacccgccgcatatggctcccctccatgaggtgccaaatgaagaggccaaggattcgcaggctgctccttccggtaacgaggggggctccgcgccctacgacgagctcttccccatggcggacaagggcatggatttcaactggaacggcgagatgagcgcggagaagctcgccatcgcgagagatatgtacgcgtcgctgccggacgcgtacaagcacggcgacgccggggaccggcaggtggtgacggggttcatggcgttcgtgatgggggtggtggccatgttccgggtgggcaagatcgcgccgaagcgcgccatggacgcggccatgggcatc

SEQ ID NO: 104618 - DNA, 270 bp, Triticum aestivum
  Clone ID: PAT_TA_104618
agccagccagccgttcccggagggcggaggcggaggcggagtcccgaggggatggggaacgtgacgtcgtcggtggcggcgcggctggccttcttcccgccggagccggccacgtacgaggtggcggcggcggagggcggggccgggctgcggatgacgggggtgctcccctacgccaacgtcgacgtgcacgcgctgcccaccagggccggcacccgcgtcgtcgccgccttctggcgctacccctccgcgcgcctcacgctgctctac

SEQ ID NO: 104619 - DNA, 441 bp, Triticum aestivum
  Clone ID: PAT_TA_104619
gacgacgaacaaacacacgagcgaacagagagtcagaggcacggcgacacagacaggcttgagttgagggggaaggtggtacgtcgacatggacgtgcactcggcgccggtggcggcgaggaggatgtgggggtacctgcgggcggtcttcttcatgatgcgcaagggcaagcgcaagctgctcctcggcgcgcacctcctcatgaagcgccgcaacaaggccgtctcgcgctccgtcgccaacctcctctcgcaccaccaccaccacggtcaccacggcggccgcgcgctgcgccgccgcgagtacgagttctcctgcggcgacagccccgacccgggctccttctccatgcgccgcctcgccttcccctgcctcggcgccgccgacgacgtcgaccagcccggccgcctccgcgccgagcaccccgcgcccgccacgcc

SEQ ID NO: 104620 - DNA, 516 bp, Triticum aestivum
  Clone ID: PAT_TA_104620
tccctgcttcctctcggtgcaagtccaccacatctctctcgacctcgacgaggatctcgtggctgtcctcatgcaagcttgcctggggggcaacgctcctgccttccaggtaacccgccttcgggatcagctttttcgtatctcggtctcccacaaccgcattgttcaagcactcatcgccgagcccattctcaccggaaaaacacactccattcagtttcttccctatccaccgccacactcctcctcacacccaaaacctacagaccaaaggaagctctttgacattggggaccgcttcggccacgctgacgcgttcctgcgctcccagctgcggttctccccctctcctggcatcgacttcgagctcaatatccttgagctgttctcatcgaaagttttcgggccgcctccggacgcggccacacccagctctatcatcttcgtccacaaagcagatttcatggtcgatgaaatcctagtcgccaccctcctctcgtttcgctttgggggaca

SEQ ID NO: 104621 - DNA, 516 bp, Triticum aestivum
  Clone ID: PAT_TA_104621
acgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatt

SEQ ID NO: 104622 - DNA, 569 bp, Triticum aestivum
  Clone ID: PAT_TA_104622
ctaacacatttttgctagttttgacagcttgttgccattgcggcctagttgatgaaggcatgaatttcttggagttgatgagcaagagatacaggattgttccaggagaagaccattatgtttgtgtggtggatttgatcagctgttcatcccgttcatgtgatgaagtagttgaatggatcagaagttcaccattcggttctagcaaacaagcttgggaaactttggttgggaaatgcgcgataaatggcaacgcagagttgatgagtaaagcagaggagcagctagccgaactagacagtccaaaataaatgagtgcttgctcttcaaagtttgttttgcgaggttatctcccttgactcccatgttgaagaaggctcaggcagacaaattactttgtgataagaactttggcatggtgaaagctgtttgttctttgcacaggagacattcttttgtgaacagagactggataagtgcatccctgaacaagtgtgatgtagcagtggcatcataaagaatcggtggtgaagggacctgcagacatgggcgttctgctgggcctggtg

SEQ ID NO: 104623 - DNA, 581 bp, Triticum aestivum
  Clone ID: PAT_TA_104623
cgctgctgtcggtgcgctccgtcccccaacgaatctcaagcctcaccgccgaccaccaccaggaccctctaatcctcgtcgtctccacctcccggcccccttcccagtctgcctgacttggtgcttggcaagtaggttgtcgatgcagccctctccggtgttgacttcacaagttcgccgtcggcgccgttcgtgccccaacggctctgttgcgtcctcgctttcctgcggcagcagccccaccttcgaccacaaccacctccccctcctcatagccgtctcatcggcgcccttccctgtctccttcaacgctgacatccgcaagtacgtcggcggcggcgccaccacctactcctacttcccctccctgccaacgcgttccatgctgggcacactcccatggatctcactgcccttcaccttctgaattctgatctgacaaggaccaatgtatgggtactgatgaaagaataaaatctccttgtgcaattgcagatatgtgatggtatcagttggcgctaccttattgtgtccaaagtatcattattctacaatatcagctactgtatctataccagtgt

SEQ ID NO: 104624 - DNA, 557 bp, Triticum aestivum
  Clone ID: PAT_TA_104624
gcggcggcgagccgcccacgagttcctgctcgccagcgccctcagggcctgcgcgcagtcgagggcggcccgcttcggcgagcaggtgcacggcgtcaccgccaagctcggcctggacgccaacgtcttcgtcgggaccgcgctggtcaacctgtacgccaaggctggccgcatcgacgcggcgatgtcggtcttcgacgccctcccggtgaggaacccggtcacctggaccgcggtgatcacggggtactctcaggctgggcaggccagggttgcattggagctgtttgggaagatggggctcgacggcgtccggcccgaccggtttgtgctggcgagcgccgccagcgcctgctctgcgcttgggtttgtagagggcggcatgcagatacacgcctacgcgtaccggacagcggcggagtcagatgcgtcggtgaccaacgcgctgatcgatctgtactgtaagtgctccaagctctcgttggctcgccggctgtttgattccatggagaaccgcaatcttgtgtcgtggacgacgatgatcgctggctacatgc

SEQ ID NO: 104625 - DNA, 481 bp, Triticum aestivum
  unsure (1)..(481): unsure at all n locations
  Clone ID: PAT_TA_104625
acaattttaatcttgatgactgagctaggcgtacagttcactgatagcatgagcattctggtttcttctgctgtgccagaaggcaaaggtgtttcttcttctgcatcggtggaggttgccacgatgtctgctattgcagctgcctatggtttaaacattactccaagggatcttgctttgctttgtcaaaaggttgagaatcatgttgttggagctccatgtggggtcatggaccaaatggcatctgcctgtggagaagctaacaaactccttgcaatggtctgccagcctgcagaagtgaaggaattggttatgattccatctcatattcgattttggggtctagactctggcatacgacatagtgtcggtgggggagattatggatctgtaagggtangcacttatatgggacgaaagatgattaagtgtgcancatccgacttagtatcagtatcctcaacttcagatgcccctgctc

SEQ ID NO: 104626 - DNA, 502 bp, Triticum aestivum
  Clone ID: PAT_TA_104626
gcgtcgacgacttcaccaacggcctccgcccggatccccagcccgacgactggctttccaaggcccgcgggttcctctacgagatctggaccttacgcagccggagcagcatcgccgcccagatcgccgatctcaagcagcgggcgcagcatgtgggtgaccgccgcgtcaggtatggcgtccgcgacccgaatcccggcaccgggaaaaatggtttgggtggatataccattgctgagcaccaggagataacccgtcggcttatcggcatcaaggagccagttggggtggacatagcgaagcttgaggagtggattagatctgaggagttgaagctgggtgttctatccatatacggattcggcggtgtgggaaaaaccaccgccgccatggcactgtaccggagttgcggggttcatttcgagtgccgggcaatggtcaccgtgtctcatcacactgaccctgatgtagtcctctgcgacatactgaggcaagtcaagat

SEQ ID NO: 104627 - DNA, 533 bp, Triticum aestivum
  Clone ID: PAT_TA_104627
ctagcttctcgttgtattatggttcgctggattgcaagtgccagggataattttagtgggtgtttcaattagactagtacgaatactagtgctccatgaattgggattgggcagattgcatccggacaagaactaatcaactcgtgagacaatggctagctaactagtagagaaggtgttaaatagtagcctactagcagagaaggtgttaaattaaaactgaattttgtaactgattgttgctgacgagaattgctgcggaccagtaatttgttaattgcagtctagataaaatggctctgggacaaggttaaccggttagagaagatacattgagttttaaatatatatccatgtgttatcttgtacaatattctgagtgtgggttaatatacagatttgacaactttgtgtttgaagggtgctttttcagacaaccttcagtatcgaggcaagttcatgaccgacctctttcattgtatgcatggttgtcttgttgcttgtgcttcaatgtactttgttcttcacatttg

SEQ ID NO: 104628 - DNA, 211 bp, Triticum aestivum
  Clone ID: PAT_TA_104628
ggggaacccaaacccagccaacgcgctggtggcgctggtgaaccccgaccgggcagccgacaagctacccgccctccgcaccaccaagggcctcggctgcatggtgctgcactgcatcgcccgctgcctcgccctctaccccggcaccgtctgcgcctccgacggcacgctggcgccgccctgccacccgccggagactgacatcaccgag

SEQ ID NO: 104629 - DNA, 357 bp, Triticum aestivum
  unsure (1)..(357): unsure at all n locations
  Clone ID: PAT_TA_104629
tggtggaggagcagccgagggcgacgacggcgtccttggccgagcacacggacggaaggggggagaggagtgtagacgctcgtggggattgaggggaaggagaaaggtgatgatgatgccggctacttggggaaggggatgcgggtgacctggggcgagtcaagcgacctgaggcgaggccggtggcgacctatggaaggaatgggacgccggcgaccttgggaaggaaggggaggccggcgaattggggtaggtgatgcgggtgacctgnggaatggcggctgggagctcctcagcccgtcgtcgctgtcggccgccggcgaccaccgcccgttgcttggaggatgaggggaatgg

SEQ ID NO: 104630 - DNA, 367 bp, Triticum aestivum
  Clone ID: PAT_TA_104630
gcgctcgccggccacctccacaccgtccactcggtgccggtgcgcgccgtgcagtacggaaaggccagccagctccgcctgccggtgtcggcgccgcggctggtgctcctcggcgacgacgacaaccgcgtgttcctcctgtccgtgggcgcgctcggcgccggcgtgaccgccgtatccgtggtgtgcgccagggcgagcgcggcgacgcggccccggttcgcgtgcaagttgtgggtcaacctggaggcggccaactgcggcaaggaggacatggtgctggtggacatgcacatgaggagcagctcgtcgcccggcgccgtggtcgccgcgggcgagcccacgttcctgacggtgccaccgatgt

SEQ ID NO: 104631 - DNA, 619 bp, Triticum aestivum
  Clone ID: PAT_TA_104631
cacaccttgcatattgcatcaatcatggggatgaagaaactctcgttcttcatggggttgctcatgcttgcgttgtttccagtgctgtcacgacaagatggttttgatcaatgggtggcattgcaagagagcaagactagcgtagccacatcgacacttgacgccaagctctccacagcagaagcctcaaggcttggtaatggcgttgatccatacactatctttggcgctgaagatggcatgtacaagagcatcagtgagtgcatttccaacatccccaatgacaacactagacgacatatgtttaacctaaaacccggaacagtgttccgtgagaaggtgttcgttggaaaagataagcccttcgtcacgctaaagtccgatccctccaaccctgctgttatcgtgtggaatgataccgccatgaccaagggcaaggatggcaagctcctcacctcccgtggtagtagcactgttaccatagagtctgactatttcattgcctatggtattatcatcaagaatgatgcacttcctgccaaggcgggcgacaaacaagtgcaagccactgcattgcatgtgacgggcacaaaggcaattttctataactgcacgatcg

SEQ ID NO: 104632 - DNA, 590 bp, Triticum aestivum
  Clone ID: PAT_TA_104632
gatggtcctcatgtgaaagcagaatctggcacttgtaatgtctgttctgctccttgctcctcttgcttacacagagatcttgcacctgttgattccaatatggactgcggatcatctcaaacgtgctgtgcaaggtcagaatcaagaactaatttgttagttcgtagtgggaaaggactccgtacaaagggaggggaaaatgatgatgaacttagtgccacttcaagccatgcttcctattccgaaaatggtggacataaggctatggcaaggtccattgcagcagattcagaggttaacatgccggcaaaacgtagaaggctattgagcgatacgaggtcacctagagaagagtgccacgatgatagtaactcgtgtgttactggtacatcagcagcaagcaaacttctgctggataagaaaaaggataaactatctacttctgcgtcaagtcgtgatctcactgtcaaggactacaaggacaagaacattgccggtcctaacagactaagaaattcccttgtggaagaatctacagagaagaagagatctgatgttcatattgccccacctagctcatctgatcgatc

SEQ ID NO: 104633 - DNA, 544 bp, Triticum aestivum
  Clone ID: PAT_TA_104633
ttctcccgcccgctcctccgcgccgccgccggcgcgggcgccccggcctgcgcgccgccgcgcgcgcgggccgccgtcgcctccgtggtgtgcaggctgcccccgccgccgcagacgccgtgcggcctcttccagcagcggttcggcttcgcgtcgctgccggcggcggaggcggccgcggggagggacccggaggccgaggtgacggcggaggaggcgaggcggctcatgcggatggccaacgtcgaggcgctcaagcggcggctcggggacggcgaggtgatcccctacgcggagctgctgcgcaagtgcgaggaggccggcgccgcccgcacccgcgccgaggccaccgcgctcgccggcgcgctcgacgaggccggcgtcgtgctcctcttccgcgacaaggtctacctccagcccgacaagattgtggatcttgtaagaaaagctatgccccttgcactgacacctgaggatgacccaagaaaggaagagctcaagcaactccagacacatttggaagaaatcaacaagctcgcacaca

SEQ ID NO: 104634 - DNA, 542 bp, Triticum aestivum
  Clone ID: PAT_TA_104634
gcttcagcttcagttcaagtctagtgcgtcgtcagattagacgtgagacaccgctcttcaaaatgtcgccattgttcgcgtccgtggtggttttggccgccgtggcccttacaacgaatggagtgtcagccaacaacgagaaattgcattgcaatctacgcacagccaacatttccaaagaatgggtcacaatggtggacccgtgtgtgaaggctatgagggatcagatcaacactgaacttacagcatccatgacctatctcgccatggctgcccacttctctactgattcagtcaaccgtcctggatttgctgctcactttttcaaatctgctgatgaggagagagagcatgccatcaagttgattgagtacatgttgatgcgtggtgaacttaccaaggacattggtgaacttatccgcaatcctgtccctgtggagactgcatggaccagtggagtggctgctctgaaacatgccctcgagcttgaaacttctgtgaccaacagcattcgttccattgttgctgtttgtgaggatcct

SEQ ID NO: 104635 - DNA, 532 bp, Triticum aestivum
  Clone ID: PAT_TA_104635
tgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtc

SEQ ID NO: 104636 - DNA, 607 bp, Triticum aestivum
  Clone ID: PAT_TA_104636
gagaacaagagagaagaaagagaggagagaagataaaggaaataggataagggggaggcgactcgaacccgcggcggccaccgcgcgcgctctccagatccggcgcaagtccagctcgctgccgcgctcaccaagggagaaggacgcctcgctccgggatcccgacctagggttccccgcgcctcagatccagcctccagatctgtgccacctcgctggcgcctggtaacatgacaccaacggtcctcatggagtttgcgccgcagaggcagattaaacggagctatgatgaaatggcctaccgaggtgtgccccgtgggtatgcagagactgttggcgagtcaggcagccctgttcgtgttgactcgcaagattcgtctgcgccaaaacgcaagtgcatcagccttaacagtgatggctttggagtgaagcgggagatttttgtcccctctaagatgtcatcgtctgagcggcggtaccttcgcaagagattccgctcagagcttgattcggtccgggatctccttaagaagccagagtttttggccataatgcctgctagcagggcacctgcgtactcatcctctgctgcccctcgagctaaaaa

SEQ ID NO: 104637 - DNA, 319 bp, Triticum aestivum
  Clone ID: PAT_TA_104637
ttcttcccccgtcctcaccctctgacccatcatatctcgatctgccttcttgttttgcaacccgttttcggttttggtcttcccgtgtggatcttgcatctgtcctgaggacggtgacgattgatatttggtctcgttcgtcgtaactggcaatctccttgccttgccgaccatcctgcaatatcaccacccatattccgagtcctcttctcgattagaatcgccgtccccatgcagctgctcttcttgttttatttctcgtttcttatcgctggccgaggattaaattaattatgacaagcatatgtccgaagtttct

SEQ ID NO: 104638 - DNA, 398 bp, Triticum aestivum
  Clone ID: PAT_TA_104638
gccatctcctgcgcccctgccccacccaccacaccacgacaccaacctccttgccttcccccaccccggtcacctcccagcgccggatccaggccgcagcgaccccctcacttcctcgaccggcctcccacggccccgccccatgacgccggcctccacggcttcgaccccccgcgccgccccgcaatgccgacctccaaggccccggcccctgcgccgccccgcaacggctggccccggccctgcccgctgcgaccctccctaatcccgcgagatccgcgacatgtcgagccgccaccatcggatccccccaccgcgccccttcttcctcattgtggtccgtcccggggcgaggacgggctctgccgcgccgtgaacgagggaacttcacgggcggg

SEQ ID NO: 104639 - DNA, 450 bp, Triticum aestivum
  Clone ID: PAT_TA_104639
accacaatgcatccaatctaattatatagccagcattgcccaaatggagtacatatactagtagagtcgatctggatattaagcaccacaccagctaccagattcgcaattacagcacttgtccatcaatcgtcacagcagaagtaatgcatactctacattattccctagaactaggctctcatcagtacctcatcatgagctgatccacgaccacgaacatgatcccttgcagcttgctgctagctgaactagtaggctgcgtactgcactactgcttgtccgacccatcacctccaaggaggtcagacaggcaggtcaggttgcacgccaggatgaggcagacgatgaccatggtaaaaaagatcttgccggagatgtatcttgggtcggcggcgaggaaggtccagacggcgccggcgtacatgcaatggaagaggaaggtgaccg

SEQ ID NO: 104640 - DNA, 603 bp, Triticum aestivum
  Clone ID: PAT_TA_104640
ccgacccgccggccttcgtcccggtgctgccccagcccgcagagctcgccgccgtcgtccgccgcgcgagcttcagcctggacgtctacagggtcctgctggcccagatccacgactgccggaacggcagcgtcttcgtccaggtcgggaccgagggcagagcggtcatgagggtgcacaccccgctctgcccccagagacgcgtcgccttcatcccgccgctcccgcgccctgcactccggccccgtggtctctgcagcttcacgcagatcctctccacggaggaaaggggcggcctttcctaccactacctgtacgtggagtctaccgtggacaaaccagaaaccaggctgcacatatacgtgttgcaagatggtctctggctcccgcgtgctcccttggacatgcaccaactccctcgtccattactccagccaaaacccgtgctcgtcgacacaagaatttacatgccggcgggcctgagcgacatcattgtcctggatttgacggcctcgagtttctccacgattcaactcccacggggcaccaagcacgacgagtgcggcggcaccaccatgctggcacggtcttatgatgcttccg

SEQ ID NO: 104641 - DNA, 577 bp, Triticum aestivum
  Clone ID: PAT_TA_104641
ctcaagcctcactgatttcagagtgtgaggacacaatatcatctaaagatacagatatatcgtctatctatgacttcgacaccagcttgcaggagcaagcacacgaaggatctcttttttcaatgaagtatgatactgacatcttggtaggaaaatgatgtcatggccaatgataagtcagctgtttcatcacccgagcagtctgtttgtctatcaaggaaacacagctctatggaaagctgtgatttggacttgcaagagaaagatttggatgctattccaacaagctcatttcaggaaaggaagtgttctttcagttcttgctcatcagatggttttctttcttccaaagagagctctaagccacaaatcaacattcataaccgtgagaagggtagtgggaggggtcttgcaagtagcagatgagccatctcctgaagctatttctagggcacctaaatcattggtatcaaatgttgacgaacatgatgatagatcaaaacctccacttatacagcaaagaggccgttttaaagttacacctgggaatgtcgagttggataaggctcactcacct

SEQ ID NO: 104642 - DNA, 459 bp, Triticum aestivum
  unsure (1)..(459): unsure at all n locations
  Clone ID: PAT_TA_104642
cgacgccgccgccgccgtcgccgccgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgcctgatggcggtggtgcacaacccgcgccagttcaaggtgccggactggttcctcaacagaaagaaggactacaaggacgggaggttctcccangtcgtgtccaacgccgtggacatgaagctcagggatgaccttgagaggctcaagaagatcaggaaccatcgtggtctgcgtcactctggggtgtgcgtgtccgcggtcagcacaccaagactaccggcag

SEQ ID NO: 104643 - DNA, 523 bp, Triticum aestivum
  Clone ID: PAT_TA_104643
tttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcagacaagcccctccgtcttccccttcaggacgtgtacaagattggcggcattggaactgtgccagtgggccgtgttgagactggagtcatcaagccaggcatggttgtcacctttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgct

SEQ ID NO: 104644 - DNA, 504 bp, Triticum aestivum
  Clone ID: PAT_TA_104644
tgacagcagcagcagcccgtcggtctcgttgtccgacgagagctccgaggcggaggcgcagtgctgctcgtcgtcgtccacggcgccgagcctgcacgacacggtggacttcagccgcaccgcctcggacgtgtccaccttctcggagcgcagcgttgaccacagcgggcccttcgggacggccgccgtgtccaagctcatcggcggccgcggctcccccgccgccgcgctcagccggctcagcatgaagccccgcgccgacgtgctcgaccgccgctccgccgaggacgagctggacctggtcaaggagcggttctccaagctgctgctgggcgaggacatgtccggcggcggcaagggcgtgtgcaccgccgtcgccatctccaacgccatcaccaacctctacgccacggtgttcgggaactgccacaagctggagccgctgccggcggggaagaaggccatgtggaggagggagatggactgcctcctcgccgtctgcga

SEQ ID NO: 104645 - DNA, 449 bp, Triticum aestivum
  Clone ID: PAT_TA_104645
aaaactatagaaggattagtggcaataaaaccttaggttagttctaccctttattttgttataattcctctgttctggtaatgaaaaagatgaccacgcagattaaaggtttagaaactataaaagaatctgaacatgaagcttaatctgctgaattttcacttcagtagtccctcggcttcgagagtatacacaatatttgattgttgcttctcaatgatgctaccaaaaattgaacaccctggcgtcggagagagggaccaggaggccgagcagtccgtggtatcgccgccgtcgtcctcatccctcgtgcgtggtgacggagagagacgatccgtctggagctcgagtatagttgaccgcgtctcttttctttctcttctttcgcacgtctctttttctgtagctgtttgaaggcttatgatgcatggtcactgactgtattggag

SEQ ID NO: 104646 - DNA, 347 bp, Triticum aestivum
  Clone ID: PAT_TA_104646
gctgcccctgcagcctctcctcctccgtgttgtcgcctccccatggcacccatgcccgcaaccatctcggccacctcatcccctctccccgtccctccagtgccgccatcgccccgcctccgttcagctccctcgccggaggccgttaccgcgaccctgccggacaccgccgacccggaacaccgcgccctcaagggccctgcctctgcgtcgtcgtcctccatggccgcagccggccaagctcgaagctcctgccgctgcacctcgtcgccgggcgttgactcctcctctggtccagccgtgggcacctcctgcaagcaccttcggtctcgctagggttctcttgc

SEQ ID NO: 104647 - DNA, 514 bp, Triticum aestivum
  Clone ID: PAT_TA_104647
ttccccaccttgttttcctattgtccggacctgtttctattgctaagttggcgtccctggttggaacctggccttccgccgatccttgtcgcctgtagagtttgaagattggcaatgccttactgcctccttcccctcgctcttgacgaatatggattcggtgatctagccgtactctgccttggggcgcttttctattaaatcgctctattctaagcttattggtggctctcctactaaccgtttctctcagatttggaaggctcggatccctcctaaagttaagatcttcttgtggcaagcctttaggggccgtttgccttcggctgaccagattcacaagaggaatggtccgggctctctattttgtgccctatgtggtgaattagaggactcggcacacattttctttcactgtgccttggctaagctcatctagagttgtgttcgtgagtggctccaggtctcctgggcccctgtttctttctctgatctgcggacccttgcgaatacc

SEQ ID NO: 104648 - DNA, 540 bp, Triticum aestivum
  unsure (1)..(540): unsure at all n locations
  Clone ID: PAT_TA_104648
atccacccatcttgtgacagttgaagagagcaaggtgtcagcggactcagatgacgagttctatgacgcagataaggttgaccctagccaagaagtgcagtcaggtgatgtgaatgctgaaattggcaacaccaatcaagaagaaacttattctttgaaggaagagttggagtgtcttgtccatggtggactgccgatggctttgagaggagagctgtggcaagcttttgttggtgttggagctcgcagagtagaagggtattatggtagtctgcttgcttctgaaggtgaattanaagatggcggatgttcagattctttggcctcagaaggagttgatgaaagacctgaagtattgtcagcattttctgccgaagaaaagtgtaaagggcaaatagagaaggacttgcccagaacttttccagggcatcctgctttggatgatgttggaagaaatgccttgagacgcttgcttctggcttatgctagacacaatccaacagttggttactgtcaggcaatgaacttctttgctggtct

SEQ ID NO: 104649 - DNA, 576 bp, Triticum aestivum
  Clone ID: PAT_TA_104649
gccatgtcaaggcggcattgctcccaattctaaggctgttcgccgccgcaggcagcatgatgaagggggccggcgccatgagcacgatgaagccgccgtcatcgcccatgttctgcgtccgcgaggcggacggccacggccaccacttcctcgaggagtgctccctctgcggcaagtccctctccggcgacatcttcatgtacagaggtgacacgccgttctgcagcgaggagtgcaggcatcagcagatcgaggtggacagggcgaggcaccggcggaagaagcacgcggcggcgcacgcggtgtcggcggcgcggaaggagcagcaccggcagcaccaccatcaccaccaccaccatcaccatcaccgtcagcaccagcagccggagccggagccgcagccgcgggcggctatggtgggctccgccccgtgggccgacgccgggttcgccgcgaggagccccgcgttgcgcgtgtgacgctctgattagactgcacccgatctccggcgacctcagtttggcacacgtacgtacagtacaggacgacggacatatacacgtactcacacgtcta

SEQ ID NO: 104650 - DNA, 559 bp, Triticum aestivum
  unsure (1)..(559): unsure at all n locations
  Clone ID: PAT_TA_104650
cattgaagatgggtattctgcacttgaatatattgacactcaagggtatcagttatctcctgatgcacgggcccaggcagatctaaaatttacatacgttgtttcatgtcaaatatatggacagcagaagcaaaggaaggctccagaggctgcggatattgctcttttattgcagagaaatgaggcccttcgggttgctttcatacatgaagaggatggtgtatcgagtgatgggcaagctataaaagagtatcattccaagctcgtgaaggctgatattcacggaaaagatcaagaaatatactccattaaactgcctgngaaccccaagcttggtgaggggaaacctgaaaaccaaaatcatgctataatttttactcgtggagatgcaatacagacgatcgatatgaatcaggataactacttggaggaggcaatgaaagtgaggaatntacttgaagaatttcgtggtaaccatggaatacgttatcccacaattcttggtgtgcgggagcatgtgtttacgggaagtgtgtcttcgctggcatcatttatgtct

SEQ ID NO: 104651 - DNA, 484 bp, Triticum aestivum
  Clone ID: PAT_TA_104651
ggttgacagcattattccacctcaaatatcatctgagcagtatgataaaatgaagagctttaaaacaatgttggagcgcatattacaaatgctgcaaattggcaaaagtagtgtccaaccttctatgagggacaacgttcctcgatatgagaaacagattatcagtatcttgaattcacaaaggaagccagtgcagccacaaatacaacaacagttccagccacctgcagattaagagcctgaaggatcaatactttgcagaactcggtgaactgttcaataaattatctgtgaagctacagcatgttgacaacattataccacctcaaaatccatctgataagtatgacagaatgaagagctttaaaataatgttggaccgtatattacaaatgctgctaattatcaagagtactatccaacctgctatgtgggacaaagttcctcaatacgagaaacaaattatcagtatcttgaattcaca

SEQ ID NO: 104652 - DNA, 446 bp, Triticum aestivum
  Clone ID: PAT_TA_104652
tgcacgaggcacgaagtaaatcacgactacttagtccgagaacccctagggtaggatgagtcgtgtacccccctatgcgcaaccaagtccgtatgatggttcgaatggaaccatgattgtgtcttgcttgatttcaattgtttatgttttgatatcagtcgcccttttgccctaggcaactagtacacggctatatcacctgccttatgttattgtttgtgtttggcccttcggcacccgtttgtttgcacttggactatagaacccccttttaggcatccccctcctctatgctacttttccctctcgtctctctctcctcaaccaaagaccggcaagacaaggtacaccgaggattctacttcgacaaccaacgagcactagagacttttgttgcagcctcctcgaccaagtgcaacccagtagtgttatgtctactcctcaag

SEQ ID NO: 104653 - DNA, 534 bp, Triticum aestivum
  Clone ID: PAT_TA_104653
ggcgtatccctgcccggccacccaagccaagcccctcccgaatctctctctcctcccctcccctaccattgccccccgctccccctcccccacgacacgcacagatccaccgtccgtccatggcccccgcaatgaggccggagcaggaggcgagctgcaaggccaccgaggaccaccgctccgagttcgacgccgccaagccgccgcccttccgcatcggcgacgtccgcgccgccgtgccggcccactgctggcgcaagagccccctgcgctccctctcctacgtcgcccgcgacgtcgttgtcgtggcggcgctggccgccgccgcgtggcgggccgacagctgggccctctggccgctctactgggccgtccagggcaccatgttctgggcgctcttcgtcctcggacacgactgtggtcacgggagcttctcggacagcggcacgctcaacagcgtcgtcggccacctgctgcacacatttattctcgtcccgtacaatggctggaggatcagccacagaacgcaccatc

SEQ ID NO: 104654 - DNA, 417 bp, Triticum aestivum
  Clone ID: PAT_TA_104654
aggaggagacgggggtaactacctcgaagcgatggcgaccgagctggccgccgaggcactcgccacggacatggcgggcgagcaccgcgcgggaggcgagggtcgcggcatgacgaccgtctacgacctctgcactgccgacaagcgaccgtcgcgcgccgtccccaccgtcgacgacctgtgcgccgccaacaagccaactccgcgggtcgtccccacagtcccggagttccccgcagccgaggagctgcccagtgagcagcacacctcctcctccatcccttcaacctgcttgattttgttgctccgtcaaaattagtcaaaattgtggccatccaactcgattttcctgaaattttgtcctggctcgtggggtccttgaaggctaagtaagggaggtgaggggtggtagctgtt

SEQ ID NO: 104655 - DNA, 392 bp, Triticum aestivum
  Clone ID: PAT_TA_104655
caagggacatggatgttcaacccgggtcacggacaagattggctggatctttcgggcactcctgaccacataagcagagctgagcagttgataagtgatgtttttgcaaaggctgatgctggctcatttggcactatctctagttgtgttgagcaattccagatgcaaattgctaacaacaaggatggcaggcacaccatcatcaccaactctgttttctataagagtacagattaggagattttttatggactagttaattgattgtgatcttgagatagtcaaagatgtttgggggattaattaatcttgaacaatttggatttacttatgtggttgtgatactgaaccaaatttcacgctacattatgagattttagttggatttagat

SEQ ID NO: 104656 - DNA, 390 bp, Triticum aestivum
  Clone ID: PAT_TA_104656
cttcctcgtccgcgccgcgacctccctggccgccgccgcctcctcggcgacgcccgtgcccaccgatgtcgccgtgagcctgctcgctggttccgtgcacgcggcggcgttccgccacggccatgcagcggacctgcacgtccagagcggcgccgtatccatgtacgcggcggtcggggacgtgggcgccgtgcgggccgccttcgcggagatcatgagcccggacgtggtgtgcgtcactgctatgttgggcgctctctcagccggaggcgatgttgacactgcgcgcgagctgtttgacagaatgccgcagcaggaccatgtcgcctggaacgccatgctcacaggttatgtgcgcgtgggcagggcaagggaagccttggggctgtt

SEQ ID NO: 104657 - DNA, 634 bp, Triticum aestivum
  Clone ID: PAT_TA_104657
gggttcggaagggggcgcatttggatttgggtttcctcctagtcctctctcggcggccatcgtcctaacgatcccgttgaggcgccgcctgcgagtttcgtccgtttaccgccaccctccaaaccgtcccaaggccgcgacaagatctcctctacggcgatcttctccgcccgatcctccccccgctggcgatggttaacgttatgatgaagaccaatcctgacccagtggttctagctaaagccatgaaagctagaaaaagcgttgtgcaaatctatcacgtcaagaaaattgatgggaagaagtgcaccactagctccggcactggtttcatcatcaagaccagagatgcagattgtgttgtggtaactaacaggcacgtgactgctggaaaggaacctttcgacgaagctaatgacaagctctttgttagatttatccgtgggagtggtgggagttgaggaccgacctggtcttctaaggttttatgacttcttcgtggaccttgcttttattgaagtccaaggactgagggggaaaatgccaccagctctacgttttactatggcaagtgaattgcaaattgggacaagtgttgttgccattggctactgcaatacaagtggcgtgacac

SEQ ID NO: 104658 - DNA, 654 bp, Triticum aestivum
  Clone ID: PAT_TA_104658
cgcatcaccatctcctccttctccgctgcaccgccgccgtcctgctccttctcctccaccgaaaccaaccggagcacgcctggaagcggagtagatccccgtccgtctctctactggatctggattggctcccgtgactcttcctccctctgttgatccggcatggagctcaaacctgacgtcagcttgtcggagcggagcggccgtgcggtggccggtctactacacggcacactggaggcagaagcgacggcagcatcaccctttccttccccgtccatgaagtcagacctctcgctcgccccctacgtccaaactgtagatccacctgttcttgttttcccccatttttctttggactaatctcatagcttccgggtcagttcatcttcaatcttctgtaaccccatgataatatccacgaatcagtatcttagttgattttggtctatggctacctaattctagagctagaatagaataggttgaggggatagatctgacactgagtaggcaagcatttcagtctaggttagtcgttggttttggagcaaaatagagcgcccctgaaagaaatgatctgcacacgggagaaaaaaaggtatttcaaaatatgtgaacaacatttcattgcaaggagagcgccatattggt

SEQ ID NO: 104659 - DNA, 610 bp, Triticum aestivum
  Clone ID: PAT_TA_104659
tctccgccccgctcctgcgacgcaccgcgccggtgcccgcagccaccgccgccgccgctgctgggccgttctgcttccagccgtgccactcccctgcatcaccgcggtgcccccctggtttctccagcccaaggtttgctcgcgaggacctcgtactcttgcttttcccgcagctggctggatccacgccagatccagtgctgccgccggggtgctctacctctccaagctcgccctttgtcccggatcccctcccagaagatccacccgcggctcctgcttccgttgcgccgggtccagcccggaaggtctgctttgctgctgctgaagacctgctcaatccagctcctgctaagctcatccatggcgctcccaggtcatgcctgaagacggcgcggtctgctgcctctgccggccagggcgcggcgcggacgcccgtaccttcaaatcctgcaacgcctcgtgcgatgtctatcgagccgttgggtgtggatgcaagctcggaagagggttggatgcttgttaaaccgccgtattggtggagagctctgtcttccagtctgcgtcagtcaagacagaggtcctcgccttccttttcccctccatcatc

SEQ ID NO: 104660 - DNA, 457 bp, Triticum aestivum
  Clone ID: PAT_TA_104660
gcccatggtgcctatttaagtcagagccttaggtgatggtgcgtatagatggcgacctcataacaatcaatgagcacctaacaagtgccgaccagcaaaccagtgatccgctaacaatagcggataatggagctgacgagcagaggcgtgagtccagagcaaagcgtaggacgagagagcgatcttgcaagggaagtatggcggcgaagaagcatcatgagaaaattggcaagcggaaatcatgtacgaaggtgccacgtggtgagaggaacgctctggtagatcgtcgtaatgaaagctttgcaggtaaggtgaagacccaaagcgtgacgagtagctccatactggaaatgagctcaactggacaacctaccgtagttgaagcacacggtgcctcaacctcatctagcacgccggagtacacgatcagaagtgaagacgacatggacgcttacct

SEQ ID NO: 104661 - DNA, 171 bp, Triticum aestivum
  Clone ID: PAT_TA_104661
ggcaccacctacctctgcaccgattctcaaccggcgtcggctggggctgcaagtccatcgccaagcgcaagctgctgacgcccgaggacgtggaggacgtgcggcgcgagatccagatcatgcaccaccttgccgggcacgacatcgtggtcaccatcaagggcgcgtacg

SEQ ID NO: 104662 - DNA, 370 bp, Triticum aestivum
  unsure (1)..(370): unsure at all n locations
  Clone ID: PAT_TA_104662
atgctacgtggctatgccgacgtgccggattcagttcttagcagatgattcaacaagagaaaatttgaggactaattcgacggatttttctgtgcataaattacttccctccggtttttcctacctctttactggctagtgtacaaaatgatagataagctcagcatcattttcactgcatcagcccactaggaagtaggaactagctctaatttgatatggtggtgtttcctgtaggatggagataggtttgtttgtttgtgtggaacngtgagcanaccacagctgcattattgggcaaatgcttccacttatccactctttcacattctttttttttattatatgtgttggtcaactgccattgtat

SEQ ID NO: 104663 - DNA, 533 bp, Triticum aestivum
  Clone ID: PAT_TA_104663
aacagggtggcggtcacagtctctccaaagatcgacgccgggatcctcgtcgcgaggctgcgcaagtccggcaagctggcggagccttggccggaggagcccaagcagcagcaggagccgcctccgcctgcagagagccaaagccaagaaaccaagaaccaagcagatgatgccagcaagcctaacgaggccgccgagaagcccgctgccgagccaagcaccgcccagcctccggcgccggagcccgagaagaccgccgaagagaccccaccgccggccgaagaaaacaaagggcccgacgaggccaaggcggagacagggccgcaacaacaacccagcgaggcgaacgagaaagccaagcagcagcagcagcaggagcagcatgatcatcatgataagccgatggacgccagggtgacgatggagtacgacgacgcccgcagcagaggcgtctacggctaccgggggcccccaccagtacatgccagcgacacggcagccgccggtgcacgtcatgagctacaacgtggcgc

SEQ ID NO: 104664 - DNA, 434 bp, Triticum aestivum
  Clone ID: PAT_TA_104664
tcggtcaaagcagaagacggcggtgatttcagcgacgacgacacaagagcgtgatgctgatggtggccaacttctggggcgtggaaacacgtggtgcaggtctgagggcttgcgcgacttcgacaagactatggcgcgggattgattcaaggcagtgcacacatgagagagcttgaagtcgacggggcgcggggtagcacgaccagctacatggagtcatgttgaaggtggagctggagtttgatggacgacttcactctgtgctgatggaggggctacggcgtaaatgcatggagagtcgaagcctatttcagcgggatagcgagagacacgtggattggactggggcccagtggtctgatggaggcgtgatactcggcatcggtcggtgatgatcggtggttctctgcagtgggggttgaggcagtgtgggc

SEQ ID NO: 104665 - DNA, 444 bp, Triticum aestivum
  Clone ID: PAT_TA_104665
ttccaagtactggttctccaatattataaacaacctcccaagcttcttcttgagagcctaagcattactggaaccacaaaaaaggggcaacttcttcaagtgctgaccaaacataacgacttcttgcaacttgcgaagataactctaactggaacccgactgaagcaggatgatctgaaggtcctcaacaaacttcccaatatagtttgtctcaggctccgagaaaaagcatacatcgacatcaagctcaccttcgagaatgacaaattcaaaaatctcaagtgctttcttgttgagggctccaacatgactgacatcttgtttgaaggtggggcccttaagctggagaagatcactttatgctcaaccgatggcatacaatctctttctggggtcgaagcccttccagaactgaaggaagtcgagttgaacaacaacaacaac

SEQ ID NO: 104666 - DNA, 344 bp, Triticum aestivum
  Clone ID: PAT_TA_104666
ctgattacttcataccgtgtaaattttccaacagattgccaaagtgatagaacatcattttctgatgaagtgtcccaatatcaagatgcgtatgatgcaagactagatattgcctcaagtattaaccgcacttattactcggctggttatggctcagcctattcattgaattcttcaagagcagatgttagatcagatcgtgcaaatatgctaagagtaagtacgggagacagtagtcggattagtatttccagcagcatccctagttcttccagtcaaggttctggaccagatgatatagaatcccttggtgatgtttatgtatggggtgaggtgtggactga

SEQ ID NO: 104667 - DNA, 461 bp, Triticum aestivum
  Clone ID: PAT_TA_104667
tcgggggagtctgccgtcaagccggctccacggtcgccggactggatgaagagagttcgtgcgggcactattcctacataaagaacaccctgcctgggaaggatgggggccctcaaaaaatctaaaggggctttgcggagcgagacagagaagaggttgtcaagccatagttaggcaccacatttgacacgttgacggaagcgtacgacttctacaatctatactcatgggaacttggtttcggtataacgtatggcaaaagccgactgaacccaggcaagcagaagacaaatgcaagagatagtgtgtggttgctcggtaaggatgcagaactgaaatgaatttagacaagaaatacaggtgataaagagcacactgtcagatacagtccaccggtgatttaagtggcacatcttgaaggctaaagaaagtttgggggttctgcacgggaatagaaaatg

SEQ ID NO: 104668 - DNA, 508 bp, Triticum aestivum
  Clone ID: PAT_TA_104668
cacggagcagctgctcacgtacgtctacaccagcctcatccccgacttccccttcctcgccaccggccggctcgccgcccgccccgcctccacggcgtcgaccgcatcagccgcctcccgcgcgcgctcctgcgaaacatcgtctcccgcctccccgtcacggacgccgcgcgcacggccgtgctctgctcccgctggcgcacggtctggctctccgcgccgcccgtcctggtagacgcctacctccgggaggacgactacgcctggccccccacgccggccaactcgcccgccatcaccgccgccgtctcccgcatcctcgaggcgcacccggggcccttccgccacgtccacctcgtctgcagccacatgaacgcgtaccgggcccggctcgcgcgctggctccagctcctcgccgccaagggcgtccaggacctcggcctcgtcaaccgcccctggccgtgggacgtgcccctccccgacgcgctcttcgccatcaacaccctcg

SEQ ID NO: 104669 - DNA, 543 bp, Triticum aestivum
  Clone ID: PAT_TA_104669
caggacatcaaggaggacacaatgcaagtgcaagaactcgaatgtctgaagaagtattgtgagtgttttgcatcaggtagatactgcaatgattgcaactgcaaaaactgttataataatgttggtcatgaggctgcaagacaggttgctatagatgctgcaatggaaaggaatcctatggcctttatgcccaaaattgggaacatccctccacatgcagcccagaaccgcgagtttaaagtagcagaaggccctcttgtgggtaagcacatgaaggggtgccactgcaagagatccgagtgcctgaagaaatactgtgagtgctttcgatctaatatcctctgttcagagaactgcaaatgtatggattgcaagaactatgagagcaatgaagataggaaagcaatacgccgtatcacccggcaccagcagcaccttgtctatgcacatcatatgcagaatcctgctacaatgggtattactggaccatatgcggctctttctcctgcagcagaaaagctctccaatctctcagtggcttct

SEQ ID NO: 104670 - DNA, 231 bp, Triticum aestivum
  Clone ID: PAT_TA_104670
gcgtctccagccctgcctgtggccggcggttcctggccagctggagtggtggtggtgctggtgcttcttcttcatacgtgtaggagttggaggttggtctgcgtgctcctggtcgtgcgaggggtcggtgtcctgcaacagctggagcatgacggcaaggtgctgtggcagcagcggtgtggcctcgcatcgactgtttggccgaatccgatggtaggggtgggaggtgtg

SEQ ID NO: 104671 - DNA, 562 bp, Triticum aestivum
  Clone ID: PAT_TA_104671
atagtaatctttgtctggcggatataacaaggcctgcaacccagaaggagtgccctcgtgcaacaggcaaaaagttatttcttttgtgctatgttgtttggtctctttttgcagttgcagggggagaaacactaacactctagtgggaggaacacttcatctctttatttctggtttaaccgttttcaacggtgtgcagctttaggttaaaaaattgatcagtttactaggagcagatctagtcctgatgatgcctgaagttgatcatgattcttctggtcttctttctattgagcttgttgctataatattaacgattttgaataagtgtgcagattaggttaaaaatggactgggaatagcttgtgctttataatgttccaaccaaacagtgagcgttacaggggtaaattcacaggaattgtacatgttggtgatattaaaaaagatacataggtcttgtgagcctggttggtttaatcctatatgttcccatcgatattttgtcttctgtaatgcactgtgacgaccttaattgagcttcagcatcatctgaagtgct

SEQ ID NO: 104672 - DNA, 350 bp, Triticum aestivum
  Clone ID: PAT_TA_104672
ccgcgccgtcgaggacgttatcacccgcggcgagactaagtatcttgaatttcacatccgcacgccatacggtcatggtcggctggcgaggcacgagttcatgtccttctcccgtgcctgcccagttgccttccggtggctcacgatgcttacattcgacaatattgcgtttgatgattccgacatccccgacctcattagcgcttgcgataggctcagacacctcactctgagctcctgcagactggttgaattttactctccgctcgagatccacacgccatgctccagactccaaaagctcttcttcatagactttgattgcagatggatcgcgttgatgactttac

SEQ ID NO: 104673 - DNA, 613 bp, Triticum aestivum
  Clone ID: PAT_TA_104673
ccccctcctcaaaccctcgtccaaaccctcgttccccaatctggccgccgccgccgcgcctgtcggcccgtgttccgtcgcgccgccgctccccacctcaccctcggagccggaggcaaaaccacctctcccatcgccgctggccttaatcgcgccgacccccttcctcctcccaacccccacaatggcagcatcgcagagttcaatagcgatggtgccgtcgaggtgcacagcagagacgcacacggcgcggggcaaggttgcgttcgagattgctggctacagccgtctcaagggcctaggtagaggcaaatgtctccgttcttcagcattctccatcggcggctacgaatggtgcatccgctactaccccgacggatgccaaggcgaggcgggtgacggttacgtctctgttttcgtcgtgctcctgaccaagaacgccgaggtgagggcgctcaacaactggatgcttgtgaatggggttagtgggcagtcgattgtggtgctctcgggtaaagcgccacgagtgttcgaccgaaaaatgccagcatggggcgtaccaaagttcatgaagacaactgctgaagtagagtcggtgtacctgcagaacgat

SEQ ID NO: 104674 - DNA, 609 bp, Triticum aestivum
  Clone ID: PAT_TA_104674
ggtgatattgagctgtgtcgattgttctctctgagtgaagagtttaagtatgttagtgtcagacaagatgagaagatggagctggcaaagcttttggatcgtgtgccaattcctgtaaaagagagtttggaggagcccagtgcaaagatcaatgtgctgttgcaagcatatatttctaggttgaaactggagggcctctcccttggttctgatatggtctacatcagacagagtgctggccgacttctacgagcactttttgagatagttctgaagaggggatgggctcagttagcagagaaggctctgaatctttgcaagatgattgataagcagatgtggaatgtccaaacacccttgcgccagtttcctggtattccaaaggaaattctgatgaaactggagaaaaaagaattggcctgagagaggtactatgacctatcatcgcaggaaatcggtgaactaatccggtttcaaaagatggggaagcagctgcacaggtgcatgcaccagttgccgaagttgaacctttctgcccatgttcaacccattactcgcacggttttgggtttcgaactgactataacacctgatttcctatgggatgat

SEQ ID NO: 104675 - DNA, 355 bp, Triticum aestivum
  Clone ID: PAT_TA_104675
cacctccacagtcgcagtgacgacgacgacgacgacgatgatgcctacactcctctgctgcatctgcatctgcctctgcctctgcctgtgcctgtgcctgtgctgggagagaagcggggccgggggcgaccgcggaatagttccccggcgaatgctgccggccgtcctcgcaaggctgctgctgcaacgcctggagaaccctgtcctgctcctgcaaagggagagccaacagagcattctggtgctggtttagggtctgtgctgctgtctgggaaaccaaagcgaggccgtgggagaccaaggaagctacagcgagttgggccgtccccctcaactggtggtggtggtggtggtg

SEQ ID NO: 104676 - DNA, 553 bp, Triticum aestivum
  Clone ID: PAT_TA_104676
agctttttccccttccgtccttcgtcgccgccgctctagggtttcctcttcccgatccccgatccagcagcagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccgccgccggagcctcggacgccgccgcccccgccgctcccgcggaggacctcaagaactgggacgccgagttcgtcaaggtcgaccaggccaccctcttcgacctcatcctggctgccaactacctgaacatcaaggggcttttggacctaacctgtcagactgttgccgacatgatcaagggcaagaccccggaggagatccgcaagaccttcaacatcaagaacgactt

SEQ ID NO: 104677 - DNA, 425 bp, Triticum aestivum
  Clone ID: PAT_TA_104677
gggccgcttcaccgccgctccgtcacgtcgccatgctccccttcatggcaaaaggccacgccatgccgctgctccacctggctcgcctcctgctcggccgccgcctcgcctccgccgtcaccttcttcaccaccccgcgcaacgcgcccttcatccgcgcggggctcgccggcgccggcgccggcgccgcggtcatcgagcttccgttcccctccgaggacgccccgcagtgcacggacgagctcccgtccacgacgcatctcgtcgacttcgtctccgcgatggctgcgctcgggccggcgttcgcggatgccctggccgtggtcgagcccaggccggacctgctcgtccacgacgggttcatcgtgtgggccaaggacatcgccgacgagctcggcatgccgcggctcgtcaccctcggcatc

SEQ ID NO: 104678 - DNA, 287 bp, Triticum aestivum
  Clone ID: PAT_TA_104678
cctgcctcttcctgccgtggcggccgcctcctccaggcacgccgcgcccctgcctccttccgacgcgaggccgctgcctcctccaggcacgccggggcccctgcctccttccggctcaagggctctttcgccacgaggtagcaaccctgcttcacccaccgaccgatgtgtcgccgcctccgctgatccactcccctcctctggctcctggtcgatgatcccggctcatcctgctgctcgcctcctccctcgcgtatgcatcaacaaaaaataggtgggtcgctgaa

SEQ ID NO: 104679 - DNA, 517 bp, Triticum aestivum
  Clone ID: PAT_TA_104679
gcagcaattaccgagtcagcaattaccgacgtgctctaaactgttaacaaatttattctattggagaaaagtgacaagtctaaaacagagaatgatctttttgggtacaagagagttcttgtggatgaaactcatctggtttctattggtcgccttccagttatggttaattcaaatttatgttggttgcatggactcagggaaagtgactgccttttttattctggtggacactttttgtcaggggaatggagaaggtattattctactgctctctcttaatttaattaatgtatcatgtaaggatgttgcattatcaaatgttttaaacacttcttttgtcactaatatggagtacagagctgtgagatttcttagttttgaattgaactttatatatatatgtcactaagcccaaatgcccttataaagcattagtgcaaatgctacgggaattattatgagcaattctaatacatacacacgtagtgctaacaaaagagtagactggtaccct

SEQ ID NO: 104680 - DNA, 529 bp, Triticum aestivum
  Clone ID: PAT_TA_104680
gcatctgctgttacggccactcccgagagagtttgtagcttcgagccatcggtgtgggatgacttcttcatacattacgagccacaaccactcaagacatccgaagattgcttgagggcgaaggctcaaaaacttcaggaggacgtacagatgttgtttcagacatttaccagtgttgtgcaaaaaatgaacttgatcgacacactccaacgtctcggaattgatcacctgtttgaagatcagatcaacacaacgatgaatgaaatccacaagaaggaattcgacagttgtagcctatatgatgttgctcttcgcttccgcttgcttcgagagcgtggcctttgggtgtctccagatgtattcagtaagttcaagggcaaagatgggagattgaacagggatataattagtgaaccaatgggattattgagtttatacaacgcagcttacctatcgatccctggtgaatcggaactcgatgaagccatcgttttcgcacgccatcatctcgaatccatgaggggcagca

SEQ ID NO: 104681 - DNA, 199 bp, Triticum aestivum
  Clone ID: PAT_TA_104681
tttgcgcccccgtgactctcttttcttcaacgggaactcgaggacacgcaccgccgcatctgcctcctcctcctcctcccagcgcgatggcttccggcgtccacgcggcggcggacggcgtcgccgcgctcgggatctccgccggcgccggcgagtgggccgagccgtgccccgcactgcgccggaacctgcacctcct

SEQ ID NO: 104682 - DNA, 151 bp, Triticum aestivum
  Clone ID: PAT_TA_104682
gcgacgcgggccttccagtactacctggaccgctccacgccgcacgccacgggccgctggctcggcacgctcgtcgtcgccgccgtctacgcgctccgggtcttgtccatccacggcttctacatcgtcagctacggcctcgggatctacc

SEQ ID NO: 104683 - DNA, 382 bp, Triticum aestivum
  Clone ID: PAT_TA_104683
gtcgtgtggtcgcattcattatggcagtgcatttggtgaaccaagtggtaatgctgataaagttgaggacatgggctatattcttgtcaagcacggcttcaactatcatggaaaagatttattgtactcaggcattttaggccatcctcttgagacatatatcttcatggggccaatctactatcagaagctgaagcacatggttcttgataagatgcgtgctcgagctagtggaccacgagttacgatgaccaggaagcctactgaagggcgaagccataatggaggcctgcgtgttggtgagatggagcgtgattgcttaattgcgcatggtgccagcatgctaatatttgagcgtctcctactatgcagtgacccatat

SEQ ID NO: 104684 - DNA, 649 bp, Triticum aestivum
  Clone ID: PAT_TA_104684
accagcgacggtcgcgcctggacgcatcagctagccgaggaaaacggggtggtgcgacgctccactagttctttgttgctgccgctcttttggttgactgccatggaaccgtttggctgagatctctgctttcttcgtcgtcgtccatcggtccaagttgttcttttctgctctgttgcctttcggttgcttctgaagcatgctgcggattcgttgtgcctccttccaatctggtgttctgtgctccatttggttcatctaactcttcatgaaccgtctctatactcatgcatgtacctcgatgttaatttttttaacaagttgttgaagaaggcagatggttctaggcttctcgttgcatcctacactccctgtccggggaatcaatagaaagggttcgcccaccttttgagatcgctctagagaaactgaaaggatccgtagaatcagaagcatcaaagaagtccagttggggcgggggataaagcgtcgggagatttgaaaagaaggagaagcaaggaaacatgaatcaatagatcagttggtgttacaagaggtaatctaagaagttgatctacgaacagaggaaggctagtcttgttgaaaggcccaacgcacccaacaactctgctggtgctggcatctatga

SEQ ID NO: 104685 - DNA, 562 bp, Triticum aestivum
  Clone ID: PAT_TA_104685
gtttttgtatgcatggtgatttggttaaagctaggggctggtttctgaaatgatgaacaaaggtattcctcgtcctgacattgcgttcttcaattcaataataaacactctatgcaaagaaggaggagttatggatgcacaagatgtctttgacttggttactgccatagatgagaggcctaatatcattacatttaattcactgattgatggatattgcttagttggcgagatggataaagcatttggagtacttgatgccatgaaatcagttggtgctgagcctgatattgttacatacaacacgcttgttaatggctattgtagaaatggaaggatcgatgatggtttgactctgttcagggaaatgccacataagagaataaaacctgacactgttacatatggcatcatactagatgggttgtttcatgctgcaagaactgtcgttgcaaggaaaatgttccatgagatgatcgaaagtgaaacgacagtggacattcccgtatacaatataatacttaaaggcctttgtagaaataattgtgcagacgaagcgatc

SEQ ID NO: 104686 - DNA, 492 bp, Triticum aestivum
  Clone ID: PAT_TA_104686
actcacatcacatcaaacgcacaacgcccgagtcagccgcgcgccacgctcgcctccagtcacttctagcttgagtttcctgcccccaatcgattgcatcgcctgtctaggcttccgaccgaacgcactcgtcaggctcgcttgaacctagggttaggaattgtcagacagcggcagcgatgggtgttgaggggccggcgatttcttacctccacgagcagggccgtatgggccgtgacatgaaggtaggaaatgaccccgtggattcctatggctccatcaagctcgccgaaagcgggctgggcacgtgcatgtacgtgacccgctgcactcagttcttcttcttactttggcgagggacctcattattggttttgaaacgctagctagatcgattcaccaggaccaaacctgcaagctagctagacaaggaagctagcacaggtggattgatgaacagtgccacatgcacatgcacgcgtacgtgaacct

SEQ ID NO: 104687 - DNA, 550 bp, Triticum aestivum
  Clone ID: PAT_TA_104687
accgtttcgacgtggccgggcaagagggcacgctgtggtggcacgctcatgtcacctccctccgtgtgaccgtccatggcgccctcatcatccgcccaagatccgggccggactcgtacccgttccccaaacccgacaaggagatcccaattgttataggtgaatggtgggagacagatcctttcgagttggataggagattcgcgaacagtgactttgccgatgtgccccgttcatctaccatcaacggaaagcttggggaccttaatacctgttccggggtcaccgaagacaattatgttcttgaagtggagcttggcaagacgtatcttttgcggatagtaaacgctgcgcttcacccacagtactacttcaagatcgccgggcacacgttcacggtggtggccgtcgatgccaactatgtcaaaccatacatgacggacaccatcgtgatcgcagcaggcgagaccgtcgatgtgttggtcgtcgccgccgccgcgcctacgggcggcaggtactacatggtcgcactgggcatcatgtcattggg

SEQ ID NO: 104688 - DNA, 536 bp, Triticum aestivum
  Clone ID: PAT_TA_104688
ccgcagcgccgccactccacccgcagcggcaaccatggcggtcggcaagaacaagcgcatctccaagggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagat

SEQ ID NO: 104689 - DNA, 456 bp, Triticum aestivum
  Clone ID: PAT_TA_104689
agctcaacgagcataacaagccattctttgatttgtgtgatggcttatttgtcaattatacatggaaggtaaccctcttttccttttctggtcccccgcaatatccccttaatgattacctgcaaaaattgggatgattttggtaggaaaaatatccacgagattcagctgcaactgctggtgaccggaagtatgatgtgtacatgggtattgatgttttcggccgaaatactttcggtggtgggcaatggaagacaaatgttgcccttgatctactcaaaaaagatgatgtctcaactgccatattcgctcctggatggatatatgaaactaagcaacaacctgactttcagagtgcacaaaatcgctggtgggctctcgttgaaaaatcatgggatgttcttcggggctatccgaaacgattacccttctactcagattttgatcagggtcatg

SEQ ID NO: 104690 - DNA, 354 bp, Triticum aestivum
  unsure (1)..(354): unsure at all n locations
  Clone ID: PAT_TA_104690
cggccgcctcctctcccgttgcttacgaccgcgcggccgacctccgcgcgctggacgccaccttcgccggcgtcaccggcctcgtcgcctccggcctcacgcacgtcccctgcatcttccgcgtccctgaaggccaccacgacaaacaggacaccaccgtcctcgccggcggccaagaagaaccaggggccatcccggtgatcgacctcgggtgcggcgaccacgcggccgtggttgccgccgtccgccangccgcggcagggtgcgggttcttccaggtgacaggccatgccgtgccggaggcggcgatggccgcggcgacggacgctatgcgggcgttccacgcggccgacg

SEQ ID NO: 104691 - DNA, 267 bp, Triticum aestivum
  Clone ID: PAT_TA_104691
gatcaccccatgaggattcagactatgactacctcagataccaaggatgttgccaagcaccgtggaacatgtgatgaggatagcacataaaggcgctgattttgttataataaccgtccatggtaaaaaggaagctgatgcctgctttgagattaagaacactcttgtccagaagaattacaacatccctctagtggccgatattcactttgcgcctacagtagctttaagagtggccgaatgctttgacaaaatccgtgttaaccc

SEQ ID NO: 104692 - DNA, 531 bp, Triticum aestivum
  Clone ID: PAT_TA_104692
tcagttgcctttgattcgtattggtcccctccaagttctgatgatgcaggagaaaagtcatgtatcgctttggttctgttggccaggtaccagtaaatttatatgaatgaatgaatttgttaatctgggcctaatttgtaacttttatggtttttattctaacggaaatcataatgatacatcatagaataatctgtttgtttccttgtatacttgttatagcgacaaggatttaaatgctagtgatatctgaattttgtattggttacttgttgggttgcttaggtgacttgcagttgtgaaaaatgagcatgcttgcttcttgttcattagtattcttaccgagttgatgaatcatgattcatgtgtctcactagcttttttttgcttaaaaagttgtgctacactctgtgccacttaccacttgttcatgagggactgggtatcacaaataagttccattgtatttcatgtatcttgaattcgaaataggtttctatctgttttggcattgaatatatatactcttga

SEQ ID NO: 104693 - DNA, 434 bp, Triticum aestivum
  Clone ID: PAT_TA_104693
tcctctcctctcttgtagtaaccaccatggatgtgtcccaagtgctcctacctaagtcgatggtctggccttccccaagctatggtggggagaggagatgtgcttcctccatggctggccggtggacgctgctgcaagggcggtgggagctgcggcgagccagggaggcaacattgtgatcgggcaccaccgcaggtgttacaacgcagcacaaaggccaaggtgcggtgttgctcgccgccggtgttgcaacgcagcgtgaaggccggaggcgggcgccgcttgctgccggtgttgcgttgcagcacgcaggaagaagttgggttgctcgccattggtgttgtgttggagcttttgtcacgtcatcagagttgcaatggagcgccgcatgaggttgcaatggagcatcatcggagctgaatgaagtttcgccg

SEQ ID NO: 104694 - DNA, 158 bp, Triticum aestivum
  Clone ID: PAT_TA_104694
ctgccgcgtcggcagctcgccgcacagccaccgctctggtgatgtactatgcacagatgcagccacaacagcagttacagcggccaccacagcagcaattacagcaacagttacaacagcaagctcagcagcaattacaacagcaagctcaggagcaa

SEQ ID NO: 104695 - DNA, 353 bp, Triticum aestivum
  Clone ID: PAT_TA_104695
tccggcaagcaacaccagcgctctcctctcccctcggttccccgctgcaatgtcgactgacgtggtcgccgatgtcccggcccctgaggtggcggcggccgccgaccccgtcgtggagaccacggcagagcccgccgccggcgacgcgaagccggccaaggagaccaaggccaaggcggccaaggccaagaagccctccgccccgaggaagccccgcgccgcccccgcccacccgacctacgctgagatggtgtcggaggccatcaccgccctgaaggagcggacggggtcgagcccgtacgccatcgccaagttcgtcgaggacaagcacaaggcgcacctcccggccaact

SEQ ID NO: 104696 - DNA, 439 bp, Triticum aestivum
  Clone ID: PAT_TA_104696
cgcctcctctgcctctgcctctggtaccggtagtttccccgccggcagatctgctctgctccggtccgctcccctcaccggcaggcaccatgatgcactacctgtaccagcaggaaatccagcgggagaaccggcggcggagcctcctgctccggcagatggaggaaggccacgccgagctgctcaactggcctgctctgatccagcgcggacgatatgcgcaccaccttgggatcatcaccaggtgcgctacggccgtgctgggcctggcgattctgatctacgtgttggtgctcaagtacaagtaccacctgcccgagctgcaggatcccattgacatgggggcgtgtgtgtttgtggctctctgcttcatcccatccggctacctctgtactcaagactactccatatccaaacttggcttcttgtttgcttgcta

SEQ ID NO: 104697 - DNA, 578 bp, Triticum aestivum
  unsure (1)..(578): unsure at all n locations
  Clone ID: PAT_TA_104697
tggacctgcatgcctcgcgccatcgccatctggccgcgcgggccgccccgcgcctcggccgccacactgccgcgccgccggactcgcgccctccacgccgcgccccagaccacggcctccgcgctgcgacgcgcccccgtgcccggccgcccgtctgcgcgccctcctgcccgtggccgcgccgcgctcccgcgctcagccgcgcccttgcgcgcgcctgtcctgcacccgtgccgcggcccccctggcttcgtgcccgtggcgctcgcagaacacgccgacgccaacgcgggccggagcagcctcgcggagaggttttacggccgcaccatggccgccatcgaccaccgcgccaggacttgagcacggccagccgatcgaggtcgtcataatcgacgacgacgacgaggccgcggcgctgccgtctccaacccctgcggttgttgaagccgaagccagcgatgtggttgtcgatgcggacactgtcgggccgtcgcgcctgccgtccccaccgtcccgctggagagtncgcagtcgagcagccgctccagccgcgcagcagcggtgctcacgctcgc

SEQ ID NO: 104698 - DNA, 470 bp, Triticum aestivum
  Clone ID: PAT_TA_104698
ctaccagctaggcacccatccagccagagatcaatggtaggagaccagctattgatgatcatagataacagacatgcgtctttagttagcatcgtcgtctattttatcgttcaggtaagctaatttggtatatatttggatggattaactgtgtgtctaggcgaacctaaagaaggttggaccgtatggatatggtagccttgatggtaatattgtggacatcgattggaacaaatcgccagaggaactcgtgagcatcgagatttggggcaaccacaatgccggagggatgatctatgccatgtccttcacctaccgtgatgagaaaggggatttagtcccggtaggtccatggggtagcaagaaaggcgaaaaacgcacgatctccattgcaaataatttggtcgcactcaggggcagcaccagcggcagctacgtcacctcgctcacattcaaaaccagcatcaccc

SEQ ID NO: 104699 - DNA, 441 bp, Triticum aestivum
  Clone ID: PAT_TA_104699
taacacagcactctcaagtctcaacgtaccaagagatcaagagaaacatggaggggatggaagatgaggccaagaagaagaagaggaggagcaagaagcgcgcaaggctcaagtcattcctccacttccccaaggccctcaagaagctccatggccatggccgtccgagcgccaacgacaacccatccccttccccctccgccgccgcagccgctggctcgctgctctccgcgtgcatgcacccccggaccaactccttctcctccggcgtccgccaacgccacgtcgctgccggcaaccgcgacggccacgacgatgacgacggcgctcttgccgtcaacttccggtcactcagggtcggcccgaccgccgttcctgacgacgacgacgacggcaacgatgaggacggctcgtcgacgcaggaggatgacggcggttctg

SEQ ID NO: 104700 - DNA, 398 bp, Triticum aestivum
  Clone ID: PAT_TA_104700
cggcgccgtcgcagcaaccgccgcactgtggacgccgtggccgccgcagaggacgagctggacaacgtcgacttctcgcgacgccggcggcgcgccaccgcattcctgcggctcctgcaggcgatccgggagcgccagctgcagcgccttgagtccgcggccgccctcggcaacggtggcggcctcgagacagagcactacagcccattcggccggagcatcttcgcggccgcccccctcggggagcacggcatggcgctgggggactactttcttgggcccgggctggacgccctgatgcagcagctggccgacagcgacgcgggccggcagggcacgccgccggcaaagaagggcgccgtggaggcgctgccaaccgtggaggtggtgggtgggtg

SEQ ID NO: 104701 - DNA, 486 bp, Triticum aestivum
  Clone ID: PAT_TA_104701
cccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaagtgacaaggccgctgctcacttgaagggtggtgccaagaaggtggtcatctctgccccaagcaaagatgcccctatgtttgtggttggtgtcaatgaggacaagtacacc

SEQ ID NO: 104702 - DNA, 565 bp, Triticum aestivum
  Clone ID: PAT_TA_104702
gccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccggtgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacga

SEQ ID NO: 104703 - DNA, 326 bp, Triticum aestivum
  Clone ID: PAT_TA_104703
tagctctgtaatctcgtcggcctctttctctgccccctcggccggcttgccacccgataggtcctgatgtcgggcaccgtctgctccatgtgcggcgacgtcggtttccaggacaagctcttcggctgtgcccgctgccgctgccgcttccagcactcgtacgtacccatcttctcgctctttgagagagtcttgttcgagacactgccaagatgttgatagatgttgatttgtttccttgcatacctacaagcagcggtggcacgaactactacggcgacgcggccccggccgacgcgggcgccggcgtctgcgactggtgcctc

SEQ ID NO: 104704 - DNA, 446 bp, Triticum aestivum
  Clone ID: PAT_TA_104704
aaattagcagctgttaagcatatgtgtttgctatagttccctgtgcaatactagcaatccagcttggcagcatgtatatctatgttcagccttgtaaagctttaatatttttctaatcaatctacctcagggtgcttctcggggtggttgatgcgtacaataagtcaatagctggcaggttttaaaatatcattacacaggaagtaactccatgtggtccccattattaaaatgaaatggagtcagtttaaaatattggtagactatcagcttgatggttatagaaatttagatacatttagcagattcagggtccccctctagaaccataaccccacccaccctcccatatgcacacagcgaattgaacttctttccattcttagcccctgcagtgatcctatcacatctttgcttaaaagtttaatccctgttctccgattcca

SEQ ID NO: 104705 - DNA, 445 bp, Triticum aestivum
  Clone ID: PAT_TA_104705
caccccggcgcggactcccctcgtcacagctcgacctccgctccagccgccggcaccacggcgtctcggtctcactcgccgccgcctcgtcatccgccgcgtcgccggaggtagagaaggagccctcctcgccgtcgaccacgccgccggacgagtcctcagccctatcggccgtggcggagagcgtgaaggtgctcaaggaggcggccaagacgaggaaggtgccggccgacgacgtgctggcggcgctggccaagatcaagaaggccaagctcgacacctccgccttcttcgagacgctcggcgggaccgagtcccccggcaggacatggaagctcatcttcaccgctcagggtagtaagctcggcaaaggcagctacttcccggtgaccgccgtccagcgcttcgacgccgcggggcagaggatcgagaacggggtgtacct

SEQ ID NO: 104706 - DNA, 432 bp, Triticum aestivum
  Clone ID: PAT_TA_104706
cacaccaccactgtccggttgattgccatgagagcccagctcactctagcgcttcttctctccctcgcggttgcctccaccagccccctcgctgtcgccgacgatcttgactatggtggtggagtgaagaaatctgatgccgcctcggacgtctccgccagtgccgagacgaaacccgaggctgactcctacgtccccgccaacgctgagaagaaacccgaagccgtcgcagccagcacccagaataaacccgaagttgcctctgatgtctctaccagcgctgagaagaaacccgaggctgactcctacgtctccgccagcaccgagaagaaacctgaagccgcctctgacgtctccgccagcgccgaaaagaaacccgaggctgcctccgacgtctctgccaatgccgagaagaaaccagaggatgactcc

SEQ ID NO: 104707 - DNA, 152 bp, Triticum aestivum
  Clone ID: PAT_TA_104707
gcgaacggcgtccctctggcggcgaaggcggtgcagtggccggtgatggtggtggtggtgatcatggccgtgatggcggcgcgcgtgggggcggacatggacgcggaccggagcgagtgcgcggagcatctggtggggctggcgccgtgcct

SEQ ID NO: 104708 - DNA, 293 bp, Triticum aestivum
  Clone ID: PAT_TA_104708
tgcataaaaactctcaaggagaacctacaaatgtacttgatgttcttctgaaatggcatttcgtgctctgacgttgactgagttcttctattgtcaagttgcaccacctacagggtctgagactgctcctcactggcctgctctattgcacagtcacgatccatatttttgtgattaatttctctacagtgacatatcccaagaagatatctcgggcagttctgactcctctggcaatggaaccacggaagacaaagctgaaaccattgaactgccccaactaaaaccaccaa

SEQ ID NO: 104709 - DNA, 493 bp, Triticum aestivum
  Clone ID: PAT_TA_104709
ggcgccacgcccataattgtgctccggctcctcgtcggagtggccagcctggtgtatccgggcgtcggggtgtggtcgtcgtggcggcgtcgtcactttgctatggatcttttgtttttccgtctgtgtcgtcctcacggcggttcttgctcttgggctgctgtgtggccgggtggatgtgtacactgggtcgccgtcgccggctgatgttgcttctcatggcgacggcggcggcggtttctcttctggcgcagggttgattggttgttgccaggcctttttgacgtggtcggccggggatggcggatctgaggctcgccaggcaccgaggcacggggtggtcctcggccgatgggccacagtgagatgtgccctttcttcggatctttaaagcttcgatgcgatggcgtgcggcgggtcttcggctcgtggctctcgtcgctccttcctccgacggcggctttgacggcgtgtggaagacggcggtagattc

SEQ ID NO: 104710 - DNA, 396 bp, Triticum aestivum
  Clone ID: PAT_TA_104710
tcttaagtgccaagcgaaacacgaccgattcggaggcccgatcatggcggggcaagccaggtgcttcggcctcgccgtcaacatgttcttggacctggaacggcagtactgcgagtcctacacgcaaggccacgtgaagcgcgcctacttcgtcggcccagtgtcgctgccgttgccaccggccggagccagcggcggcggcgaggcgtcgtgcatcagttggctgggctcgatgccaagacactcggtggtgtacgtatgcttcggcacctacgcttcgatctcgaatggtcagctcggggagctggctctcggattggaagcctccggcaagccgttcttgtgggcgctgagggccgaggggtgggcgccgccggcggggtgggaggagcgtgt

SEQ ID NO: 104711 - DNA, 570 bp, Triticum aestivum
  Clone ID: PAT_TA_104711
atccgaagggccaatgtaccacaacggcgtgtaccacctcttctaccagtacaacccgctgggcgcaacatggggcactggcaacctctcatggggtcactccgtatcccgcgacctggtgaattgggctgccctcgataccatgctcgaccccactgccctcttcgacaataatggctgctggtcaggctctgccacaatcctccccggtggcatcccggccttgatgtacaccggccgcatcgacgccggcaaggaggtgcaggtgcaaaacattgctttccccaagaaccctgtcgacccgctcctccgtgagtgggtcaagcctgcctacaacccgatcatacggctcccgaccgacgtccccggagacaaatttcatgacccaaccacggcatgggtggaccacgacggcctatggcgtatcgcggttgcggccaaggtcggcggccctagtggcattgcctccacgctgatctaccggagtaaggacttccgacgctggaagcggaacaccttgccattgtacatgtcacacactgctgacatggtcgagtgccccgacctatt

SEQ ID NO: 104712 - DNA, 417 bp, Triticum aestivum
  Clone ID: PAT_TA_104712
agcagcgaagcaagtcggtcgtggggctggagcagcagcaccacagcctcctcgatcccctgttctcatatcctatccgtgcgagcatgggaaatagcagaggagcacgcacgtgttgacgtccggggagtcagaggggaggcgacctaccggtggagcgcggtgagcagtggatccggtcggtcgtggggctgaagcatcagcgccgccgcttcctcctttcctttatcaaagctgaagtggtgtcgtcgacgtcgtcgttgatggtggcggtcatgttgcctgggacgccgtcaacacgccggtgctgccgctgctggtggaactatgcaagtcgctgctggtgcaacactgctgctcatggtgcccaacgtcgtcggcgcgcaactctcctaccttctgcccaccgggtcaccc

SEQ ID NO: 104713 - DNA, 283 bp, Triticum aestivum
  unsure (1)..(283): unsure at all n locations
  Clone ID: PAT_TA_104713
gcgcctgtacacgccgtcctcctcgtccgctaccgccgaagccgcggacggcggatccgagcccgcagcgtccaccttcctctccttctccgacccgctcaccggcgacgacggcggcgccgccggtggtggctgcgcgagcgcctcgcgcttgcccgtggaccacgagatcaactccaggatctacctctggcggggacacccctggaacatggaggtcgacgccgtcntcaactccaccaacgagagcttggacgaggcgcacagtaatcccgggcttcac

SEQ ID NO: 104714 - DNA, 494 bp, Triticum aestivum
  Clone ID: PAT_TA_104714
aagaatgctcccatttgctatgtttggtttgagccaaccccctggatggacataacccaggggcttctgaagacaatttatgtcaacaagatgctcaaagctggttacatagttaaaatattgatagcagattggtttgcccaacggaaccataggatttgcagcaataaatatgtaataaggaaaattggctgctacaatattgagatgtggaaagcagctggcatggatcttgacagggtagagcttgtatggttctcagatgtgttggaaaggcatgcatctgattactggccacttgccctggatgtctccaaaaaatgcactctaaaaagaatggcaagctgttgcacggaaacagccccatatgacccgcgactgcctgctgctgtgatattttacccatgcatgcaagttgctgctatattatgtccgaagttgcaggcggatatatggctcttcagcatggatcagcaagaaattgtcatgctaac

SEQ ID NO: 104715 - DNA, 478 bp, Triticum aestivum
  Clone ID: PAT_TA_104715
gcgagctctctccttcctctcgaccttcctagctacacggacacccacagagcaccggtagtttgttaaagaaaatggcgcctcagagcctggatcttggcctgagccttggcctggggctcgtttcccagcccaccctgccgagcttctggtactccggcggcaatgtggcggcggaccaagaagtgggcccgactccgaccgcggcggcggtggaggagaggaggtgctcgcccggtagcccggcttcgagcggcagcggcagcgggctgaagcgtggtgccgagaggtccgccggcagcggcgacgaggaccaggacgacgacggcggcaacgcgcgcaagaagctccggctgtccaaggaccaggccgccgtcctcgaggagtgcttcaagacgcaccacaccctgactccgaagcagaagctggcgctggccaacagcctggggctgcggccgcggcaggtggaggtgtggtt

SEQ ID NO: 104716 - DNA, 648 bp, Triticum aestivum
  Clone ID: PAT_TA_104716
tataatgctttgcttgctcggttgctccttgcttgttggttgctgctgctaacatcttgtcatcttctctatgatgtatttagctgagacagtagccgaatccgaaggagaagtagccacacacccagcaacgaccctggcaccaaactctaacctggcagtacttcagatttcggagttatagggaacatcctacagggataaatatagcctcataaaaagaacatccagtctttacttagggtagattaatccccatttgtattgttaattgcatgtattcttcctttgtcttcctcttgtgctcattcacagataagcgcattgatcatgtagaatttgtaatgatgtgcaacctgcaaagcaccggacgaagacccaacagactggcacagatcgaacgacgaaccgacaagaacagcgagcacgtgcgaacgatggacgaacagaagaacacatcaacatatctggcaagatcccaaaatcggcggctggccgtgcaactgcaacgataatattaagcaagtcatgtaccaactccagaggaccacaaccaatgtctgcttcaagttcctttaacccttccttccttagcaaagctagccagatcctcccatggcaaccaacctggcactccacagtagaacc

SEQ ID NO: 104717 - DNA, 386 bp, Triticum aestivum
  Clone ID: PAT_TA_104717
ccttggccgcgtcgcgtgctgctccggcgacttccgttgcatgcttccgggcaacccagtcaaagtccgtcagtactccacagttgatgcgcttggcgttactgggattctcggctatggtcaagtctgaggtcgtcgatgctccggccagccaaacaattgattcacgaaggtagtctgctctgctggtgtctgccattgatgtggcctgcatctggttccatgcaacaaaggcctcctcgggtcttaccttcagctactcggggcagaaagtttctgtgaagagattcagatagtgaagatcacaaagtaagagcgacaagatggagttggtagtaggtgcctcaaacactaccatgaggtctctcctgggcaagctgggtggc

SEQ ID NO: 104718 - DNA, 532 bp, Triticum aestivum
  Clone ID: PAT_TA_104718
gttccgcgcaccgacctgcaaggcaccccggtggtggacggcgtcctgagcgagatgacgtccgtgacggcggatctgcactcggcggcggcgttcggcgcgacgctgctcggcgacggcgaggagaacgtggggcagttcctgtacctggaggcgatggagtaccacatgtggaacacctacgacgtgcacttctacgcctccttcgcgctgctctccctcttcccggagctcgagctcagcctccagcgcgacttcgcccgcgccgtcctcctccacgacccccgccccatgcgcaccctcaacggcaagaccgtgccgcgcaaggttctcggctcggtgccgcatgacgtgggactgaacgacccgtggttcgagctgaacgcgtacatgatccacgacccgtcgcggtggaaggacctcaaccctaagttcgtgctccaggtctaccggggcgtcgtcgccacgggcaacgtcgcctttgccagggcggcgtggccggcggtgtacctggccatggcctacatggacc

SEQ ID NO: 104719 - DNA, 218 bp, Triticum aestivum
  Clone ID: PAT_TA_104719
cttggcggcgggtttggcaagggtggtggactcggcgggggtattggtaaaggtggtggtcttggtgatggaataggccatggcattggtggtggtatcggcaaaggtggcggtcttggtggtggtattggcaaaggtggaggccttggcggtggatttggcaagggtggtggacttggtggaggcattggtaagggtggtggacttggtggtggaat

SEQ ID NO: 104720 - DNA, 480 bp, Triticum aestivum
  Clone ID: PAT_TA_104720
tgaatgtgctaatggagtcaaaggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctctccagggcccagattgactctgttcttgatcttgcacg

SEQ ID NO: 104721 - DNA, 535 bp, Triticum aestivum
  Clone ID: PAT_TA_104721
aatcgaccgccccttggccgtcgtattgtaggcaacgaggagagacaagctttgcctctaaatgaggtcagagatcatgtaaatgatcagcaccctagttacactatgcagccaaagcgagcgaagctggcacgcttgcatagagtcactcattcagaggagatgcaggatggacttctcagccatgaagtttatggagaggcgggacatagtgaactgatagatgaggctactgcaactcataaaaaccagagagtcggatgctccgttagcccccaaactgtaagtataggggagaggcatatggagactcctgctcagatcatacagcaggtgcacaaacagccttttcatgatgcggtggttcatgcagaaggcagtcagttatactgtctggatcttgatggggtggttcatccacctgtcgaccaagcagaacatggagaagaggcatctcctgagatgatcaataaaacagttttgagggagagcattcggccaactggatgcgctgttgaacccaactctgttaatg

SEQ ID NO: 104722 - DNA, 551 bp, Triticum aestivum
  Clone ID: PAT_TA_104722
cacagccgccgcctaccccaccaacctgccccgacccgctcccgacctccgaggcaatcagcgtccgccgcggccgccatggcgttcgagaagatcaaggtcgccaaccctatcgtcgagatggacggcgatgagatgaccagagtattctggcagtctatcaaggacaaggtagtcaataagcaacagctctgacaaatctgatccgcttgggccattgtgtgtgtgtggttcttgttttccatatgctgtcaggctgattgtttcgtttgtttcagcttatcttcccatttttggacttggacattaagtactttgacttgggagttctacaccgtgatgcaactgatgacaaggttacagtggaggctgcagaggctactctcaagtacaatgtggctattaaatgtgcaaccattactccagatgaagatcgggttaaggagttcaacctaaaacaaatgtggaggagcccaaatggcacaattaggaacattataaatggcaccgtgttcagagagccaattatatgcaagaatgtcccaaagctt

SEQ ID NO: 104723 - DNA, 357 bp, Triticum aestivum
  Clone ID: PAT_TA_104723
cttcgccggaagatccagtcacccgactactcgctcccggacaacgccgcgcagctcctcgacgcgctccttgtcgcggcccgccgtttctgccttgcccctccccggctgctcacgcagatctgcctggccctcgcggcgctagcgctccgtgcggagggaggggtagacgggcttttcgctcgaatgccgcacctacccgaccccgccttgctggagctgctcaccgtgctccccgaggaggtggcgcacgatgagagcggcgacacgggggtcgactccgccacgcggtgcaggttcgcgcgtgagctgctcatgcacgcgcccgccgtgcttgagttcctgctagcgcagtct

SEQ ID NO: 104724 - DNA, 578 bp, Triticum aestivum
  Clone ID: PAT_TA_104724
tgcgtctgataaactcacacggcagctactgcattaatcagggctcatggacggcagtggagcatgactggtggttaggtcgacctcctcggcaagagcaacatcaaggacaagggtggcagtggcgacaagggaggtggcagcaacggcagagcaatggcaatgctaggtctctcccttcctttccttttttttttgagaactctcccttcctttcctgcttggcttattctgcagcaaaaataatgtgattttccctcttctttctgtttttagatcaccccaccttgactatacaaggtaattcttgaagatgcatgttccttaatttgatcctgtgattagttgatttgattattctattgatctatgaacttcttgttgtttttcttcgaatttagaaggatcttatggctaatacattcagtgttttgcctctgatgcctttttccttaataacgctcttttaggttatgttcttattaatacaaggattgctgaaaaggtggacctggtgaagctaccatcaaggggaaactcaaaatcagcattgtcctttgctgataattaaactgagt

SEQ ID NO: 104725 - DNA, 434 bp, Triticum aestivum
  Clone ID: PAT_TA_104725
ccaccatcccatcgcctccgtttccgaaggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcg

SEQ ID NO: 104726 - DNA, 309 bp, Triticum aestivum
  Clone ID: PAT_TA_104726
tgtaatttattttcattttattttgtgtaatccagtgatgattttttattgtaattgtattctttttaattcctcatttggtccctttccagctcagttgttgtaattaatcgcatgccctcgtgttcttttgatttagttcgtgtgttcttttttcttatttgcatgatccattatatgcatctgacaatgtgtatgtactaaacatctgtatgatcagtttattttttatgtttctcatgaggtttattttttctttgtggttgaatccaggtagccctttgaaaaggcacaagccttatgttgatg

SEQ ID NO: 104727 - DNA, 163 bp, Triticum aestivum
  Clone ID: PAT_TA_104727
aaattagtacagaaggcagtgggataatattataatcttcctttgtttccttattaagggccagtcgtcgatattttcctttatattatctccatgcttcaacaatgaaagcattaaccaattcaggagaaagctgcacattttctcctcctttgaaaacatt

SEQ ID NO: 104728 - DNA, 571 bp, Triticum aestivum
  Clone ID: PAT_TA_104728
gacgcaggcgtgctcctgctccgtcggaatcggatatccagcgcattttagacgaatgtttcatcctcctgttcgagacaccctctggctttgcactttttcattctgctttgtcactcattaaccgaccagattctatggaggacatatggtcttatttcatctatgattgcatggcaaaacttgctattacgctgaaagagtttcaaacttttgaggacaagtccagtgccattaatcaaaacagtggtgtcaacgaaaggcttactcagatgatcaggacgtggatcggcgggaagaaactggcagttggaaagcctgaatataaggaaattattgaagagagattgaaaatagactgcctgtataatccagcagtgatggaggtgatgtggggtatacagaattgcatgccaagtttggtgcctggagaaaaatcacagctggctgaagaggaccgcgtcccgatgagtaagggattgcgaaaagtcttgaagcgttatgactgtaatgtcaaaacaaagattgtcagcaagcaaattattgagatggctgccgccttgtttaagtg

SEQ ID NO: 104729 - DNA, 542 bp, Triticum aestivum
  Clone ID: PAT_TA_104729
gcggcgtcttcgcactcgcctctctctcgcgcttccgagctttggcctccgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccaggggttccttgtcttcaacgct

SEQ ID NO: 104730 - DNA, 619 bp, Triticum aestivum
  Clone ID: PAT_TA_104730
ctctcctcctcctcctgccaccgatcccgaaccaggaggaacccggcgcgaggagggcaaaggaagagaagaggagatcaccgagcccagcgcgcgcacaggacagcaggcgccgcgatctcggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctgg

SEQ ID NO: 104731 - DNA, 598 bp, Triticum aestivum
  Clone ID: PAT_TA_104731
gcctcgtgccgtctcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaa

SEQ ID NO: 104732 - DNA, 636 bp, Triticum aestivum
  Clone ID: PAT_TA_104732
cacgaggggcacgcctgcccgggacataaccaagttttcttcaagtaaccacgtctaattcattagacaaacatattacagggattacacacgtgatcatcacacaaaacaaacataggtgtcttgcaattttgcaccaaagactccgcagcaagtagaactataatttcacccgtagagaatcctgtgccatgctgttaaagaaaaggaacgccgtcgcctgccaccacccatgtaccctgcaagacaataaacaaaactgtaccggtcacaaaatcagatcggatctggaggctggcaagaagaccaagccacctgctgccttgtgcagccgattagagcaccgccgattcgagggaagagcagaggcagattattccaacgcggcgtcgtacccaccattgatttagcgcctctcgaagcaaactaagcttatcctatgtcaccgtcggacagaaaccgacgaggtccccgcccactcctgctggacaagggccctgcaccaacactgacggcgagaggaagcaacaaaataacctcccaatcgctgctccagagaggttcctggaatgtacggagcggtttcaagtgctcatatcatggatggagcatcactttccctcttcacttgcctgc

SEQ ID NO: 104733 - DNA, 543 bp, Triticum aestivum
  Clone ID: PAT_TA_104733
gtcctcctcccccatcccaccctcgttagccgccgccaccattatgcctccctcctctccgtcctacaaccacgccaccggaggaagccgtcgttcgtggcgccatatcgctgccggggtgccgcgtaagaggctaggggacgccgccaccgcaagccggcaggaagccaacggcgagcacgccgtcaagatgccgccaggaggacctaccatccggtccatgtcgtcaagcgagggccgcttgttgcgtcgtcgtgggaggaggcgcaccatcgaggagcagcagaggaggagacgaggaccatcaaggagtagcaggggaggagacgaggaccatcgaggagcagcaggggaccgccgaactccctcttcccttccggctgcaccttctccgtccatggacattgtcagaatggtcaatttagtctggcgtattattttcagatatcatgtttgtccaagcctccaagattcaattagatagcatcgtcttctccccgagcagcaaaatggaagttaggaatgtcaactctgctgtgtgtc

SEQ ID NO: 104734 - DNA, 526 bp, Triticum aestivum
  Clone ID: PAT_TA_104734
aaccactaaccgccggccgcgctccatggacagcaccgtcgaagcaatggcggccgcctacgacgcgctggtcgacgccgcggccgccgccgtccgcgagcccggccggtcggcggcgctcacggacctccaccgctgcctcgacgccttcagcgactcctgcgaccgagccgagggcctcgtccagcggccgccgccggcctcggccccgccgccgcccgccacgacgcgctgtgccgcgccgtgcgcgcggtcgacaaggatctccgggccgccggcggcggccaggaggagaacgagatggaccaggaaaagaatcgccctccgaccacgccgctggcggccgaggacaactagcccaatcgatccacctcgtctcccgttgatgtgatgttcatcgttcttgttttttccatgtgatgtccatcgttcttcttggtttcttggttgatgttcccgctaatcttgttagtcatccacggagtagagcattaattcgccgcctctgcttgcaaaataatcatga

SEQ ID NO: 104735 - DNA, 286 bp, Triticum aestivum
  Clone ID: PAT_TA_104735
aacggcgctaacctcagcagcgtcagcaacggtggaaagatcatgtgcatgcaggtgtggcccatcgatggcatcaagaacttcgagaccctgtcctacttgccaccgctcagcactgatgccctccttaagcaagtggactacctgatccgatccaagtgggtgccttgcctctagttcagcaatgttgggttcatattccgtgagcacaacgcatcccctgggtactacaatggccggtactggacaatgtggaagctgcctatgttccgatgcaccgacgcca

SEQ ID NO: 104736 - DNA, 503 bp, Triticum aestivum
  Clone ID: PAT_TA_104736
ggtggacagcggcgaggcacatatttttgcggccaaggaagcatcagcggacaggagggagagctcgcctccgacatcggagctgtcaacgggcaagatgaatccccaggcgcccgggtggaacaagagttcttgcgactactttcgactctttgggcgaggcgtacgacttctacaatctgtactcacgagaagagccggcttattgtcaagaggacgaaatgcatgcaggaaatagtgtgtgggtgctcgggtaaagctgatgttgagaacacaaggtcttgttgctgtgagtaccctgctctggtaaggcttctatgggcagaggacaacgggtagtacattgcagagcatagagagaatcacaaccattggatttcacctaattttgttgagacagtccactgaccattgcacaagcacatcgatgtatacagcagggaccgaatagtggtaaatgcaagtcatctcctatctcagggagctgcatttttcaagttgag

SEQ ID NO: 104737 - DNA, 580 bp, Triticum aestivum
  unsure (1)..(580): unsure at all n locations
  Clone ID: PAT_TA_104737
ggcttcttcagctctttatttggcagctctcttctgtaatcccctctatgttgtcatgaaatttcagcaacacaaatttgtgatcctgccaggtcaaaaaaatggtcttgtgtgggttacaaaccaatgcttgcttgcgtacactctggtgctccagttaaagatccaaagctataatgaacaaaaatcacaagaagagtacaaatgaagttacaacgagctgagcagagtagctggcgatcaaatgatttcgggtccctgctagctatttctgatcttgaagctattccttcaggacacatgattacactatattacaagttgaaaaagtgtgtaaagtggaagttagtactaaagcggattgctctttttgaaccgccaacaaattttagtcataatatgtgccattcaagtggaaacacaaactangacgtgcaattttttttcccgttgcaacgcacgggccctcttgctagaactcgctgatgccgcccaccgccagcaaatccaggagcctggtccacttcatcgacattgtagacagccaagctactgtcacgccgtgacagcactaactgtg

SEQ ID NO: 104738 - DNA, 167 bp, Triticum aestivum
  Clone ID: PAT_TA_104738
tactgcaaaagggacagagagattgggtgagagacgagagggctccggcaagaggagagagggctatcctcagcatgggctcccgcctccttctactctctgagtgactgccagatcgccggagtcaacacccctcgacacatctccctcagcgatcatcaagtgtt

SEQ ID NO: 104739 - DNA, 546 bp, Triticum aestivum
  Clone ID: PAT_TA_104739
cgcggcgttaacgccgacgccgacctcctcagggccgagctccgccgcatgcagtgcttccttcgcgacgccgacgccaagcgccgcgccggggggcgcgacagcgagcgcctcaagaactgggtcgtggacgtgcgcgatgcggcgtacgacgcggggaacgcgctcgaggaggccgacttcctcgcgcgccaccgccacatgcggcgcgggttcttgggcgccctaccatggctcgccaatctcgccgcgcttcacacgttcggcgtgaagattaggcgcgtccgggccaggatccgtcagatctccgacagcgccgtggcctacgggatcacggacctcggggaggccagcgccttggctgatgtcgaggagcaagaggtgacgccttatgacctcagctggaacagtgcagatagtgatttttttgttgggttccacgaggagagggatgctatattcaaggagttgttggatcctgagatttcgccgatttgcgtcgtctccatagttgggatggctggatcgggcaagtccaccctcgca

SEQ ID NO: 104740 - DNA, 609 bp, Triticum aestivum
  unsure (1)..(609): unsure at all n locations
  Clone ID: PAT_TA_104740
tctgactgtcacttgttggcttttcgtttggatatgttacaaatctggtatctgttgtttatttgttgaaggaagaaagcatagtcgatatgatgcaaattttattgtggtgtgtaagatcagtactagtaagaattgagaagttgtgcttgagaaaaacttgtttggataaatgagaagttgtgaagttctgatggttgaccttctaggaatggctgatggtgttttatactttgattccacttcaattccatgcttagttacttgtaaagtgtggtatgtcaatttatacttgattgtgcttgagcttaactgcatgaaatgaggggctgtgtacagttctgtagatattgcattggtattttagttttgtaatatgttcctcctgtgccgtaattatttacacacctgcaggcacaaatgatttatttatttgtcaagttcactcagtttcgtgcccatcttttgctttccaacgtggaccactttattaattagttggcacatcctaagttcttattgctntgtaatcttgtattggcaggttctccagtttatttaccgtctctgattgaactattttttattggtgaactaaatgtggtttct

SEQ ID NO: 104741 - DNA, 585 bp, Triticum aestivum
  Clone ID: PAT_TA_104741
ctctgttggaccttcgaattttggctgcgcgccatgtgttcgaccaaatgccgcctcctgctcaggcggctccacgaccgccatttctccaccgccccgccacctaaccaccggaagagcaacccgcaagtcaccatccggtggccggagcgatacaggccctctaccgatgccggagacacggcgagggcccatgaggccaccgtcaggaggctcgcggcggcaggcgacgtggacggcgtccagtacgccctgcaggagatgcggctgcgcggggtggcgtgccccgagggggccctcgtcgccgccatctgcgccttcgcccgcgccggcgcggccgaccgcgcgctcaagacgttctaccgcgcgcacgacctggggtgcgcggcgcccaccgtgcgggtgtataaccacctgctcgacgcgctgctccgggagaacctggtcggtgcggtggtgccggtctacgacaacatgaggaaggccggcgtcgagcccaacgtgtacacctacaacctgctcatgaaggcgctgtgccagaacgaccgggtcgacgccgcgcgcaagatgctcgacgaaatggcc

SEQ ID NO: 104742 - DNA, 563 bp, Triticum aestivum
  Clone ID: PAT_TA_104742
gctcctaaacactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctg

SEQ ID NO: 104743 - DNA, 477 bp, Triticum aestivum
  unsure (1)..(477): unsure at all n locations
  Clone ID: PAT_TA_104743
aacgccggcgccatgaaaactgctcgccgccgccatgaaatctgctcgccaccggatggtaggtaggcggggcggccgcctggctcttcccggtggtggatccgccactgcgtccgcgtgcggtggccggagaccaagcacgcaggtgttcgacgcaggcccgaccggcgcatcccgtgacccttgcttgctggtctgctcccgaatttcgagggtcgatacacgtacatgatttggacaagagcatgtggagggccggacctgacattttgacggcccaggtgtcgttgctaaaatcggtggatctcgggtagggggtcccaagctgaagatctaagctagatggtaacaggaagaagggggacacggtgcttatccangttcgggccctctcaaagagagttcaaaaggaaaaaaggaaacagtggtcttggcccatattcatagctcggcccacttcctatcacacgaagatga

SEQ ID NO: 104744 - DNA, 485 bp, Triticum aestivum
  Clone ID: PAT_TA_104744
gtggacagtgagcaaaaaagctgcttgatgtttctcaaacacacaactctcaggatactgacactgctaaaaagaagagagggaggcttgtcaaggcccagagcaacatggagcagaagttgaatttgtcaacaccaaggcttgccttggttgagagcggctgcagtaacagcagcaagagcgacatagatgacgatcttgtgccgatggtagctgctgttaattgcaaaaggacatttgcaagcgttcagggtaactttgggtctgctatggagagagctgaggaggtactggtaaagttaccagccgaacatcctagctttgtcaagcatatgctacattcacatgttgttcagggtttctggctgggtctaccgtctgtcttctgcaacaagcatctcccaaaggaggacactacttttgtgctagaagatgaggatgggcataattatgatgcaaaatatctaggtgccaagcaaggactt

SEQ ID NO: 104745 - DNA, 534 bp, Triticum aestivum
  Clone ID: PAT_TA_104745
ccctttaatcatattaatattaagataaattgttctaatatttaaagttgtaaagtttagtacatcatctaatattcagtggagacagtgatagatgtatattatcactattagtgcttcctgcctacttgattttgaaggtacacgacaactggaggaaaaggtttgaggagataccacggtatctatggcttgaagaatattgtaaacaagtaagaacttgtattgagatcgcactacaatgtatggatattgagcgacttaataggccttcgatgaatcatattgtcagtaagctgattccaatacgaaggataggggtacgtcgtgggcgcgctacagccgctcattatatgacatctagtttaaaagtagattatacgtctgccaagttttcaacggacttatcgttgccgatagacatcaacgagatgatagacacccctcagatgccttcactagaaccagaagattcacacattcgcacatgtgaactgccattcgagtttctacgagaaattactaatgattttt

SEQ ID NO: 104746 - DNA, 464 bp, Triticum aestivum
  Clone ID: PAT_TA_104746
caagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccac

SEQ ID NO: 104747 - DNA, 630 bp, Triticum aestivum
  Clone ID: PAT_TA_104747
caaactgaacttcctatcgttggcgtcagtattcccgtgtgcaagctaaatgggcaatgcatgactctttccctgattcttttttcattttggaatctaaaggacaataattttattattgacatatatttacttgatcttgaacgatctgctctgctgcacttatacatatatgtgcattgggttctgttcagagaagtttggatctatacttttatgagcagtccactacacgatcttttcgtatctattatttgtcgatctaccaacaatttcttaattaaagaaggaagaatggatgaagcagaagattacttaagttcagtaaaggcatccaatactgcccccttgatggtcagaatcattgccacatgaaaacacttttgccagtttgcatgaattagtctgttcttttcatgaatattctgcagagagttcattatgctctgctatttgcccttgcttcaaataaaatcggccgcttaactgcaagtattgtcaaagtaataccttctatgattattgaatagttgcttgcatgtgattgtgagttttaactacatgggaatatggatctcaatgcttacctatgtataggttctcatgctcttcatatattatacaatgcta

SEQ ID NO: 104748 - DNA, 317 bp, Triticum aestivum
  Clone ID: PAT_TA_104748
aggagttgaggacgcaccagggattagcacagtagccattacttaatccacaacacacggcgagaaggaaggatatgatggcatggttcgcctcactggtcgttcttggcagcgtctatgtagccgccttggcgttccgcctcctttcgcaccttaccgtgtgcctccggcgctgctatggcacgtgggccgtcctgacggggccaacatcgggcattggctggtccgtcgccatggagcttgcgcgcaggggactgaaccttgtcctcgtcggccgtgatccggcaaagctgcgtgacatctccaagacaatatcc

SEQ ID NO: 104749 - DNA, 420 bp, Triticum aestivum
  Clone ID: PAT_TA_104749
caccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactatatacgttttaatggtaaccaatggaaaatatctc

SEQ ID NO: 104750 - DNA, 539 bp, Triticum aestivum
  Clone ID: PAT_TA_104750
caccatgttcagaaaggaacttttagccgctctgttcttggtgctctgcgcctcagctttatcatctgaaattgagtatgatgaactttttgaggcctctaacggaaccgccgctttttatgcttatccgtcagtcaacttcggtgtgattcctcttgctaatggcctgtgcaataatagagtgagttcaacaagacgcaccgttaaagagtttattgctgatgcttttgagaacaactcctttggatgtgctgggtatcccggtggtccacctgtacccacggtccctaatcctttcactcgtcctgaccctcctccagctgctaatctcccaaattacattgtattacccccaatcgttaatgcccctgctcctcctgctggcagattccttgcagatgaaagaatgacaatctgtgatgcaaatgactttaatactgtgcttgatggcaactcaaaaactactggccttaaatctttcttgtgccgtgacttccctggtatcttctgttcgactaatgatggttctgatgttcctg

SEQ ID NO: 104751 - DNA, 483 bp, Triticum aestivum
  Clone ID: PAT_TA_104751
acctcctcaatcttgtctccctcttctgattttaagtggtgacacatataatgaagggtatgattatgcgtcacaaaatgtcattgataagcttggcgtcagcggtctgagtgaaggaaagattgcttcatccttggttgtttttctagctggaagctgcactgaaggttatatcaatggcttctttgacgatgacaagctgcgagaaggtttaaagtggatggcgaacagttttcctctacagcctgatgtcatcctcgtgaagacacatgagttacttctgaattacttgaacccatcacttgagctacttaacaagcgtgttgcgcctgaagttggtcctgagcattgcatctcagtattcaacaacgctgtcagccagcttggagaagaaattttagctgcagcatacataagtcctaatcagtggccaactcttgagattgatcttctggagagatcgagcagcgagaggatgttcac

SEQ ID NO: 104752 - DNA, 568 bp, Triticum aestivum
  Clone ID: PAT_TA_104752
aagtttcacccggctgcatacacagccccgttttttttatttcagagtaccccaccttgctcgcgcacgtacgctgcccagctcgctctgccgctcgatccgcacgctccggccgcgcgcacgacgcgcacctacgcacgacgcggctgcctcccaacggactgagcatgagcaccccgctagccaacaacccaacctacactcatgcgccaccgcacatgcagcacgcacagacccgccggccactaagccaactaactagcatgcacacaccttgctcacgcacacatacatgggcatggcttgctcctaacatgaccatacgatgctaactctctctgctgcatctgcaattctgcatgggcatctggttagaatgagaacattacgtagtgcaaatacagccaattacctcaccttatttttctcaccatgctatggtcccattcagtgtagttaatttgatgggctccaaaggtgatatgtgtgttcaaatgctacctcataatttttcatttgtggtgtttctcatagccgtttctgtaagggatcaatggaaaacgaccat

SEQ ID NO: 104753 - DNA, 555 bp, Triticum aestivum
  Clone ID: PAT_TA_104753
cctcagtccatcctagcttgatctgctcagccttcgccttccgtcgtgtcgccgcctccgccctcacacccgcctcctctgcgatgctgcatcgcaccccaggtccccacccatctttgctcctctgccccgttgtgtcgtcgctgagtcgcgcctctgcgggtcggtgctaggggatttgttccatgcgacacttgttcgtctcgcctcggcgtcaggaaaggattcctccttcacctcctgtgcaccgccactaacccactaccgcgccacctgacccatctctctccacggtgaggcaatggccgagcggcagcgatgctaggagcctgtaaaggagacaacacaagtttccatggccctagccgtgcccccacgctgccgaggaggacgcactgcggcagtgcgctcgctgcaatggtcaacaaggaaatccacattgtctgaaactgcaacttattatagaagctcacaagctatggatcatcgtcagccgggtagttgtcatcagggcgccaagccgccaaccatgctggtatgcatgtttcttgctgg

SEQ ID NO: 104754 - DNA, 468 bp, Triticum aestivum
  Clone ID: PAT_TA_104754
gctttttcttgctttccagctcaagacaatgtccagaattgcttggcccattttcattactgcagcagttataaatatgctcaaaacttgtttgaacactcctgcatcaaagatgtcacctggcgtgccaccattccaagcaactataaccatggcctgcaaggataaaattaagaagctccacatcctgttaaagctacggaagatgtgccaaaatgaccgtatttcaacaaagttgacttttcccatccaatggtcattaccagctggtctgtgctctccattcgtctgatctcgagcattgagaacaaaatttggagtcttgaaaaaatcagcatcagccctcataggccatcctaaccgaaaacaatctcttgaccaaaagtactcattgagatcatcataatttctccaatgtgagtgttttgatttcattgtcttgctcctatcagcttccatctctatgat

SEQ ID NO: 104755 - DNA, 515 bp, Triticum aestivum
  Clone ID: PAT_TA_104755
ttttttttttttttttttttagaaagaaaatagcataaaatcattcatacatagcatgcatataagtccagtgtcccaaattcgatgcccaacaagtttttttgatgggtcatgtcatccgacacatactgccccttcatattcatctaacaatgtgtgtacgtaaatgatcgtccctctatcctgtgatacatcacgttagcgcgtacgggctacacaatgtgtagagcaacattgagtgcatgaatgattcaatcaacaagtagaggaggaagaagaagtcaagcttgcgatctcctcctttgccgcgtgcaatggccaccttgcctccagctgagcaactatgtgacaaaacttggtgatcatgggccggatggtgtaccatcgatatgataacgacctcacattacgatcatggatgatgtgcatgtcgtagggcgcaatgtgcttttgttcgtgaaatgattcgtgcacttgctgccagaaagtcctccctctgctcctgcctacgaaat

SEQ ID NO: 104756 - DNA, 574 bp, Triticum aestivum
  Clone ID: PAT_TA_104756
gcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctct

SEQ ID NO: 104757 - DNA, 432 bp, Triticum aestivum
  Clone ID: PAT_TA_104757
ggctccaacgagggcacggaggccgccctcgacgcgctgggcgccgagctgaccaccccgctcgtggccgacgtgatgcaccgcctgcgctacgaggagaagctggccttccgcttcttcgcctgggcgtcccagcaggacaactacgagcacgagcaccggacgtacaacgacatgatcgacatcctctccggcacgcggtacaagtcccgccagttcggcgtcctctgcgacgtgctcgaccacatgaagcgccacggcacgaggtcggtgcccgtcgaggacctgctgggcatcctgcgcgcctacaccgagaagcacctcaccaacctcaggaagctggcaaagaagcggcgggtgcggatgcgcacgccgccggagaccgacgcgctcaacatcctcctggacgcgttctgcaagtgcgggatggtc

SEQ ID NO: 104758 - DNA, 358 bp, Triticum aestivum
  Clone ID: PAT_TA_104758
ccgcgccgtagaccaccgcagcctcctgctggccttccgggctatgctgcgcgcgggagtcgcgccggaccacttcacctttcccttcgccctcaaggcgctcgcccaggcacgcgccgcacttttccgcgcgccggcggagcccttcggtgcctccacgcgcagcttgccaagtctggccacggcgccgacgtctacgttacttcctccctcgtccacgcctacgcggcagccgccgccgacgccgcctctgcacgggcggtgttcgacgccgcgcgccaccgcaacgtcgtcacctggacggcgatgatcgctgggcacgccgcggctggggaggcgcgggatgcggtcgcgctat

SEQ ID NO: 104759 - DNA, 473 bp, Triticum aestivum
  Clone ID: PAT_TA_104759
cataacctcaccgccgacgagcaggtcgcgcttctcctgtaccacggcctgacgatggcttactctgaggagctgctcagctgggtgacccgggtccacggggagttctcgacgcttgatggggaggatatgctcaccatccgtcaccacagaggcaggctgatgctttcttcgtggccgccgtcgtcacgtaacaagaccaggatcaccaagacggtcgtcgacgacgaccatctcgccgtctacctcatagacgccgtgctgattccggcagatcccaagcgtcaaagagttgtggcacttatcgtcattattctggtacttgttgccggcgtgctcgtggcgttgtgagttttctttcctcacacttaattccgctacgatcaaatggaagcacatgcaaaacgcagcacgtacgcctgtccatagcatcagttcatgcaatttgttggcgcactagctcgctcttgttc

SEQ ID NO: 104760 - DNA, 564 bp, Triticum aestivum
  Clone ID: PAT_TA_104760
gcatctcccccctcctccgtcctcccctcccgtcgcccgcctcggcctcagcctcctccagtcctcggagccctccacgatattctctaggaaatggctgacggtgaggacatccagccccttgtctgcgacaatggaactggaatggtcaaggctggtttcgctggagatgatgcaccaagggctgttttccctagcatagtcggtcgcccacggcacactggtgtcatggtagggatggggcagaaggatgcctatgtcggtgatgaggcgcagtccaagagaggtatcctcactgaggctcctctgaacccaaaagccaacagagagaagatgacccagattatgttcgagactttcaatgttcctgccatgtacgtcgcgattcaggccgtgctttccctctatgcaagtggtcgtactaccggtattgttctcgactctggtgatggtgtcagccacactgtgcccatttacgaaggatacgcgcttcctcatgccattcttcgtttggatctcgctggtcgggatctcactgactcccttatgaagatcctcaccgag

SEQ ID NO: 104761 - DNA, 407 bp, Triticum aestivum
  Clone ID: PAT_TA_104761
cacctctcgacgccccagcgcgtggtcgccgtcgctgctcgtctctttcttcccacgacgcctccccatcctccatcagccatcgccgcggctgtgggcgcgcagcggcggagcgggaggcagcggcaggcgtaggcgggcggtgaagggaggcggacgcggtcgggccacggcggcggcgggcatggcggctgcggaagggcgcagcggaagcgagcagcgctaaagggtgtgggacagggcgcggccggcgcgtgcggtgcacgaacaaggtgtgcacggggcggtcaggcggggcgagcagcagcgcgcgcgggtggcgctcagaagcagcagcgggctcgcgcgggtggcacggggcgcggcctgcagagccgacgggtggtagcgggcgggggcacacgccc

SEQ ID NO: 104762 - DNA, 568 bp, Triticum aestivum
  Clone ID: PAT_TA_104762
gttaaacttcttttacaaaccatgacatttttctgacaaaccatggcaaatctatttaattggaatagattttccatactacatggcacttttttccccggaacatggcaattcctttttatgaagcatggcaaatttagttaaatggatttttttctattgagtacaaaattgtcatagcacatgcaattgatttgccgtactacatggcaatttcccccctccaccttcgcaagtttattttacgaaccatggaaaaaaaaaaaaacctgaccatggcaattatattttatgaagtatggcaaattcagtaaaattgaatagatttgacatattacatggcattttttccccatccaccatggcaagtttatttctaagaaccatggcaaatttagttatttgaaacagatttgccatacgacatggcatttttttccctagccatggcaattctattttttatacgaagcacgccaaatttagtaaaatggagtagatttgtcatacttgatggcatttttccccaaatcatggcaattatttttgttaaaaaccatgggaaatt

SEQ ID NO: 104763 - DNA, 389 bp, Triticum aestivum
  unsure (1)..(389): unsure at all n locations
  Clone ID: PAT_TA_104763
cgtgttctggttggtgccgcagttcgcgctgatgggcgtggccgacgggttcgcgctggtgggcctgcaggagtacttctacgaccaggtgccggactccatgcgcagcctgggcatcgggctgtacctgagcgtgatcggcgccgggagcttcctgagcggcctggtgatcgcggcggcggaccacgtgagctcgcacggcgggcggcgggccgggtggttcngcaaggacctgagccggagcaggctggacctcttctactggctgctcgccgccatctccgccgtcaacctgggcttctacgtgctcgtcgccgcccgctactcgtacaagcagaccgtcaaggccaaaagggtgagcgccagcgacgtcgagtgcgccaccgccg

SEQ ID NO: 104764 - DNA, 558 bp, Triticum aestivum
  Clone ID: PAT_TA_104764
ctttcttgcctgaaggagcttcgacactgcattttcagaatcccagtgccgaaataataagacacagagcaatccccaatgtgttcgcaaatctcgagcaagctcgatacaaacagagtcaccaacagggaagccctcttactccatcatggcaacatttgcctcaggacatccatttctatgctggggactgggatgagcttcacacggtcctgtcggtgatacaagaggatgaggtggatgcattgtcaggagtaggactagggttctgtgaagatgactttttggatggttgcagcagccaggatgggaacaatatctgccacgaaacctcgtcaagacgatcaacaaaactgtcaggcagccgtgcatgggagaggggaaacgaggcctgcacaggagatgagggtggataagatatagtgttagtgaatgagatcccctactctgcaagctctcttcaaaacctatattcgctcatcaaaaaagttcgtaaatttttaatgctattctccgtgtcattttgttgggaagatactttcttgcgatgagatgcct

SEQ ID NO: 104765 - DNA, 537 bp, Triticum aestivum
  Clone ID: PAT_TA_104765
agaaaactgcaggccactgcacgtaggccctccttcagcagcgacctccggcgcactccgagctccctctgtgccgagtcggtgacggactgccagtcggactgctccgactcatgggcatcggctctcatcaccgagctcgaccagtacaagaccgagacaaggagtgcaagcctagcaaccacagtcgacatcgctgtgatggatgacttccttgagatggagaagcttgcgtcagccaacggcgccgtctccaggagcaattatgccgaggacaccggtggtcagatggagaaggccaggaagatggcggccgagaaggataaagccttgcacgaagcccagcgcgagctgagggcttgccgccatcgggcaatggtggcaaaggagagatcagttgagatgcagaggcagctgaatctcgtcaacggagagaggcatgccatggaggccgaaatgcaagacgcggagaggaagaggaacgatctggagggtagacttgagatggcccatggcgagatcacgagcctgttggac

SEQ ID NO: 104766 - DNA, 637 bp, Triticum aestivum
  Clone ID: PAT_TA_104766
catcattcaagccaagcaagcagtggtcaatacaaatccaccatgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacattttgcagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaaatccttcaacaaattctgcaacaacaactgattccatgcagggatgtcgtcttgcaacaacccaacatagcacatgcaagctcacaagtatcgcaacaaagttaccaactgttgcaacaattatgttgtcagcaactgtggcagacccccgagcagtcacggtgccaagccatccacaatgtcattcatgctattattttgcatcatcaacaacaac

SEQ ID NO: 104767 - DNA, 229 bp, Triticum aestivum
  Clone ID: PAT_TA_104767
cacggcacgggtaagcatagcaagagccgtcctgtctctccatccatctctctccccgtccccatatgcgtccccagatctgccgagcggtggcagccatggccgaccccctgtgccgccgcgcgagcggctgagaggaggcggcacaggggagcggccgtgcaagagctcgggggcagaggaggagaggaggcgaagagcgcaggagaggaggggggaggagggggat

SEQ ID NO: 104768 - DNA, 481 bp, Triticum aestivum
  Clone ID: PAT_TA_104768
cgatcgtccggcggccagaccaccctacaatcgttcctcgtcaagcccagagtcgccgatggggaaccaaatccctacccgccggtagcggaggacgatgagattccgaactccccgccggcgccgccgaagcgggagatcgtcagggtcaccaacaagaccatcagggagaaggcgagcgcgttctcgtcggtgggctcctcggcgaagcgcggggccgacgcgggcgctctggacccggcggtgttcaagcggttcaacggctcgtcgcccccagcggcgagagccggcggtggcgccgctgctgcggaggcggggggcgacgcggacgacggcgatggcggcgtccggctcgacgtcgaggacatcgcggcggggggccgccgctgggagtcacggaagcggaagagccccttcggaggcaacgaggggcgcacgagcagcaacgccgggcacgtggtggtgctcggggacaacccga

SEQ ID NO: 104769 - DNA, 415 bp, Triticum aestivum
  unsure (1)..(415): unsure at all n locations
  Clone ID: PAT_TA_104769
ccggtggcgtgctaccttatcttcccttgctccagtaatagaaaccccagtttgagatcccaaattcttctctgaaattgtgattcatagcttggagttcagttgattatggtcaggttcctgacaattggtatctagagccagtcggttcttggcgggaggcgtgatctggagtgcaaatccctcttcaagctccaaatcangaggcggagatagatcggaggtggccggagaggcgttgtttgggtgcggtcagagttcagcctggttgcagaggaacatttcctccgtactaaaatcccagttctgaactccgtttgtgcgtcggtggtgaggataagaaagagttccaggacttccaagacatggtgaaccgcaacttcatcaccatgcagcagaattttgacaaaattca

SEQ ID NO: 104770 - DNA, 424 bp, Triticum aestivum
  Clone ID: PAT_TA_104770
ataccagacgcttgccaccggcgacgtcgcggcgagccctactgccgggtacaaatccctaggcagccacgccggcgtcctggacgtgtgctccatcaaggacattggcccggcttccatgggcttcccttccctgcaggacctgcacctctacggaggcggtcacttagacctgcagcagcagcagccaatggagagcttcttcgcgtgcagcgatggcggcggcattgggtcgttggggaagaagaggtccaaccagtacgccggaggcaagagccctatgatgtggggtgacgacgacgacggcgacgaggatgacaagggcgatcagctactccagatggcaccgccgatgatggacgacatagactccatgtacgaagcgaagccgatgatgaccatgtccggcgactccgctggtaac

SEQ ID NO: 104771 - DNA, 550 bp, Triticum aestivum
  Clone ID: PAT_TA_104771
ttatcatacttctttggtccgctatctatttattttctgtttgttgggatagtgcatcactttatcccatggttgtctatgttttgcaccaggatactactggtaataataaggttattcttgtcttctacagataaacaaaacaagggagctgacgcagatggcctcttaattgatgatgatagtcatggtcaagttggggatgatactagatgccgccttgaaattgttggtttgcctgcgtccaaggaatatgatatggtttccaaccaatttgtgttacaaaaagttctcatgcaaattggtggtatccagtctcgagttcatcgtctacaagagcgtctcagcaaggctcgctgtaaacaagcaaagttggcatctttcatggatcatgaccaggtcaaggtggctgagaagaggcaaaggatacaaaaacgcgcattctctcctgagaatgatcgatatgctaagccacagaaaaagaagaagctaaacattttgctggagcaggaggatggaccaactctgtcagtaaaacccacattgtctg

SEQ ID NO: 104772 - DNA, 445 bp, Triticum aestivum
  Clone ID: PAT_TA_104772
gacaacgcggcggcctccccgtcagtcgccatcggcgttgccaaatcgaaggcgtaggcacgggtggctgcgtctccgccgtcagcgaggtcctatgccagccgtgccgaggcggagagcacagcggcggcggtgagggagaaggaggtgtgctggcggaggagctggagaatccgcgggagcggcggggccggctgcgggccgcgaggcaggtcacggagagggtgctggcggaggcggacgaggcgccgcggcgggagatgcgggagtgggagtccagggcggacgagcagcgccgggtcgtggcagacctgatgcgcctcatcggtatgccggaggtacggttccgtttgtttctattctgtttggtagatgctctggcgcttgattctaaatgtctgtggggtgctgatcatggcggcggctggtctatgttccactggaa

SEQ ID NO: 104773 - DNA, 497 bp, Triticum aestivum
  Clone ID: PAT_TA_104773
caagtgaattagcagaaataaattgcacgaactattatttttttttcccataaatgtgaagcatgtacaactatttttctattgcaaaaaaaacattccttgccccaagcgagccagcacacaaataagagtgactccaagcttttttctgaactgagttagttacgttatccgtaagagtatcttaggttttaagtgacaatcttcaaactctctctgcattattaatttaatttttgtaaatactatgaagactaaaactttaagaattaaaccaataagtgtatttagtgaagtcagaggtctgtttggaatattcttagtgcaagtctgacatgaaaggagggctgtcacttttccatgactgactggtgcttcatgaagcaacggtcataatattaatcaaagtcgaagcctttgtctaatctccttttttgtaaaacattattttgtaatattcttaacttaattaatgatcacttccattatgctatcat

SEQ ID NO: 104774 - DNA, 527 bp, Triticum aestivum
  Clone ID: PAT_TA_104774
atgtcacaaaatgcatacaagcagatccatatgatcatatatatcataaattgccccgtggctatcattttctagagcgagtgcccaactgtagacattgcaatgcgaaaaggttccaatatgagacgccaacattttgttgcatgaatggaaaagtaaagatagtaaccccagtggttcctgatgaattgcgtcagttgtacatgagccaggatccaaatgcaaaatacttccaagatcatatacggtgcttcaattctcatttctcttttacctctcttggtgtgatcctggaccgaagattctgcaataggaggtttggagtatacaccttttgcgcacagggccaaatttatcaccgtattgaccagttggttccaaaagaagatggccccaagcatttacagttatacttctatgacacggatgcagatttgcaacaaagatttcttcactcgccaaaccttgaccaaactctgatccggaagttggtgaatatactttcaagtaatccttatgcacaaata

SEQ ID NO: 104775 - DNA, 638 bp, Triticum aestivum
  Clone ID: PAT_TA_104775
aactcgagcttataccagtaattaattaatcgggcagaatggcgatgaaagacgatgttcagttcaacgatgtcttggaagttctcaaagtgtacttctttgcaccgacctacatagatcggagaaccgaaaatctatttttagtgaacgcaaagcaagcgattggcgtcgtcatattttatttcgtgtcgattaaattattgaagatgtacatggccgatcgaaaaccgtatacactaaagacagtatcgttcatccataatgcatttttggttttgctgagtacctacatgtgcattgaaactttcatggcgaataaagcttgccaggaaaaatcattccttggtagcgtatggctacctcagataaaagtcggagcacctttcactcctagctgccagcgattagtagctatcttacacatccattatttgtcgaaggtatatgaatttatcgacacctggattatgatcctgaagaagaacgatcgtcaagtcaccttcttacacacatatcatcatgctacgactttcttatgttggtacgcgggattggttctctatcctggaggaagtatatacattgtttgcgctctcaactcatttgttcatatcttcatgtatctctactacctcgtt

SEQ ID NO: 104776 - DNA, 350 bp, Triticum aestivum
  Clone ID: PAT_TA_104776
gaagggaagggaaggaaagagaagaggagagtgagcaggtcaggcggcagccaaggtgctcgcagattcgccggcgatgtcgtccgaccttggcctccgagtgcttgtgctctgcctgctccgcgcccacgcaatggcctgctcaggatgccgccctctcccctgctccaaccctaatcccctcccctcccctcccctcaagctgttgctccttttggtcacgcaggtgcacgaacacgtccctgctcctctggtggacaaggtcggttccgatctggatgagtagcaattgcttcaggtggacgaggcacgagccctcatgggtcctccttcctcctacccccaccccc

SEQ ID NO: 104777 - DNA, 457 bp, Triticum aestivum
  Clone ID: PAT_TA_104777
ctccaacgcggaacggcgatgtggcgggcgaggcggtggccgcggccgcgatggttctcgtccgacaccgcggcagtgggcgccgattcgggcaatccggcgcggcgtcgggtggcggcgctgtgggggaacggggaccacggccggctggggctgggggcgctggagtcgcggtggagccccacggcgtgccccttcttcctcacgcgccccgccgacccgcctacctcgctcgcctgcggcggcgcccacaccctcttcctcaccgagggtgggcgcgtatttgctacggggctgaacgactttgggcagctcgggataggctcctcgatgcctcatactctggaccctgttgaagtctctggatttcacgagaaagttgttcaaatttcaactggcaaccatcattcttgtgcagtaacagccgatggtgagctcttcgtttggggcaaaaatt

SEQ ID NO: 104778 - DNA, 194 bp, Triticum aestivum
  Clone ID: PAT_TA_104778
gcacctttggaacgcatggcatcagccatatggacctgcatggatgtgatagtttactcaatcatttttatgccttcaactacagctaccacacaacttcattgagatttgttttctataggacctgaattaataatctccaacaatatggaataggctagcacaagagaagatttgacagtaaacgctcattg

SEQ ID NO: 104779 - DNA, 609 bp, Triticum aestivum
  unsure (1)..(609): unsure at all n locations
  Clone ID: PAT_TA_104779
cggtgaatctggtgttggcagagatactaatcaagtaatcattcagtccatgggaaccacgaataaatatctgtaataagactatgttttgtctgtacttatttgctccaaacttctaacattcagtcggaaggatcacagtggttagtcaggctgtttttttaggttgtattaccaccaaattcaggcctactcccatgtagcttgttctgtgaaaaatgggatatcagagtgcaatatctgtaacacgcaatgcactgctagtagagttgtcttctgcagagcattgttgctgtacctaatatattcctacttgcgtaaaagcataaatgggtttgcagcaggggcagaaattcaatgagaaacttggaatctggtcttcagtcaggcttatatttctgttgcagatgctagcaaaatgcttggagcctgatgttcttttcttttctgggtactcctgatgttctttagtaatgccagaaaactgttgggagggtcatggaatttgttccatcacaagaagctttgcgttttttaattattatgtactccangtgtgatgaattgtcttttctgatcttggaaatgtttgtgtagctatgcctgtca

SEQ ID NO: 104780 - DNA, 482 bp, Triticum aestivum
  Clone ID: PAT_TA_104780
ttccaggttgaactcgacgaactcatcagcagccggctggcggatcctcgacacaaatcagcagccgatgggcacagaattttatgagaccatgctcatcatcaaaggagcccgagctgagactgaggatgatctgagccagttgtttgaagactttggaatcaatggaagccaacttgcagcttcattcggtcctcctacttttgtgatggactccaacttgactagcgacgcggcgccagtcccatcgccgttgagggtggggccctccgccgccttgacggtagacttgataggtactgtgtgtgctataaaagatccagcagtaatgttgcattatatagcacttaaaattgtcatggactctactagttccgactttggaactggtggatgaagctgttcttgcagctccactcagtccttctgcttatatgatcgagaaaaacttgactcacgacgaggatccagctgccacgctg

SEQ ID NO: 104781 - DNA, 595 bp, Triticum aestivum
  Clone ID: PAT_TA_104781
tactttgtattgtcgacgaagatgaggaattcagtgggaagtctgtatggtcgtgggaacagggaatgcgtagcacggtttcaacatgtagtctcatccagacagataggttactcatctgttccgactttggcaatctaagtggtgattccatagggtgatttgaggctctctgcggatgtttttcgccgctcctgaagtcctgaggtatggatagcgcgagtaggagcccttgtgattttattcttgcttcccagggcatgcccgaggttttccagtgatggctggcattcatggccctatgttcttagccttatgagttgctcagcagtgatttctaatgtttcagctttttcacctagacacggccaccgcatatttttgggcttctagtgtttgatgattgagcctaccacatataccttatcatttttatgatggtgtagtggttaggaatatggacttatagtcctttgattttctagtgaattcatatgtgctaatctcattttggtaacacaaatttttagcccatcaaagatggaaatttttagtccatcaaagatggaattctagatcagcatgcaaggatgtg

SEQ ID NO: 104782 - DNA, 573 bp, Triticum aestivum
  Clone ID: PAT_TA_104782
gcaccatgccgtttgccatcgacatcgccgaggagctcggcatcccggcgctcgctttcgccacgcagagtgcgtgcagctacctggcactcctgtctatgcccaggctcgtcgagctcggcgagagccccttccccacggacgacctggtgtgcggtgttccggggatggagggcttcctccggcgccgagatcttcctcgtggactctactgcgctgaacaaggcgacagagacccctggatgctcaagcttgccgaggtcaccgctcgttccagcaaggcatgtgcactcatactcaacaccaccgcgtccatggagcagccagcgctggctcacattgcgtcgcacacaagcgacgtcttcgctgtaggcccactgcacgccaggtcaaggctcaccgcaagcgcaagcctgtggcaggaggacgacgggtgcatggcgtggctggacggccacgaggaccggtccgtcgtgtacgtgagcctggggagccgcgcggtgatcacgcaagagcagttcaccgagttcctctccggcctggtagctactggatacgccttcctctgggcgc

SEQ ID NO: 104783 - DNA, 557 bp, Triticum aestivum
  Clone ID: PAT_TA_104783
tccatcaaagtattcatccacatttgctgtggctcctggtaataaacctatctatattgttaatcatgccatgataatagatttctctaggaaaaagaacatggtcataagcgtgcctatatcgcttaatgttactagtagcttcttacctaggatttaaaagattatggctggttaagagtctactttgtatggcttgagaagttcctggaaactgttaccctgtccaatgcaaatttggcaaacctttggtcagccatctgacagcccataatgcaacttgtttataccctatacaatgcaaatttgttatcctgttcaatgcaaatttgtcctttggtcagccatatcacagcccataagactcataggtataacatcatgttgtggtcaatctatctggactcggttctgtttccccttgtgaagtcggcggatcttcagatacttactgtcatagcgctttagcttcacttccattacttttctattatttgtgctataaatctttcttctagaagtagagctttagcttcacttccatttcttttctattc

SEQ ID NO: 104784 - DNA, 518 bp, Triticum aestivum
  Clone ID: PAT_TA_104784
cggcacgaggtggtttcttgcttgtgtctgcagcaaaagcggtacagcaccacggaggattcccggagcgaccaccgcgtggcgccgtactacagccgccggctgtcggcgagcgtggagtcgtcgtcgtgctacggctacgaccggagccccaagatcgtggagatggacaccggccggcccaagtcgcgctcctcctcgctccggacgacctcccccggcgccagcgaggagtgctacgcccactcggtgtcgtcgccgctcatgccgtgccgagcgcccccgcggatcgcggcgcccaccgcgcgccacttcccggagtacgagtggtgcgagaaggcccggccggcgacggcgcagagcacgccccggtacacgagctacgcgccggtgacgccgaccaagagcgtgtgcggcggctacacctacagcaacagcccgtcgacgctcaactgccccagctacatgtcgagcacgcagtcgtccgtggcgaaggtgcgttcgcagagcgcgccgaa

SEQ ID NO: 104785 - DNA, 631 bp, Triticum aestivum
  Clone ID: PAT_TA_104785
tctcgtttccctttcaacacgttatcagcacgctcccggcggagcgattccatctgcgcgacgattccccctacagcatcattcgctcgcgtgttcgtcggcgtggtggtgcccgctactgtggccgccctcaggaccgacgtccctacagcgcgctgtggccatgaattcctgcaggcaaaacaaggccatgaagaacagaaaatgaatgaagaacaggggagatggcatccatcgatcaaaagattggaggtttaaaccgagaattcattgtctcccatcacggcaagagtgtaaatcgagatccaccaacgaacagatcgggaagaaaacagaaaaggtacacgcgttgatttcttaaatcgctttacctttgtttcctctatgagggacagtctcgtcgcgaagaacgacggcggtcgaaccctcgggccccatgggcaaggtgcctcatcggcgtccaatggtgggagaccgccctcggccgcgtgatccgtcgcacgagcgatgggcatctggcgcaacggcatcctggccccggcgctgctcctcccggcacaccccgtgctcgaccatcggccttgcccccacgggcgcagaggcgactcggccccgacgctgacacatggag

SEQ ID NO: 104786 - DNA, 383 bp, Triticum aestivum
  Clone ID: PAT_TA_104786
caaagttgcaggtccttaatggcaattatcgcattccagaacaacctaagtacagcaccagtgtcacagggctgatcaaatatatgctggaagcatctccaaatgccagaccagatatcacacaggtctggtttcgtgttaatgaactactgcctcttgagttacagaagagtttacctgatggggcttcagcagcaatttctatgggcttgcaggacgatggtggttataaaagaacacatgtgacgcctaaaaggaacccccctgcacctccaagagaacaatctgataactcatcatctcatggaagtgcaaatgccggagatgcacctctatgtgcatcttgggtgacccaacatgcacagggttctcaagttgctgat

SEQ ID NO: 104787 - DNA, 519 bp, Triticum aestivum
  Clone ID: PAT_TA_104787
agctcgccattttcgccggagactgctgctgctgtcgtccgacatactctgttcttgattccaatttcttttccgggccgggcgactctgctgtgcaacttgcccactgactgcacacaaagtgattgtttcttggcataattctggcacaaatggacgacggggtggacctcccgagccaattcctcttcccgcacccggagatgcccggcgccttcagcgacctcctgggcgacgccgccgcgacctgcacccacacgcacacctgcaaccctccgggcccgtcagccgccacgcacacgcacacctgcctgcacacccacacccaccagctcttcgccgccggcagcgaggacgacgacgcggcgcggccccgccggccgctggggaaccgggaggccgtgcgcaagtaccgggagaagaagaaggcgcacgccgcgttcctggaggaggaggtcaagcagctgcgcgccgccaaccagcagctccagcgccggctgcagggccacgccacgcttg

SEQ ID NO: 104788 - DNA, 193 bp, Triticum aestivum
  Clone ID: PAT_TA_104788
ttgtaactgcgattgccatacttgtagagcttgtagctacttattacacttgtagagcttctggagaatgtttggagtatcacgtgtagagcttgtatatgttagagcttattatgtgtagagcttgtaaagtatatgttatttgtacaataggagctttgtactgaatctggctgataatatttggagtatt

SEQ ID NO: 104789 - DNA, 544 bp, Triticum aestivum
  Clone ID: PAT_TA_104789
gaaagcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgactt

SEQ ID NO: 104790 - DNA, 585 bp, Triticum aestivum
  Clone ID: PAT_TA_104790
tgttgctctccctcccctctccccccctctctctcttgcgcgcttgcttgctcccctgctccgtgtgagcgaggccgagacggagcaccagcggaggagggctgtgctgaagaaggctgcgccagcgagagcttggtgactggtactttgaacatgctttttgcatatcactgcattaaggatgaataaaatgttaagcaccgactgtttagggaggcaggagtttcatacattccacaagaccactgaaatactggaagactggcaacctcaagagattgcattccacgaaacagcgctggggtcaacgctagtagatcatcaaaatgtccactctactgccgcagtatcagcggtagacattggaatggctgaagtcagcttgttgcatggtgaatctgacacatcagctaccggtttactgccagtgtcattcttgtcatgcagtcctagatctatggttccaatatcagttccttcatcatctagccttgaagccatcctaacacctaatccaatgtacagtgatgttcagttgaaagaagtgatgaactacaatgctacagcaatggatgaaagcactga

SEQ ID NO: 104791 - DNA, 376 bp, Triticum aestivum
  Clone ID: PAT_TA_104791
ccctggcgcccctccgacacggcctcgccgacgccttccgcggcgccgatttcttcaagacccgccgcatgcacggcctcaagcacgtcgacgactccgggtgggagttcgactacatgttgggcgacgagattcaaatcgcccaccggaagcagcgagccagctacagcccgctgaggcaggccctgtccctttaccccgacaggcaagttttgaaggacaacagcttccttgagttccacacgctctcctaccaggaggaccaggggctgcagcatgtggtctgcatccgccatgaccgctattgggcgcgggcaagtgtcgctctcttctcatccaacaccatggagtggcaaattttcccttgggtggaaac

SEQ ID NO: 104792 - DNA, 99 bp, Triticum aestivum
  Clone ID: PAT_TA_104792
atgtgctgaagaaaatccgtctcgcgaggcagacggagcgctgccgcaagtctgctcatcaagagatggctctcatcgctcgactacaacatccttaca

SEQ ID NO: 104793 - DNA, 446 bp, Triticum aestivum
  Clone ID: PAT_TA_104793
ttgcctgtgtgctctgtttattttcgattggtagctgtgtgattcagtgtttttgcatgttgtatgtacagggatttgatggacgcatttgggatctcggctctcttcaaagtgattctgaatcttgtttgggttggttgatgtggattatctaaaggcgaagaggcgacagaggtttaacatgcacaatgcaagctcaggtggtgtggtatctggtcatgtgaagtacacctgcttcaccagtgaagataatttgtgtgcggcggcagggagtgctattccatcagaaccgatgcccgacacctccggagcatgaccacgtatccagggctgcccgggccggcgtatcccccacccagtgcccaaaggtcagaagaggacccggcctatccggagagaggagtcgactatgaaagtacctgcaacggcgtaatcaagctaccgtc

SEQ ID NO: 104794 - DNA, 573 bp, Triticum aestivum
  Clone ID: PAT_TA_104794
acaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccaacaacaacaacaacaacaacaacaacaacaaggcatgcatatcctgctgccactatctcaacaacaacagttgggtcaaggtactctcgtccaaggccagggcatcatccaacctcagc

SEQ ID NO: 104795 - DNA, 370 bp, Triticum aestivum
  Clone ID: PAT_TA_104795
cctccgctgagtctccggccgcggaggcgcctccggaggccaggaccaaaggccgcgggctccgtcggtggcgccgtatccagcgggagcaccgcgcggaaggcgccgctgcccccgccaccgccgctggtggcagaggtggtgcaaatgacgacgcggcacagctccacaagcgccggctgcccctcggcgccgccgcgccccccaaggggaagcacgaggtggccgtcgaggaggcggagagctccaccgcttccgtcgagtcccgcttcgtcccactggagcaggcgccggcgccagcgccagcgccagcgaagctggacccggatctcggcctgctcgtctcctccgtcggcttctcagtcggcgc

SEQ ID NO: 104796 - DNA, 513 bp, Triticum aestivum
  Clone ID: PAT_TA_104796
tcaaccaggcgcgcacttctccccctctccgccgtcgtcgtctccgatccaccgccgctccgcgcgaccatggtacgttccccttcccctgactaggtggctgcgatttgccgtagcagtttttcgtcggttccgaaagggcgcagattcggtagattcacagcagctgcggcgctcgattggttgaggctaggtagggttatatgttaggacagaggtgattcgagttctcttagagttggtgtgtctcgttagattctcatgatttgtagtgtggcgctgttaaattgggtgaagctgcggtaggattacgtatttctcttcaaatttaccttgtggatgctagtaaatgtcgagtatggcactgatagagagaattacattcggcatctcctggtggaatggggtagcatggatgaatacagttaatttgttcgtatggcaaatgggttgggggtttttagaaaactgagttaatctccatccttgttagttgagttttcaccatttatc

SEQ ID NO: 104797 - DNA, 495 bp, Triticum aestivum
  Clone ID: PAT_TA_104797
gctgtggacagtcactgctctctcttggtattgctaattgtgcttggatgactgatgcatctttgcgtgctgttggatcccactgtcctaaccttgaaatcctgtcactggaatcagaacttgttaagaatgaaggagtgatttctattgctaaaggatgtcgcttgttgaaaaatttgaagctgcaatgtattggtgctggcgatgaggccctagaagctattggttcatgctgttcgttactagaaattttatcgctaaataactttgaaagattcacagacaggagcctttcttccatcgcgaaagggtgcaagaatcttacagatcttgttctcaatgattgcctgttactaactgatagaagccttgaattcgtagcacgcagctgcaaaaaaatagcacgtcttaagatcaatggttgtcagaatatggaaactgctgcactggagcacattggacgatggtgcccgggccttctggaactctctctaa

SEQ ID NO: 104798 - DNA, 536 bp, Triticum aestivum
  Clone ID: PAT_TA_104798
cgtctgttgatgctagagctcttgctatccttgaggatgcctccaagcttgtgggaattcatgaacctatggctgaaataatcaagctgttgactcaaggtgcatcaacagatgagaaaccaaagctggtctccatcgtaggatctgcagaaatgggcaagacaactcttgcaaaccaagtgtatcaagagttcaaagagaaattcaagtgtaaggctttcatatcggtgtcgcgaaatccagacctgatgaatatcatgagaactattcatagtcaagtcagtggtctacattttgataacaccgaagcaggtagcatacaacaagtcatcatgaatatcaacggtcacctagcagacaaaaggtattttgttgtcgttgatgatatatggaatgtggaggcatgggatattattaagtttgcattccccatgacaagttctggcagcatcataatcaccactactcgtataaatgaagttgccaaatcatgctgttcatctttcagtggcaatatttatgatataaagcctctt

SEQ ID NO: 104799 - DNA, 518 bp, Triticum aestivum
  Clone ID: PAT_TA_104799
caccaatgtctaatttattttcatgcctttggttcaatgaggtcaactgtttcacctcccgtgatcaattgagttttacatacacttgcttgaagctcacgagaatgaacgcttgaagatatttcacctaaatatgtttaagtctggtgggggtggagcagtgaggctggagacccaggcaggggacgcctcagggcttggaggagaggtcgacgatacggacaaggagcagtagcctcatggatctgcagtgaagcgtcatcgagggatggctgatgtcaaggcacacatagctccggctgccgcggataggaagtactcgacgcatgatatcctcctgactctgactgaaccctgtttcgtgcaaacatgctctgtatttttttgatacatcatagttaataaaaaaacttctgctgtaatggaggtactcatctttagtagtgtgcttaatttgattcatcacctcaagtgttttacacaaaatttgaactatgtgtatctactggctccttaga

SEQ ID NO: 104800 - DNA, 584 bp, Triticum aestivum
  Clone ID: PAT_TA_104800
aaacaaacggataactcccagcgttggatccggttttgtaatcctgaattaagtgcaatcatttcaaaatggataggctctgatgactggattctgaacactgataaacttgcaggactgaagaagtttgctgatgatgaggatctgcaatcagaatggcgtactgctaaaaggaataacaagatgaaggtagtttcgctgataagagacaagactggatatgttgtcagcccagatgcgatgtttgatgtgcaggtgaaaagaatacatgaatataagcggcagctgctaaatatccttggtatcgtttaccgatacaagaagatgaaagaaatgagtgccaaagatagaataaagagctttgttccaagggtatgcatatttggtgggaaagcttttgccacttacgtacaggcaaagaggattgtgaagtttatcacagatgtcgcagctactgtaaattatgaccctgatgttggagatttactgaaggttgtatttgtcccagattataatgttagcgttgctgagaagctcattcctgccagtgaattgtcccagcatatcagtaccgctggaatgga

SEQ ID NO: 104801 - DNA, 420 bp, Triticum aestivum
  Clone ID: PAT_TA_104801
agtcagaaggactgcacaattctaagttgagaagtaggagaagaaataaagctcctgcttcagaccatgacactgagaaccgacaagaccatggtggcaaagatactgtcaccgtagacaattcagaaggaatacacaattctaagctgagatctagtgcaagaaataaaactccttcagaccatgacaatgagaaccgacaaaaccatgatctgaattccaaatttgccttggaatccaattgtggaaatggtgatctgaattccaaatttgctttggaatcaatgaagaacaacacagatgttcttgacaagcatggagggatagaaggaaatggagccggaaccttgatcacattggaccctgcatgctttattttaagtggacatcgtcatcagagaaaagattatcggtcaatac

SEQ ID NO: 104802 - DNA, 503 bp, Triticum aestivum
  Clone ID: PAT_TA_104802
aggcagcagccaagcaatccccacacacatctctccactacccgattcctttctccagctcgccatggacgcctcagccaccgtagccaccgggaaggggaagaagggcgccgccggtcgcaaggccggaggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgccggcaacgccgccaaggacaacaagaagagccgcatcatcccccgccacctgctgctcgccatcaggaacgacgaggagctcggcaagctgctcgccggcatcaccatcgcgcacggcggcgtgatccccaacatcaacccggtgctgctccccaagaagacggccgagaagtcccccaaggagcccaagtcgcccaaga

SEQ ID NO: 104803 - DNA, 389 bp, Triticum aestivum
  Clone ID: PAT_TA_104803
ccccgctccctccatcctctccctggcgccgcccctcttctccccactcgcctcggccgcgtcttctcctcccccgcgtcgtcggccccctccctcctcctcccccctctgtccttcgtcatcacacgggtcttccggccagtgccggggtgcagctgacggcggcctcagcgggtgggcgatggcggccgcagctatgcacaagctcgcatcgccctggcgccgatctcgcgcggctcctgcgcctcgccaccctcttctccccagctcagcaggaggtttgcgaggccaccacttgggccgctgctgcctcttccgcccagcatgaggagcacgaggtgagcagcaacaacggggacaggcgacctctgggagagtttgcggagggg

SEQ ID NO: 104804 - DNA, 624 bp, Triticum aestivum
  Clone ID: PAT_TA_104804
acccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaatgtcaactagttcaatatataatccttcctacgtgcatgcatggacgcgcttgcgtggagcttaatttctacgttgatggagtgctcatacgatgttgagctactaaaaaataaaatgaagttgcctgtgtgtgttatttcagtagtgtgtctatgtctgtaccttgcacacacactgtgtgtgcatatatatttatgcgacatgtatgca

SEQ ID NO: 104805 - DNA, 531 bp, Triticum aestivum
  Clone ID: PAT_TA_104805
gcttaacccaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatgtctacgttgatggagtgctcatacgatactga

SEQ ID NO: 104806 - DNA, 386 bp, Triticum aestivum
  Clone ID: PAT_TA_104806
aaacgccataccatatcacacgggctagccagccatcccatcatggagaaggcgcagaagcgggtggccatcgtcggcgccggcgcgagcggcctggcggcgtgcaagcacgcgctggagcgcggcctccggccggtcgtattcgagtcctcgggcgccatcggcggcgtgtgggcgcgcgcgctggcgtccacgcgcctgcagacgccgcgcacgctctacgagttctccgacttcccctggccgccggaggtcgccgaggtgttcccggaccacgcccaggccgcggcgtacctgcgctcctacgcggagcggttcggcgtgctggaccgcgtccggttcggatgccgcgtgacaggcatggagtacgccggcgtcggcgagga

SEQ ID NO: 104807 - DNA, 476 bp, Triticum aestivum
  Clone ID: PAT_TA_104807
cggggcgagggcgacgatggcggtcatggggtccggcacctggcgcaaggcctacggcgccctcaaggactccaccaaggttggcctcgccaacttcaacagcgagtacaaggatttggatatcgccatcgtgaaggcgacgaaccacgtggagtgcccgcccaaggagcggcatttcaggaggataatgtttgcgaactcggcaaatcgcccgcgggccgacgtcgcctactccatatgtacattggccaggagattgtccaagaccaagaactggatagttgcgcttaaaacactgatagtgatacataggttactgagagaaggcgacgggtcattcaaagatgacttcctgagctattcgtacagaggaaacattttgcagcttccaaatttcagggatgactcgagcccattagcatgggattcctctgcttgggttcgcctgtatgcattctacctacatgaacgcgtcc

SEQ ID NO: 104808 - DNA, 459 bp, Triticum aestivum
  Clone ID: PAT_TA_104808
gcgatccctttgcttccctccgtcccggcgagcaaccgccgtgctccggcccgccccgccgtgctccggccctccccgccgtgccccttctcaacccgcggggccaaccacggctagcaccgcctcctgtatggtctggcacgcctcctgtacggcctggcacttcctccaacgccacccacgcgtcaccggtgctcgggacgaagctctgctgctacatcgcccccaggcaccgacagatccaacctcccacgccaccctgcacacggccacccatgaatccgggtgctgtggaagcatgacggcgatgagctgtcactgcagatttggcacgggttgagacttcggggatgaaagccggcgaccaggcaaggaccaatctggcgagctcttcaccaaggcattttctttccttgttttttttctctctgaaatatttctttcctcaatttctctctc

SEQ ID NO: 104809 - DNA, 489 bp, Triticum aestivum
  Clone ID: PAT_TA_104809
ccactcactaaatgagactgaggtcactactgtaatatgtggtcggaaggaattaaagaagttgattgatataggttggcaacttgacactgtcaagcgtgtgatctacatcaatgaggaaggcatctcggctgaagtttctatagctcaaaacagcactagctggtcagttaagtcatttgaggaagtaggtaaattgggagctgaagcacctgttgatgcaaacatgcctctcccatctgatgttgcggtgataatgtacacaagtggtagcactggattgcccaagggagttatgatgacccaccgcaatgtcctggctacactttcagcagttatgaccattgtgcctgaacttggcaaaaaggatatatacatggcctacctcccactggcgcacattcttgagttggcagctgagacacttatggctgctgttggggcctccattggatatggatcagctttgaccctgactgatacatcaag

SEQ ID NO: 104810 - DNA, 269 bp, Triticum aestivum
  Clone ID: PAT_TA_104810
gcgccgcctcctcgtctccccccggaccgcgcggcgccgcctcccgtccccgtctccggccgccgcggcccgagcagctccgcgcggcggcaatacgtcgccggtgttgcctcgcaagccggccacgccagccgcgacagagacacacgcactcgaggcagcttgcaggggcacccacacatctcgctggattggctggccccctctcttcggtctgacatgatctcctcctcgctcctctcgcgcccccgcctcgccccgcgccccgt

SEQ ID NO: 104811 - DNA, 601 bp, Triticum aestivum
  Clone ID: PAT_TA_104811
gagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcacctgcccccgtcgaggttgaggagaccaaggaggaggcgccggcagcagttgaggcagaggagacgaaggagcccgagccagcagctgcggccgaaccggaggccgaggcgcccgccgtggtcgagacagagaccaaggaggccgtggctgaggcagagccggcggcggccgaggaggtgaaggaagaggcggcgcctgctgccgaggccgagccggccgctcccgctgctgctgaggaagcaccggtggaggcagccgcggccgcggtggccagcgtcagcgtgtgaggcgccagcgcgcgcggaggaggagctggctgggtcagcgtcgacggcggcggccgtgtgctcctacgtggcacggcgtgatgctgagtca

SEQ ID NO: 104812 - DNA, 529 bp, Triticum aestivum
  unsure (1)..(529): unsure at all n locations
  Clone ID: PAT_TA_104812
agtggaaaaaagcttcctcttatctggcgagcgaggtcgaggctggccgtgatgcagacgacgccgggcgcggaggcggctatctccggccagatccggtcgaggaggggcggcaggggtcggatcctgttccggcgacggcgtggatgcgatctacgaggcgcatgaggaggtccaatggtggggcttcaattccaagttcatcgcggcggcgttcctcgccggtaccgagcgagatggctagctccggcgaagtctctccatcgatacggtggctctgtacctgtgagagagacatangtgaggggagaggcagggaggagagggtgtgaggagcggcagggaagtcttggtggtgcccgcctcctacagcagccctggtgagtgcggccaaagagagagagatgagagagagccaagaggaagaaggaaaggaaggagacttcaggaaggggcggcgggatcctgcggtgctgggttccagctccgttggtggtgctactgctgctgttggacaatggccgatggg

SEQ ID NO: 104813 - DNA, 450 bp, Triticum aestivum
  Clone ID: PAT_TA_104813
ccgctgcacggccacgacgccgtctccgcccgcagcgccgggttcggccccttccgctggagcccgcgcccgccggtcggcgcgtgggacgccacccccgccccagccccatgtggcggtgggggcgccccgcccatgatgtcgccgttcttccgctccccgcctcagccgctcccggcgctcgcgggtgctggggagttcgcgcccgtcaggcccacgatcgggttccccgggatgccgtcgccgacggtacttggtgtcaaccctcacgcatcctggctaccgacggcagctgcaggtatccaacatactcctgatttccgctgcgcgttaacgtcagaaattgctacggttttgcttttaaccgtttcagctcaattttttcaagagtccaaagttcagagtggtgccatgagccattagctacctctacctgtacaccaatttttt

SEQ ID NO: 104814 - DNA, 148 bp, Triticum aestivum
  Clone ID: PAT_TA_104814
acactagttgatgatattcattatcttgcagactctgaaaggttgatttctgctggtgagactgattttgccaaggatgcagcttttggctctacatcttccaatcttaaacagtgggttgaagaaaagactaacggaaggattttcg

SEQ ID NO: 104815 - DNA, 460 bp, Triticum aestivum
  Clone ID: PAT_TA_104815
ttgccctctccacccctgttcctcctccttggtgaaagccccaaatctggttcggattgggcagcgacagcgcactgcgcgtcgtatccaccttggaggcgcctcccggggagggctgcgctcaggtgagggcggcaaaggttggagctttgggtggctcaggtagttcggtgacggcggtgtcggtgggttttcgcatggctgaaggcgtcgccgtatccctcatgagtggtgttctctggcggcgacatgtttggccacttcccgcgatgcggcgcctcgatccaatggtaggggatagggttccccttccggcagtaccaacaccctcaggctgcgaaaccttggttctcctcttctacggcagcctgcaatgttcctcggcgacctactggttctacttgatgtccttgttgccatttcttcggtagctgcgcccggtggctttcctgtagctttc

SEQ ID NO: 104816 - DNA, 407 bp, Triticum aestivum
  Clone ID: PAT_TA_104816
ggcacgtccgagtacctgataagattagttgcaccgttaggatttggaaacactttgaaccatcgatcggccattcatttccgaatgatcggtgctgattgttcggacactgactgacacactgatgatgttcaagtgtccagttgtggccatgtttattcctacgcttgtatgataacccatgagtgatgtgcaggccatgatgacccctcaaatggtgcagaactactatgctcagctgtatgcggctgggctggcgtcgccgacagggccaccgccctaccatcagtacgtggggtacatgcagatgcaggccccgacgccgagggcagcggtgctctcgccggtggcgcagcagatcgcggcggggcagccgtatgcgccgcacccggcggcggcgcagatgc

SEQ ID NO: 104817 - DNA, 377 bp, Triticum aestivum
  Clone ID: PAT_TA_104817
tatcatctcccgcaccacggggatggatgagcttgaagcagatttcagaatgacacactgcttgccacggtgctgggcaggaggccagccatgtctgcggaagccatggtccaatctctggctcgactctgcggggttgagaggcgacatgtccgggtggaagtgacgcacccggtagatttcttcatcacattcgcctccactgtggattgtgagagggtgctcaccagctcggggcagtttcggtgcgccggagcgtccgtcgcttttcggcgctggcatcggagttcccaggcaagcagcggcaaactcaagttcttctgcaagattggtattgaggggctgccggcgaacgctcagccagctcatcaataacc

SEQ ID NO: 104818 - DNA, 467 bp, Triticum aestivum
  Clone ID: PAT_TA_104818
ccatcatccagcttcatgctcttcttggcaacaggtggtctgccatcgcgacacacctgtcgaggcgcactgacaacgagatcaagaactactggaacacccacctcaagaagaggctggccaagatggggatcgaccccgtcacccacaaggccgccagcggagctcccgtaggcaccgcagacgacgtcagatcagccaaggccgccgccagcctcagccacatggcccaatgggagagcgcccggcttgaggccgaggggcgcctggctcgagaatccacgatgcgcacagcagcctctacaccaacttcaatcactctgcacccaataaacctgccagagcctaccacctccccgtgcctcggcatgttgcagccatggcagggcgcgaagctagacctggagtcacccacctccacgctgacgttcatcggtaataataacagtgtcagccttgggatatct

SEQ ID NO: 104819 - DNA, 198 bp, Triticum aestivum
  Clone ID: PAT_TA_104819
gaaaatatcgtgtactcccaactgatggtgtgctccggctacaccacatgaacaccaaccgttagatacatattgtaggcacaggatccaacccgaacgctccatccttggaaatttgcaaaatacaccccagatgcgtacagaattagtgtatttcccctgtcacctacctccaagccgtgcgactgttcccaaatt

SEQ ID NO: 104820 - DNA, 431 bp, Triticum aestivum
  Clone ID: PAT_TA_104820
gtcgccgccgccgccgccggccaagccacccatccccaactcatggcggcggcgaggatctggtggggcgatgcagttccttctaaagtgaatcagtggtgaaatccatctatgtatgaaacaagaaaaaaaaatgctggtctttcgtgtttgttttcatttctagccccgagttgctatctgcgtgctgcatccgacggactatcgtgatagtcttcgggatctgagggaatacatgtgccagggatgctttccttggagaaatcaggcaaacctgcaggtggggcaacaagcgacaccaatttatcaagacccctctgttgctggattaatgaatggtccacatgttgattacgacaataatccagctcctaacagtgggagaaacattctgggagccattcaagtagatcaaatggcaatgcagcacg

SEQ ID NO: 104821 - DNA, 573 bp, Triticum aestivum
  Clone ID: PAT_TA_104821
gcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctc

SEQ ID NO: 104822 - DNA, 248 bp, Triticum aestivum
  Clone ID: PAT_TA_104822
ctccgcagttggtggaagggctcgaggagagcatcgggcggggcaaggggtcgacgcggctctacgcgaccatcgacctcggcagggcgcgcgtgggccgcacgcgggtcctcgccggcgacccggtgaacccgcgctggtacgaggacttccacatctactgcgcgcacttctccgcccacgtcgtcttcaccgtcaaggccgcgcagcccatcggcgccacgctcctcggacgcgcctatctccct

SEQ ID NO: 104823 - DNA, 281 bp, Triticum aestivum
  Clone ID: PAT_TA_104823
gtacttatatctgttcaattttctctcaggaaatccttttttatgaactgatggtggggctcagcagcaaaggtatacatgtgcggtagccgctctttacgtatttttttcctaatacatatactttctcttcttaactgggggctatttcaaaagggaaggatctcgtgtgtaaaaattggttgaccttattttctattcatcctgaatgtactgaagtgtcaacatttgtgtattgataactaatcgtaataatcttgatataagatatatatacacac

SEQ ID NO: 104824 - DNA, 403 bp, Triticum aestivum
  Clone ID: PAT_TA_104824
tccgccctccgcctccgcctccgcctcgatttctactccgatcctctcctctccactgccccttcttcttttgtacgggacgttcatgagggccccccggccggatccagcccaccgccgttcttctaccagtgccgctgatggcgcccacgccgcacacccgtgccgcccgatgcccgccgccaccggtggtcagccagccggagaaagggttgggaagatgcagaaaaccatgcaaaagcgaagagccatggacataggatgctttaataaaaagcaaattgcaagccaaacaaaacttatgcaacgacctgtccatccagtcattacatttgaagatggatttggtaagttagctaaatcctgtggaaattcctcgagtgaactcaccgaacagattgag

SEQ ID NO: 104825 - DNA, 255 bp, Triticum aestivum
  Clone ID: PAT_TA_104825
aacctcaaccacacgctacgctacctccgtctccatccaaccatccaagcctcacgcacttctcgttttcttcatccatccatccatggagatcatcgacgctgagctgcggctcggcccgccgggcagcggcggcggcggcgacgcgcagaagaaacggtcgtcgtcgacagtggcactcgcggccaccagcgaggcctccgggaccgacgaccacgacgccgcgccggcctccaaggttcaggtggttgggtg

SEQ ID NO: 104826 - DNA, 379 bp, Triticum aestivum
  Clone ID: PAT_TA_104826
ggtcacatgtccgtctgcctactggctggcattaaacaccccgcctcttggcgcgtggcatcccccgctatttaaacgtggccaggtgcccggcaacaaccgcatcacacctgtcctctcctgatctcctccttcttgcaccacacccgccatggccttgagctccaaagccctgtgggacagcctctccggtgaacaaaagaaggaactctctggtattgcggccggctggcaggcccgccaagccagccggatacaggctggcttgctggcgagctccccggaaggcagcgacgtggacgagccaatggacgactagcccgcgccaccgccctcggcggttcaggcgggcatcaccatgggcgaggcgcgtgcgcac

SEQ ID NO: 104827 - DNA, 326 bp, Triticum aestivum
  Clone ID: PAT_TA_104827
tttttttttttttttttaagttattcatcgatagctcaaaaagaagaactgtacacattcaattgacaacgaacgtggtacacctcaccaagaagctataaaaaatgaaaaataaatgaaagaatcacacgcgcgctcgtacgttgtctccgtgtcattgggtgatctcggccacggccaccgatacccgggcagccgccgcgaaggccgtgatgatgccgcctcccgcgacggcagaggcgtcctgttcctcctcctcctccggcgagactgagactgaggccatgaccgccggtggcgacagcggcggcggcgtggtggtggtg

SEQ ID NO: 104828 - DNA, 198 bp, Triticum aestivum
  Clone ID: PAT_TA_104828
gggagcgcgtacttgcattggaaatgcctgactctgagctgaacagcccgcgtcttcgtccgcctcgccgccgccatcgccgaccacggcgggaggcggagttctggagaagagggagagggattccggaggcaatggcgcgggcggccggcaccgggggtaccgcggcgttcggatgagggcgtgggggaagtgggt

SEQ ID NO: 104829 - DNA, 244 bp, Triticum aestivum
  Clone ID: PAT_TA_104829
catgttgccgattgccggcggacggctcgacggtgcgatgaccgccgcgattgtccgatggccaccgcgtactgggcgaggtgacgaaacccccatgccctccgcttcccgccgcagtcgccgccctatctcctccaagagagctgacccccaccatcgaatccaagcccccctgctgcgccgtcgccagatctacacccccgatgagcgcgctgggtgatacacccccatttctcctctccac

SEQ ID NO: 104830 - DNA, 157 bp, Triticum aestivum
  Clone ID: PAT_TA_104830
ctagcctctgcaccttcacatacattccctcgccaattgcaatggtgatgttttcttggtccatctcaggcgcggggcgttgattggagagagagggaaaactgcggagtggcggttacttggctggggtgtgctgttcctgtccgttcgtgctccc

SEQ ID NO: 104831 - DNA, 540 bp, Triticum aestivum
  Clone ID: PAT_TA_104831
gctgctgaaatcactgagaaggtgaggttgatggcagaggagagacatgtaagctttaaaatgtataagaggcgtggggtgaaggatctcgaagagaagcctaagtcaaagagaaggaaagggcaaaagcggagtcgggggaggcagaccgttcagggtcagtctagagaacatgctgacctttcggattctgccgatgatgaagaattcccgagttgagttaaactagaaccataagtgggtaatgaacaccttcacttgattgaattgtttgcgggagtgattggtttatgaaccaaccaataaggaaatattggtcttgctgaaaatggagcaggtttgcgttatctactcacacctgatattgatacttgagccaagtgacactccgatcctatctgaagtccatctgccagtatgtacttcagttttgaaaagctttcaggggctaatgatattggggcctttcagtgccagtgcaaaagaaaataacaccaatatacaatactactatggctggaagtgagtccagcctgtctg

SEQ ID NO: 104832 - DNA, 370 bp, Triticum aestivum
  Clone ID: PAT_TA_104832
atcgcaactatctcttcaggcgcacaagggataactgccaaaccctctcacaagacgatccatccttgctgctaactggcccatcccgggcaattgtgtaccttgctccaattacattcgaagtgcagttaaaagtaaagggcaaaggtgagtctgaagatgagatgctggctttcggtgccttctactatgacgatgggtctgcttgtgaacgcaagctttctatacgttacgaccacaagcgctgcatgcttgagtatgaagtggcgctgcggccacgctcggttgaggccacaatcagcttgaaggtcgtcgtggggtcatggccggagaaccaccgaggaatagtcgtcgccatcacctccggcat

SEQ ID NO: 104833 - DNA, 249 bp, Triticum aestivum
  Clone ID: PAT_TA_104833
ccttcattcggcagcacctcgccgccgctgaagccgaggcccagcggggcaggcccggccaaggaccggacgacagcaggtacggcgagcacggccggggcgacggcgtcttctcccccggcggtggcctgccgggcctctgcttcggcgactcgaacgccctggagctgcaagagagcaacgccggccacgtgtggtggtccgacggcctccgtgcaccgcagcatcacgccgtcccgacgccaaccc

SEQ ID NO: 104834 - DNA, 331 bp, Triticum aestivum
  Clone ID: PAT_TA_104834
gccgccgcccctcaccctcggccgcctgccctcgttcctcctcccatcttgcctccctcaccaatttctccgctcgtcagggacgcacactgcgctgtcgcccatccttttgcgtcgggaaggcatcgaccctgccattcctccgcacgaccggagatgcagacgccgtcgccgccccctcgccctcggacgcctgccctcgttcctcctccaagctcgcctccctggcgggaattgtccgctcgtcggggacgcacactgcatcgggaagacatcggggaaggcatcgcccctgccgttcctccgcgcgaccggagatgcagatgccgct

SEQ ID NO: 104835 - DNA, 654 bp, Triticum aestivum
  Clone ID: PAT_TA_104835
gcggaggggagtgcgatgatgtctgcggacgaactgcataatgggctagaatttctcctacatccagttgacagattcccgctgacagaagtcactgctgatgttgagcagccagatccaccggcgctcatggacgtccggcggtcagcgccgcctactgccgactcttcttgtgccgttgtggttggccacctcggtgtctcctctgggcataacagatctgctggcaagaggccgctttcaccaaccaaatccgccgagtccactaggaaggttaaccccgaggcaccaggatggacaagaaggggaaacacgagcaacagaatagccgttcttgctgctgcgagtgccatgcgatggtcagattactaagagctgtagacaatggatggtacattgctgagcactggtcaagccacaatcattccatgtctcttacatgcagagaaaaagttcattggccgtccctcaaacacatagacgtgtacacaaaagatttggtgaagcatctaagggcgaacaatgtgaacctcagcaaggtgtatagcatagttggcagcttctttggttcatcacatagcgtgtcttttacaaaaaggtcattacgcaatctgtgtggatgaataagccgagaccaagctgacgatgatgtca

SEQ ID NO: 104836 - DNA, 139 bp, Triticum aestivum
  Clone ID: PAT_TA_104836
cctcctaccctgctcggcttgcacgcacaggcactcgagctggggtccatcctatcctagtagtattatcctagcacggtagcaccccatgggcttgggcccgaggtggtcgccgtgggcggcgttgccgttctctcct

SEQ ID NO: 104837 - DNA, 512 bp, Triticum aestivum
  Clone ID: PAT_TA_104837
tgtgcgcatcctgagaagcaattgtttgactgggggatgatgaggatacgatatccttttaccatgtatggaataggggatggtttttcaatggacaccgatgatatccatcgcaaaaagagattcaccgagaggatctcaaagcttgaagaggaggaaaagaaccaggctgagaccaggaagagaagattttttacagaaattcttaatgctgctagggaatatcaagtgcaaacatcggctacttacaaacgaagaaagcaacgtaatgatggagttcaggcatggcacgtccgggcgcgccagcgtatcaatcgacttgaaaaaagtaggttgcaagttttgaaagcaggtgatcaagaagcgtatatgcggatggttgaggagagcaagaatgaacggctgacgatgctccttgataagacaaatgagcttctagaaggaattgggaaagctgtacagcgacaaaaagatgctgagcatgttagtcgtcctgaagggtctgaagactc

SEQ ID NO: 104838 - DNA, 240 bp, Triticum aestivum
  Clone ID: PAT_TA_104838
cgttgccttagtccattttggacgccttagcttgccaggcaggcaggggagctgttttaggcgggaaactggaatcatgttggcgccaacaggtaagaggggagaaagagagagagagaaacagcccccaatccacacactcctccccctccttctcttcagtggctcctctccagcagatctggttcctcctgctgggggggggctcctccccctcctctccaacggttcctcctctcc

SEQ ID NO: 104839 - DNA, 437 bp, Triticum aestivum
  Clone ID: PAT_TA_104839
tttctttctttacttctggcctcctgcggctcgatctatcgctccttcccagcgggatgcatggcgccctcctcagcctccaccgtcgagatcaccagtgagtcagtcttcgatagtgaggtcgtcccctcctcaatcgtcgagatcgcaccctacctccgcgtcgccaacgaggtcgaggcaagcaacccacgcgtcgcctacctatgtcgatgggggggccttcaggatggccaacaacctcgaccccaccgccagcggccgtgatgtccatgagttcaagaccgcgctcctgcagaagcttgaaatggagaccttgaagcagagtgatacacgcgaaatgtggagtttctaccagcactactacaagacgtacatcatggcactagtaaacgccggcgatacaggtgaccgtgctcagctcacaaaggcgtatc

SEQ ID NO: 104840 - DNA, 260 bp, Triticum aestivum
  Clone ID: PAT_TA_104840
ccccagtcattaacccaccatcgaccagcagcgcagcaggccaccaaaagctcgcccctcaacctcccatcccatggcgaaatgcagcaagatccgcgacatcgtctggctccagcagaccctgcggaggtggcggtcccgcgccgcggcgcgcgtggccgccgagggcggcgtgaccgcgccagcggggcacgtggcggtgtgcgtgggcggggcctcgcggcagttcctggtgcgggccgcgcacctgaaccaccccg

SEQ ID NO: 104841 - DNA, 189 bp, Triticum aestivum
  Clone ID: PAT_TA_104841
cggcgcgggaatggttcccggggccaggactccggcggcgtccgtgctgcgtgggctcgtggcggtcgtcggcgcggccgtcctgtgtttctccggcgccgccgaggcccgcgtcctcctcacgctcgacgacttcggcgccgtcggcgacggcattgccaacgacacgcaggcgttcgtggacgcgtg

SEQ ID NO: 104842 - DNA, 301 bp, Triticum aestivum
  Clone ID: PAT_TA_104842
caccagcatcagtctccccgtcgttattcaccaggtgtgcgctatcatttaacatcgcggagattggctttcgcaatctggcagccacctccatgcgcggtggctcatcttcactggtctctagcagcaagacgccattttctgtggtgcaatagaagcggcctgcaaacatcaagggtgctgtgtgcaccgaaatcttgtaccggaccattgtccagcgctcgtcgccgggcttggcgatgcctacaatgcatagcgagtcgaaacaaagcacgaccgaggaatcatctgcggcaatgcc

SEQ ID NO: 104843 - DNA, 563 bp, Triticum aestivum
  unsure (1)..(563): unsure at all n locations
  Clone ID: PAT_TA_104843
ctagaactggttgcgcttatctcagagatcaagcatcccaacacccttgagttagttggatactgtgctgaatatggacagcgattacttgtatacaatcacttcagcagaaaaacactagatgatgcacttcatgatagagaggaaatcgacattgagctatcatggaatgctcgtctccaggttgctcttagctccggaaaagccttagagtatcttcatgaaagcttccaacccccgatcgtgcatcagaattttgaaccagctaatgttctcctagatgataagttgtcagtgtgtgttgctgaatgtggactancagagctgatgccctcaagttctgtcactcagctgtcaggtcggttgcgcacattactgaactatgatgcgcctgaattccaggaatctgggatcatttcagaacgaggcgatgtttacagttttggagtagtgatgctagaacttcttaccgggcgtaaaccatacgatagttcacgcccacgccatgaacagcatcttgttagatgggccggttgtcagctccatgacattgaatccctttc

SEQ ID NO: 104844 - DNA, 272 bp, Triticum aestivum
  Clone ID: PAT_TA_104844
cctgctgcacggcatcgtgcacctcaacggctacggccacctcgtcgccctccacggcttcaagggcggctccgacttcgtctccggccaccagatcatggacctctgggaccgcatatgctcaaccttgcacgtaaggacggtgagccttgtggacacggcgaggaaagggcacatggtgctcaggctgctgcacggcgtcgcgtacggcgacacatggttcggccggtggggctacaggtacggccgcccaagctacggcgtcacgctgc

SEQ ID NO: 104845 - DNA, 178 bp, Triticum aestivum
  Clone ID: PAT_TA_104845
gcccctttcctccgccgccgccgccgccgcttctgccgccatggccgacgagctggacgagctcatcgacttcctctccaacggctcccctcaggtgcgcggcgccgcggcggacatcgtgcgggggctcaccggggacagcgacgggctgcgctccctcacggcgcgcgccaaccgc

SEQ ID NO: 104846 - DNA, 302 bp, Triticum aestivum
  unsure (1)..(302): unsure at all n locations
  Clone ID: PAT_TA_104846
cggattcaagacgatgcaggaccttttgtgttcatgcgagggaactcacaaaaaattcaattctaggtctagtagaacaaactgccctgtgatggttagattgcttcncacagaggacgacggatggtactacggagaggtggtattagaacacaaccacgagttggcagctagtgcaggtgaaagaaagttatggaagtgtcacaagtatgtccactcatctatgaaggacattgttaggcacttgcgtactaacaatgtggcactgaccgaggtatatggggtgatggctgacattcatg

SEQ ID NO: 104847 - DNA, 188 bp, Triticum aestivum
  Clone ID: PAT_TA_104847
gttttcctcctccacctccaccggcatcacatcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggagatcctcaccgagatacaggagtttctgg

SEQ ID NO: 104848 - DNA, 117 bp, Triticum aestivum
  Clone ID: PAT_TA_104848
ggtacaacccgacgccgtccggctggttcacgccgcccaacatgccgtcgtacctgacaccgccggggccgctctacccacaggaccccgggttccggcccaacaccgcaccgggcc

SEQ ID NO: 104849 - DNA, 567 bp, Triticum aestivum
  Clone ID: PAT_TA_104849
ctaaaataaattaaaccaaagtgtgccctgaaacttgtgcattatttttttaatctttttgattgatttctttgggaagttagtcaaactttgtgagtgtggaaggaagggggcaactgtttcggacacttattaaacgtcttagagctcatttcatcatctttgtttttctaacacttaataatgagctgacagatgatagaagcagaaaaaaatacttggccaaatatcatttaaccagatattgtacattgtagaatcagtagtctatctcacttcattcttgttagaacctgcataagattttgtatgtgatgcttttgtttattcaatcaagtgaaataagggctacaacaagagatcaccattaggttatcatgaaccagcaaaatgggtataagaagctatattcaagaaaagatattttgctcattctttatccagagcaaatataaagtcgcatacgaacatccgaaactaagaagtcaacaaatagatcagtatattccatgttaagtgtacaactcacaaatagacatttccagtgagaaaatattaactatttct

SEQ ID NO: 104850 - DNA, 580 bp, Triticum aestivum
  Clone ID: PAT_TA_104850
tcaccactcttcagcaaatataaagtcatccactttaacaagacagatgctcggttagcaaataatggcatcagtactgagcttcaacttgttagatgccgtgttaattttcatgctctgaagtttacccctcaaattgaggcactggggaataaattggtacagaaacttcgagacaagggatcatgtgtggcattgcatttacgatatgagatggacatgctggcattttctggttgcaatcatggccttaatcctgaagaagctgaggaactcaaaagaatgagatatgcatatccatggtggagagataaagaaattgattcgaaaaccaagagatcagaaggactatgcccacttacgcctgaggagacgtcactggttttgaaagcactgggctttgaaaaggatactctcatatacattgctgctggtgaaatttacgggggagaaaagagattgaaaccattacgagctgcttttccaaaacttgtaagaaaagagatgctgctagattcagaacctctgcgccagtttcaaaaccactcttctcagatggctgcactcaatttcattgtat

SEQ ID NO: 104851 - DNA, 526 bp, Triticum aestivum
  Clone ID: PAT_TA_104851
ggagatgaggtatgaagaatccatcttgtgaacaggcaatttcttcttccttgatcccgttccacaaggaagccaataaagaaatgggaggcgagacgcagccactggcggccgcagcagtcaccgtatccaaggtgctcgacgatgacgacctcctcatcgaaatccttctccgcgtcggtttccccaccacccttgtctgcgctgccctcgtggggggcgctggctagggcacgcctccgaccgtgccttccttcgccgtttccgcaagctccacccgccccgcctcctcggcttctacattgacgactttggtcttccgcctggcttgacattggtgttcgtcccagtgctgcctcagcccccagagcttgctgtcgttgtccgccgtgcgaggttcaaattgaaaaccaacaatgccaggtctgccacaatcaaggactgccagaacggcagtgtcttcttcaccttgtacaacggcagaagcagaaagtcaaccagagtgcactgcccattgtgccccgag

SEQ ID NO: 104852 - DNA, 179 bp, Triticum aestivum
  Clone ID: PAT_TA_104852
gggttgagctcgccgtcgattcgaggggagaggaggcgggaggagaggggcggccaccccggggaaaccgagccctatcggccgcggggcccctccatcgaccgccagtcgccgccggccatggcaggggcggcgcccgatcgggcggcgctgacagtcggccccggcatggacatgcc

SEQ ID NO: 104853 - DNA, 263 bp, Triticum aestivum
  Clone ID: PAT_TA_104853
cgagtccgtccgcccgtgccggcgtcagcgttgcaggccagtggctgcgtgcttgtgcaggaacttgtgacgaccagagatgaaggcaggacgcggtgccaccatcgcccttttgctgctgctgctgagctccggtcccggcatggctacgccggcggcggcagaggtcgatgttcagcactacaccgacgggctcggaatgtgggtctgcacggtgtatgcccgtctgggaccaatcgacaaggcgacgtgcgattggatgt

SEQ ID NO: 104854 - DNA, 117 bp, Triticum aestivum
  Clone ID: PAT_TA_104854
ttatgatatgtcatttttggtgtcatgttagcctggacaaccttatggtctgaacccttgtacttgatggtttccgtgtgtgtatctatggatgcacccaataggtagtatataatg

SEQ ID NO: 104855 - DNA, 167 bp, Triticum aestivum
  Clone ID: PAT_TA_104855
tcaccacagtctcggtctatcacggtagcactagcttcagctagccaccctcttcctctccgggcatcttcttgcatcaaccacggcaatggccaccgctgacgtccagaacccatcggccgcgctgacggaggaggcgcccgcggcggagacgccagtggccgccg

SEQ ID NO: 104856 - DNA, 503 bp, Triticum aestivum
  Clone ID: PAT_TA_104856
tcgccggcggacgaccgaccgccctggcgcaggtggtgtctcgccctgccagtctgccatgcgccgggcgccggcacctgttccttccaccggcggactgtgaacgcgccgtgccaacatgcatggcggagcacgtaccctactggtgaagagggagacgctgctcgccgagcggcgtgcctcggcacaccagacacgagtctcgcccgttgccggccctgaccggcggcttacacctccagctctcccgtacctacggtcaaccgaagccgagaccaaggcgcgttgatctcaatcttcctgttcgttttcaatccgaaggtgcaggtttcttcatggattgccagttcgccgcgtttgattttgcgtgtcagacgagagaaagaatagaaaataggaaaataaaactcggttctactactgaaccgtaagttcagtttattttgttcgaaaagaaagtgtttggtctattttactccctccgtcccataatataagaacga

SEQ ID NO: 104857 - DNA, 235 bp, Triticum aestivum
  Clone ID: PAT_TA_104857
ggcgatccaaactgaatccggccgattcggggcaggttgaggcggactgggggttcggattcggggcggtgaagaggagagcagggggagatggaccaggtgctgaacaaggtggggagctactggttcagcaagagggccagcaaggagatcgactccatcggcgacgacctcaactcagtctcttacaatattggcgggggagctaaatggatggtgaacaatatcaaaggga

SEQ ID NO: 104858 - DNA, 185 bp, Triticum aestivum
  Clone ID: PAT_TA_104858
gccagcctccatccaattcctccccgtctctccttctccacgcaagcacaaggggcaagaaaggcggcatcgtcaccaaattgggcaagattctctctttctcgcacgcaaccaatcgccagccagccagcatcactccttctcccgcggctgtcatacaaggacaagagaggctgctggtctcc

SEQ ID NO: 104859 - DNA, 472 bp, Triticum aestivum
  Clone ID: PAT_TA_104859
ggcaaagttgtggtcgatagcgtcatctcaacgctcttctgctcgaatgcttctgcaaagagacgctgcgaggcctcgtgatgcttgtggacatgaaggcgcagcgattcttcggcggtggtcacatggacgatcaacgatggctacggctgtgcactcgggcgagcttgagatcgagcgctagaggagatggagagagctccagagcaacgggaaagtgagagggagtgcagggcatctcccaggcgagcggatggggacgaggacgtgggggacagcgctaagcaggagatggcagcagggtgagcccgcgcgacacgcctctgcctacaggcagacgttcaagaagacatggccgtgggctggcttggcttcaggtgattgctcacaacattggcctagggtgacaagatgttaggttattgctccctacattatagtctctggccaaagagaatccaagacatgctct

SEQ ID NO: 104860 - DNA, 519 bp, Triticum aestivum
  Clone ID: PAT_TA_104860
ttttagacttctagcgcactcgctccagtccaggctcaggcagggcttcctcatcctctcttatcctcctcttccgcggtcacacttcacatctccgtcttcttctacatcccgcctcgatctggatcgacaaggtgggttatattctcatcgattatcgccctccgctatgtccgattatggtagcacccaatttccaccatgctgtagattgtggggggaaagagaaaccatccgtcaacagcaatgtccatggttttacgaccgctccccctttagcactgccacgaattacgcctttttcgtacgtaccatcagatcaatgtgtgcatatgatgatatatatgaaccaactgaaccttcttgtttgattcgatgtccttagttagtcacctgcaccgtcggtgttcgacgaattgcttcactgccatgtttcttagctgaatgagtgcaccagggttccaaactgataacctggcattatatgtatgatgcttcatcgcatttcagttgtcgtgc

SEQ ID NO: 104861 - DNA, 452 bp, Triticum aestivum
  Clone ID: PAT_TA_104861
atcccctgaatcgatccttcctctcgatcccgacctggttcacaccggcggcggcggcaggccggcaccgaattccagcagttcctcacagactgcccggctccccctcagcccctctcacacaggcacgcaacagccagtagcagcccgttccccggcggcagctcgccggctgagctcgtcacttcgcaggcgggagcggcagcagcagcaccaaggtacttgatggagcctgatctaactttggatgaagtagcagaacagaacagatcagcacctgacgaagaggatgaagatgctttcgtcgtcgaggagattggggattcttcagatgaccgacaggcagagccgaccgtggcgttggaacccaagaaggggatgatgttcagcagcgaggatgatgctgtcaggttctacaaagcttatgccagaaaaaagggctttggtgtcat

SEQ ID NO: 104862 - DNA, 499 bp, Triticum aestivum
  Clone ID: PAT_TA_104862
tttcctaataatccttatactcaacaagggacatggagggtgttccaagtgcagtcacaacgttgatcaccactgccgttcttgaccaagacctactagtttggtggtacaccccgcatacaacgtcttcaggctgtggtgccccggtggtgccagcttcttcgtgagtacctgccggacttcttgcaggacctgctgcccaaagtacttcaaatgggagttcatcacccatgttatctatgatgacaagtggcagtcagcatctctacatgcctaatttagcctttgttacctgggatgacacgttggacaagcataatatgctgtgaacattttaccgatgcctcccacacctatgtctataatttgtactccctccatccggaaatacttgtcgaagaaatgcataaaaataaatgtatctagaattaaaatgcgtatagatacattcattcctccaacaagtattttcggacggaggttgtaaaaaaaaaaaaaa

SEQ ID NO: 104863 - DNA, 577 bp, Triticum aestivum
  unsure (1)..(577): unsure at all n locations
  Clone ID: PAT_TA_104863
accccttgcacacaattcttgtattcgattcaagacaacagctctacctgttgcatgggttataacccgatctgttaccaagcatgacacttcgagatggatgaaagcacttactagtagaatacattctgttgattccaactggaggattggtggatttataattgatgatccaacctcagagctggacccaatcangaatgtattttcctgcccgattttcttttctttatggcacataaggagaacatggcttaaaaatataatcaagaaatgcagcaatactgaggtgcaacgggaaatatttacacaactaggaaaatttatgtacagtatctggagtgagaaaaatcccatggatgtcctggagcaattgtttcaagactttgttgaccaaaccaccttcatccagtatttcaagtcattttgggttcccaaattggagatgtggattgattccatcagaaatttgcccctggcaagtcaggaatcctgtggtgctattgagggttaccatctaaagctcaagcttaaagcatatgatgattcacagcttgatgctcttcaacgtgtggat

SEQ ID NO: 104864 - DNA, 379 bp, Triticum aestivum
  Clone ID: PAT_TA_104864
gtctccgccgtcctcgtggtctgtgcccgtgccatccgaagccaggactaactctagccctagcgcacacgcgggaggaaacaggaaaggggagcggagatgtcgtcgtggctgcgcagcgcggtgagccgggcggtggaggccggcggccgcagcggcgtcgcccgcgccgtcattggatacgcggacgccgtcgcgcaccacgcggggcaggccgtctccgacatcctcctcgaccgggggggcacacagagcttcaaaagtttcaagaaaacagtaatgcgattagaagaggcagcagtttcatgccgtgggggtgaaagaattgaattattaagacgttggctgggagcattacaagacgttgaggctgctctct

SEQ ID NO: 104865 - DNA, 267 bp, Triticum aestivum
  Clone ID: PAT_TA_104865
acaaaatgctgagggaagaatcacatccgaggatgttaaggagcaaacaaactttcaaatatcaaggagcgagcgtatgagtacacagtcctcgtcagcaagaatttgaccctaacgatttgggctacatagaggtatgtgtatgtccaagcgaagcctcgccatctcgacaggcgatgtctcaccatcaaggcaaaagcatcggataccaaccagcgtggtgactgtgtagttcctcttgccttccacaagccggcgtgcatgtaa

SEQ ID NO: 104866 - DNA, 383 bp, Triticum aestivum
  unsure (1)..(383): unsure at all n locations
  Clone ID: PAT_TA_104866
ggaaatattcgtgttttctgccgagtccgacctttattgtcaaatgaatctggagctgtttcttatccaaataatggagaaaatatagtcgtggtgtcgagttgatacataacacacaatcgtattcatttgcgtttgacaaagtgtttgatcactcggcatcccaggaatatgtgtttactgaaatttctcagttgggtcaaagtgcacttgatggttataaggtatgcatatttgcttatgggcaaactggttccggcaagacacacactatgatgggaaatcctgagttcaatgatcaaaaagggttaatacctanatcgcttgaacaaatttttcaaactagtcaatgccttatgtcacaaggttggaaatataagatg

SEQ ID NO: 104867 - DNA, 423 bp, Triticum aestivum
  unsure (1)..(423): unsure at all n locations
  Clone ID: PAT_TA_104867
tgcgggaccggggcaagaaccggaagccgatgcagcgggggcgctacctcagcaccgaggccatccaggccgtccagtcgctcaagcgcgccaccctctctggagcccccgccggcagcgccgtcgcgacggaccccaagctgcggcggctgctgaaggccgacatggtcgccgtcttccgcgagctcgcggcgcagggcgaggggcacctggcactcaaggtctttgatgagattcgaaaggagcactggtacaagcctaggttgttctggtatgttgatcttattacagtgcttgctaggaaaggattgaggtccgaggttggcaaancctgttcgtatctgaagagggaacaattggaacctgacacggatggtttcaatctgcttctgaagacactcttacatgctgagttcacacaat

SEQ ID NO: 104868 - DNA, 419 bp, Triticum aestivum
  unsure (1)..(419): unsure at all n locations
  Clone ID: PAT_TA_104868
ggacgaggtcgttggcgacctgtcgcgggagggggacagcgggatctgcgccaggaggtccagggcacgttgctgccgctcgtgcagcagaacgacggcctcaccgacgcgtccggggagaactgcgttggcctggtcttgtaatgggcagcagcccgcacccgaggtgcagagcagctagaaccagtgataatcgtgagatgggggcggacaacgatggagcttcttaatcagctggatggattttataagcttagcaagatttttggaaggttgaaggtggaatcgaactccgagctcgaggttgcgctggtgcagtggtggctgcgatcgggcccgatctangaaaaatcttcctcgtttttggtctgcatggcgatgatctgtttcttcaggattcgctcgttgccaaagctggc

SEQ ID NO: 104869 - DNA, 296 bp, Triticum aestivum
  unsure (1)..(296): unsure at all n locations
  Clone ID: PAT_TA_104869
tctctccgtctctctcagcacaggcgttcgctgccgtctccggcaccaagcgctcctccgggtcggcgctcggcaccgccggtgtaggccgtgcggggccctgggtccggccgacgcacgaggtcgaggggaatcgtccggctctgcctgtgcggtgcgcccttcatgtgttcggtgaaatgccancccgggcacaactaagattggggggggacgaggtcatgccttcatcttcctggggatgactgtactgcaaaaaaattggatgtgggggattcctgtatcactgaaactac

SEQ ID NO: 104870 - DNA, 351 bp, Triticum aestivum
  Clone ID: PAT_TA_104870
gcacccacatcggccagttccgtcgagctccagcggcgcgtatcacaccccgagctcccctatgtccgcacctccttcccctccggctagaatcagcgctcaagccgtccaccagcccccgtggtagctagggcttcggccgccaccccttacctggccgggatccgccacatccggcgacgtcgaggccagcgggcgccggatccgtcaccggggtggcgggagaagcaggacaggcacagatggaggaacaccgtcttcatcccctgccccgacgccaaaggtgattgcgtcaaaaacatggaggcgttcaggaagcgggcgggcaagttcaaggagcaagtcgccgag

SEQ ID NO: 104871 - DNA, 326 bp, Triticum aestivum
  unsure (1)..(326): unsure at all n locations
  Clone ID: PAT_TA_104871
gaattagcttccgtcatccatgcaaaccacttctaattgctacgtacaacccggaggaaggatccgtacgtgaacacttacttgatcgtattgcaattaatttaagtgctgaccttccattgagttttgatgaccgcgtggcagccgtcaatattgcaacccaatttcaggagtctagcaaagatgtttttaagatggtggaagaggagactgaggtcncaaaaactcagataattttggcaagagaatatctgaaggatgttgctatcagcacagagcagctcaaatatcttgtcatggaagctatacggggtggttgtcaaggg

SEQ ID NO: 104872 - DNA, 285 bp, Triticum aestivum
  Clone ID: PAT_TA_104872
tggaaatgtggataggtgtatgggtactgatgggttggtggcagtttagttgaagtgtcacagggcagatggggtgccatacctatggcacatggaatcactttggggagaaatggccccaaatctatgagctctggattctggttgcttgattttgatttgacagtacatagtttgttgcttaagttggtttgaggggttgtgtaaaattctcgccttaaaggtttgagcaatgtgaaatcgtgtgattgaagtgtcaagctaatttacttcaataacaatggc

SEQ ID NO: 104873 - DNA, 204 bp, Triticum aestivum
  Clone ID: PAT_TA_104873
ccgcacgacgacgaggaggcgcagtgcggggcgaatggagagtggcaggaaccggccaagagcccggcgggcggcgccactgccatccgaggtacgtacgagatttccaggtctgcaacgtagtactaggtggtgtgaggttttccaatcttgtatgcttgtgtgctgttcgacagaatgccagagccagcgacggtgccggac

SEQ ID NO: 104874 - DNA, 405 bp, Triticum aestivum
  Clone ID: PAT_TA_104874
gccgtcgcccgcctcggcctcagcctcctccagtcctcggagccctccacgatattctctaggaaatggctgacggtgaggacatccagccccttgtctgcgacaatggaactggaatggtcaaggctggtttcgctggagatgatgcaccaagggctgttttccctagcatagtcggtcgcccacggcacactggtgtcatggtagggatggggcagagggatgcccatttacgaaggatacgcgcttcctcatgccattcttcgtttggatctcgctggtcgggatctcactgactcccttatgaagatcctcaccgagagaggttactccttcacaacctcagccgagcgggaaattgtaagggacatcaaggagaagcttgcgtacgtagcccttgattat

SEQ ID NO: 104875 - DNA, 279 bp, Triticum aestivum
  Clone ID: PAT_TA_104875
aaatatgtagcctgtgtgttcgccaaggagaagagcctatggcaaagcatttgtgctccttcttggtccatgtgtgtgtgttttcttgtgttcttgagagaagaagatagagagagaaaccacaagagagttgtgtgaggcagctcgaggtagaagaagagcggcgctgcgagagctggcgccaacaattggtatacagagccaggttgatccgagggcgcgacggcggcgcagtcgactccatgtgaggtggaggatgatggtgcgatgctgctggtg

SEQ ID NO: 104876 - DNA, 555 bp, Triticum aestivum
  Clone ID: PAT_TA_104876
tcgcggccgcgtcgacttttttttttttttttttttgaggccaaatgaaattgcatgttgagacagcataaagcaagatgtggacagagtgatagtagagtatgcaccgtaatattacatgtttccaccaaaatttgaagacatggagtggaatatgagcaatgtactcttggttctgttgacacgagagtttgtaaatccaatcaagaaaaactgattatattgcaggaaaccgactctccttttaaccccaagtactcacctctgcagcggcaatgcttcgatttgatccagctaatagttgtatgaagcaggaacaaacacatcatgttcagagtcatcaaaatacacaccagctcagtgattatggggaaactgagaatagggttggtagtatgctccatccttgcagctctgaaagtggaggcgaacaaaaacactgtccagaaatgctggcctgtttaatcactcagtatgaaataatgatacagaaaacatctggaccgaaaatgcatccagaagtcctcaataaaaattagatcaaaacacccgtca

SEQ ID NO: 104877 - DNA, 485 bp, Triticum aestivum
  Clone ID: PAT_TA_104877
cgaattcgcggccgcgtcgactttttttttttttttttttttttttgcacacacgacgttttcctcttgttaaaacaaatatgcttacaactttggaagtaccacacagacacaggccaaccttcctgattgatgtcactcacgctttgcacctctggtgaaacaaaactcctactcgggtacatccacaagggaaactactcaatcaccatctaacctaggtgcaaagccaaaatacatatgcagatgcataaatagtaagaattaaaactaacacccgttgcccaccgctgcaccgggggccctgtctccggcaggaccatcgcgtggcccctgtcttcatgcgacgcgcccatgagcgtggacgccggttcaacggccgcggccgctgcgagcagcagcagcagcagcagcgacccccgccacatgtcgtcggtctggtgcgggcgcttgctctctctgccttgttcggtttgcacggatac

SEQ ID NO: 104878 - DNA, 576 bp, Triticum aestivum
  unsure (1)..(576): unsure at all n locations
  Clone ID: PAT_TA_104878
tcgcggccgcgtcgacatttgataacataaagtcggtaatgaaatactacttggaggtgcagggcataagaaacatgatggcacattgagactgtttatacctggaaaattttccagcaggtgtgtgcagaggcatggattcgacagctccaccagttgaatcttaatcagacgacaaagagtattgacctggcgagaccttacataatatcactgcatattagtagaacaaaagaaaactgagctattatctgttttttcttctatcttccattaaatgtggtaactatctcatactgaagtactaacttcctctgctccagaattagttacctgggttacaaatttacaaaagaaccagtttggtcaacttaattattcttaggcgcatggaattgaagcatactattactattcaacacaatcataagaaaatatnttgtggttctctgaatacaaccactcagccacacgatggaagaatcatgtttcctatagtacacaagaagtatttgtccttgtgtggcagtacatcagttgcatcaacgaaaagtagattcatagtcgacgcggccg

SEQ ID NO: 104879 - DNA, 519 bp, Triticum aestivum
  Clone ID: PAT_TA_104879
tcgcggccgcgtcgactttggagactccggcgtcccctcggcccgtgatcgcgtccccgtccccgtctcgctcgcgggtggccggaggatggccgccgcccatttcacgctcaacaccggcgcccgcgtcccctccgtgggcctcggcacctacaaggccgccccgggggtcatcgccgacgtgctcggcgctgccgtcaaggcaggttaccggcacatcgactgcgcgccgctctaccataacgagaaggagattggtgttgctctgaagaagctcttcgacgatggcgtggtcaggcgagaggacctcttcatcacttccaagatatggtgcagcgatctcgcacccaaagacgtgccacttgcaattgacagcacactgaaagatctgcagctggattatgtggatctatacctaatccactggccattccaagtcaagaaaggcaccgaaataagtccggatatctttgtccaccctgacatacccaagacctggcaagccatggagcagctgta

SEQ ID NO: 104880 - DNA, 377 bp, Triticum aestivum
  Clone ID: PAT_TA_104880
tcgcgccgcgtcgactttttttttttttttttttttttcagaggaaaaccgagtgaaaacctagattacaaaccccacaaaggggacacgcggatgacctggccacaaacgccaaacagtcgaccgaagcatcgaggacaaggcagctcccattttgcaaacgagcttcacaaagaaagttgcaagcctcgcaccatcctagtccagcgcaacatccggagagcaccacccgctaaaaaccgccctcgtggagtcatcgttgctgcagtggccccgccgccgcagcttcgacttctctgttacagccagaaatcagcatagacgcacccattggcgcaccggaccgtcagcatcaaaaggaaatgctgcgactcggc

SEQ ID NO: 104881 - DNA, 445 bp, Triticum aestivum
  Clone ID: PAT_TA_104881
cgcggccgcgtcgaccacccctctcccctttccggcgagaagatggcggcggtgcaggtcgcgtccgcgctctccgtgccgctcctctcggcgctgctcggcggggccgtcgcgctcgtcttcctcgccgggtacctgcgccgcaagcgcgccgacatcgcgcacctgccgccctccgccgccgccgccgccccggacctgcccaagcaggtccgccccgccggccagaacaagaagggcggcgggcacgcccgcgtccaccaccaccacgcctccgccgccgacaaggaggcggccaagaagccagggccttgacatcgtcgacctcgtcgctctcctcggtagccacaccattggcgactcgcggtgcacgagcttccgtcagcggctgtacaaccagacgggcaaaggcctcccagactccaccctggacccggcggcggcg

SEQ ID NO: 104882 - DNA, 506 bp, Triticum aestivum
  Clone ID: PAT_TA_104882
tcgcggccgcgtcgacctctatccagatcgttctgaagatttgcatcaacatcatccatcttcaaaaactcaatgaccgcctcttggaatgttaccaagttattcaatttgaccggaccgtctgttgaaagattagttccacactgtatctctttagttcggaaaactagcgaccgattaaattccaaggcccttttatccaaaatgctttgaggatcaaatactacatatgtatttttcaacttgatattaaatcttgtaagaaactgcttgatggcgttggctattctcttcacaccatcatccacatctcgagatgcagaagtagagcagggattactatcaggttcattcctcttggtctcagccgatctcacctctgtatcagtattaccaccagaaacagagcactcagtatctacaggtggggcttcactagcaacagatggtgcaagtacaaactccaacccttccactatgatctcaatcttccaactccttaactg

SEQ ID NO: 104883 - DNA, 454 bp, Triticum aestivum
  Clone ID: PAT_TA_104883
tcgcggccgcgtcgacggcgtgcaagatagctaagtaggtaagcaaagcctgttcaggttcctcattccaagtcctgtggaaaataaatgatagcaaccgttgcttgataccgggaagaaaagaactccattgtgcagcctggccatgtgaatgaagacatagctcgtcatcttccgacaaaatgcaccaattcttcgtacctcaacaaggctgcttgaatctcggatttgtagaacatgtattgtttgatatctcacaagaaggaaagttattttctcaattgatggcacaccgtgacttgaccgctgctccacaagcaacgcccatggacctggctgctgctcatgtcgtgtgtgcaggctgctacactacccgacggcctacatcgccacgtatacttgcttcacacaatcgcacggggctcgtcagctagactcggcttcgagttcgtgc

SEQ ID NO: 104884 - DNA, 605 bp, Triticum aestivum
  Clone ID: PAT_TA_104884
cgcggccgcgtcgacagcttccaaacatcgctacttctgatcccgaaggaactgcccaaaaaccagcaagcccgcggaaatggtcaatacggaactcatcatacaaatcaagggcacgtttaatcctctttacccaccatgcaaagccatctgcttccatagatttccagtcatacaatgggctgttccataactgaccagttttactgaacgcatcaggtggaacaccactaacaaatgtggggaaaccattattgtccagcaaaaatgatttcctgtttgcccaaacatctgcgctgtggtagccaacatatattggcatgtcacccattatgctgatgccaagcttctgtgcatgtgaacgaacccgtttccattgcttttcaaataagaactgttgtgccataaaattttctataaagtccttctggttttcatatatatctttcaaggctccaggatggcgatctttcagcggttcaggccactcagaccaggacactgcattgatgctattgtcgatagcagcgaaaagtgcagcatcttcaagccaacctgaaacatctggatttttcttgaattcgtcatactgccttctgagctct

SEQ ID NO: 104885 - DNA, 660 bp, Triticum aestivum
  Clone ID: PAT_TA_104885
tcgcggccgcgtcgacagcccaactaaatcacaaagcccatcttttaacaccccgcaggaagtagcccagcgcgaagggagacggtcagatcgtttgattttccatcgtccgatgcctgtcgccaaggtctagctgtctagggtagttcctgaccagcgccgtttcaatctgagtccatgaccagcgccgtttctgagctctagggcagttcatgaccagcgccgtttcaatttgagcagacaatccttgcttagacgagatagcgtctaacgtgaacgagggccatcttgcgcggacgcgcggccggccggccgcgcaaccagtggagagaagcggcgaccaaggaaagggttaggttagtctatttctcactcattggtttgtccttgcttatgtttctaaatcagattaatggatgccttcagaactacacaagtcgaatggtagtaactgtataaaagtaaaagattggggacacatccctgtacggctgtacccatcggacaagcttttgcattgtttatcccatccaatagtagaaagatttagttcattcacacgtgaattgctttggcatttggctgatggtaacttttgataaaaattcaacttgctcacagcagaatatgttttgacgaagatttagttcgttaacgtcg

SEQ ID NO: 104886 - DNA, 489 bp, Triticum aestivum
  Clone ID: PAT_TA_104886
gatccgaattcgcggccgcgtcgacgagccttctagttgagaaaattccttttttcttccatgaccaacaaggcatgtctctgatcccagcagttggctcgaagaagagcagtctggtccacaccgaaatgaactcctgtaatgcctctgggctaaggtcagacccaacgtcttcaatccagaggcctctgacgttcgtctccgccaccgtgtggttcgtcttgaggcgtggctgaacagatgcacaaaaggttaggagactcgtactgcagcctatcgccatccagccaacggtccaaccaaaaaagcgttgcctcgccattgcctacaacagatctaccctcaaacagtaccctggactcctgtgtcacttgcagattaaattccttccagggattcgaagcaccgggatgcttcagccaaagccagcgcgagcgcagggccatgtccagccatttcagatcaggcaaacctaagtcgacgcggccg

SEQ ID NO: 104887 - DNA, 596 bp, Triticum aestivum
  Clone ID: PAT_TA_104887
tcgcggccgcgtcgacttcttgacaaactgccgaaatgccttagttgtagaaaaattaaggtatgtataatcttcccatttagcaggagacaaatataattaacataaccgtgcttccatttttttctctgtttcgcatgaggaaaaaattagtgctgtagtgcaattattgatttggaagacagctgatgctgcatagctttactggaagatgcatgagaacggaccgttaaactttcattcccagtacagtactacatttgtaccgatacttccaactactgtaatgatagcatatcttgaggaactattgtccttccaaagtactacctaactataacctctaaacagacagctaatgataatacttgatctaaataaatactgcagctatcttcactttgaaggtaagcttcattcatggcatcgggcggttgaaagtacttaattagggtaatattatttagcagaatttggtgatggatgtgtggaccaaaaaatacccactacagtgcctcctttagtagaaaacacaatcaagacagcatgttttgggatgtgatttacgtactgggttgcctcagaatgaaatgagc

SEQ ID NO: 104888 - DNA, 349 bp, Triticum aestivum
  Clone ID: PAT_TA_104888
tcgcggccgcgtcgacaagcaaatctgccaggtgttcctccagcttgcatgttagcggcagctgcagctgcatggttagctgcacttgttgtttcagcagcagcaagatcttctgcagcaagaaggtcgtctagcaacacacctccccgtaaacctccataaatgaatatcatatcaccaaccgcagcagctgcatgcctgcaccttcgtgtaagctctccagaagcctcaccgcccgctgcatctgcactatatcttcctgtccttggagttgtaactactgattttgtgtcacaccaaactccagcagcagtgtccaacactgccacactagaggtcgacgcggccg

SEQ ID NO: 104889 - DNA, 609 bp, Triticum aestivum
  Clone ID: PAT_TA_104889
cgcggccgcgtcgacggaggagcgaaacagcatccctgccttcctccacgcccgtagggtttccggatcggaggagcccaagccgccgcagccatggttcgcggatcgctcgggaggttggcgtcgcgcaccctctccgtcgccggcaaatggcagcaccagcagctccgtcgcctcaacatccacgagtaccagggcgcggtggtggggtcagtgcaggaggtcaaggaagttttgaagaacgtcttccccagtgagaaagagatagttgtgaaaagccaaatccttgccggtggccgtggattgggaactttcaaaagtggactgaagggtggtgtccatattgttaaggctgaggaggctgaaagccttgcagctaaaatgcttaaccaggtcctagtaacaaaacaaactggtccacaggggaaggttgtgggcaaggtctacttatgtgagaaaatgtcacttgttaatgagatgtactttgcgatcacccttgataggaagactgctggtccactcattatagcttgcgccgagggaggaacgagcattgaagatcttgcagagaagttccctgataagattgttaaggttcctgttgatgta

SEQ ID NO: 104890 - DNA, 559 bp, Triticum aestivum
  Clone ID: PAT_TA_104890
cgaattcgcggccgcgtcgactttttagaaaaccgtagtattctttgcctacccagagtaatactgtggttttcaattaccacagtttagaaaaaactttgctgccaaactagagttattacacgcaaaaacactgttttcctttatgattattactattcggatataaaattccgttttggcgtattcttaaaaggcaaaaaccaaactccctctcgaaacagaatttctcaacgcggagcatcaggtatgctgcgaatactgcccgctgagctgatcaagagccagaagtattttgaataatgtcatctcctctcgcaaaatgccttccctcgtaaaacaaaatccgaagcatcaaaagttctggtaagccgggcccctgtccggtctgcatctccaactccatcgtcgcttgagccgcggcgctcctatttcttccggttcttcctctgctgcttggccagcctcctcttggcgtcggccttggcgaagaactcggcccactcctccgtcaggacgaacaccggttcctcctcctcctcctctgcccacccttcct

SEQ ID NO: 104891 - DNA, 602 bp, Triticum aestivum
  Clone ID: PAT_TA_104891
tcgcggccgcgtcgaccgacgacaaagaaggttctattacatccgtccaggctatttatgtgcctgctgatgatttgacggatcctgctcctgctaccacctttgcccatcttgacgctactactgtgttgtcacgacagatttctgagctgggacatggttacactacctcgggcaaatggcggtttgggggactttttgcctttcaagagccatcacaaagatactgccatttggaagggcctcaagagctgcatcccgttggttgtctcctcctcgcgctgctctattggcaacggcgcacacgtctccttctggcatgacccatggttgttgcctagcagtctgaagcatgcttttccggtccttttctcctttgctcgcaatccaagctgtcttgtgcaatctcagttacgggaggcgcctggaacgtacagctccacccaaacctcactcaggctgcaactcaagacttgcatctgcttcatcagctcatggatcttgtcaacctggatctatcaagctcggatgcacgggtacccacgcttggaggaaactgtttatgcaccagctactactacaagttgctcaccttccgggga

SEQ ID NO: 104892 - DNA, 449 bp, Triticum aestivum
  Clone ID: PAT_TA_104892
tcgcggccgcgtcgactttttttttttttttttttttttttgcaaattgcgtacgatagctttataaaaggagagaaaattagtacatgacatctaccactcgctgcgaacaatgagcgtagcacaacatcacatccggctatcctcaggacagccacacacagcaacacaactacaacacggaaaaacctgcccaaaaccgaaacacctcgccgcgtcttgatcgacgccgaacacctccaaaggaagctggaggggagcggtcagggccacgacaaacactggaggagcgccaacagaaaactcagtctcctcgcacgaggctcccaacagaaaaacgacgtcatagacgccgccatcgtgccgctccagaggaccaagggtttcgcccggagacaactgccaacaccaagcacaaggaagatggcgacacactcgacgtcgcctcc

SEQ ID NO: 104893 - DNA, 577 bp, Triticum aestivum
  Clone ID: PAT_TA_104893
ccgaattcgcggccgcgtcgaccactactaactccaggctgcaccaaagaggatgaaaccactgaatgccagttcaaactgaaagctgccacaaagaccgaatcatcaagtaatatgcatcagaatcactagtcagaagtcaaaaccatcggggaagcagacacagtcgaggctgatggcttcaccaagtccctgcgaggctgcaacagggcatacgttccatgtgagcagctgcagcggacgcctacgctactccctgatgatttcatgaaccttttatatcacattgtattcaggagtgtagctttcagaccaaacaccttataagtgcagttccagatgacaaaaattgtgtcgtaattcaggtgcactgatttttaatattggagctgagacatagcgattgcttctacagctaacatcttctgtcacaatcatcatagcaccagaatgcacttgatcatagtgcggtccatgtcaacctgagatcctcgatagttgatatacaaatgctcaaagattgcccctttaaacccaaaccgaggtacatatccccaatccatgtggctttcttgga

SEQ ID NO: 104894 - DNA, 506 bp, Triticum aestivum
  Clone ID: PAT_TA_104894
ccgaattcgcggccgcgtcgacaggggggaaatgtcactcgctttaggcttctgctcgacagtacttggaatggttcggcttcttgtgactaattaacctgtcaggttggtgctgatttgggactatgattaaaactagaggctgatgttgttcaggctcatggagctcatggagctcgacctctcctccgtggcctccgtctgcaagttcgccgatgacatcctcatgtatgtacgcctcctcttctaatccccacactgcttcgtactagttccaatcatgccccaccaaaaaagaaaacatacactaggtatcacagttcactatggatttgatcatcagttcataaaaaatcacagaaaaaagaacaatgtgttactaccatgggaggctccctgctggatgtcggcgccggaggggtatccccgcagccatagacttctcttctctcctgcaatgcaaggttgattttcctcttaaacattcacacaggtcgacgcggccg

SEQ ID NO: 104895 - DNA, 646 bp, Triticum aestivum
  Clone ID: PAT_TA_104895
tcgcggccgcgtcgactttaatcttactgccacactgtatgactctttcagcctttccagtgccaatataagaagtttggtatcatgcttgtatgagagtgggggaaatggaatcggtgagaacttccttgactccagccaatggaccgtggttgtataaatagcaactgcttcttcaggtgtcacatatggcccgtctttcaagtagttgtgttgcctctcttgttctgccttcagccacaaacgagttaaccttccaagatttttgcggcagacagtcttgtcaactgtagcaccacgccggatacgctcacgattatagtgagcaacatttgtccaccaatcagccttggacttcacataacggagtatcatgttctcaataggaactggcaggccagggaccttccaggggatatttgccttccagcagcgccatgcctcactaagatgctgcagtatagtcctggccttgttttgcttgatgccctctggcatagcatcaaggacatcatgcataactgcagctcgaagttccagatcaaagtgagactcgacacgttgcttggttactgttttagcaactccttttgaatggcgaccttcaaactgcctggccagcaaattacctagccacctttcaagc

SEQ ID NO: 104896 - DNA, 575 bp, Triticum aestivum
  Clone ID: PAT_TA_104896
tcgcggccgcgtcgactttttttttttttttttttgatgtacaactggtcttccattatcatcacttacatctggcaagctcagttgttcaaaaaagtgccaagatcaagcacataaaaaatgtacagcacgaaaaattattttatagagaactgaatgaagctaatttggtgttctagatgttttatatgtcctggtaaaagtttttttttgcggggaagtaaaagttaaacaaaattgatttagggaaaatcaatagctttgattaatttggaacggatgaagcagttatctttccccaaaagaaataaagaatgctgctcaagtttgaacagtttttgggtaggctcagactggtaaagaaggccgcgcctgaaaaccaagctcgttgtcaccgtccggttaaggcccattttggcagccggcacacgagtcgctctcccagccgcacgcagccgacggctccttctcatcccctcccagctcccatctcgtcgagggtttccgcggctgcctcctacaacctacgctcctcccaacatcacaccaatggcgaccagcaagaaaatttcgtc

SEQ ID NO: 104897 - DNA, 234 bp, Triticum aestivum
  Clone ID: PAT_TA_104897
cgcggccgcgtcgaccgcggccgcgtcgacctgttcatgtgtgcccgaactcctcgccacagcctgccctcccaaagcttcttcaactgccgccgagaggtcgcgagccctgcaccagccgtgtaatctgcacctccgcagtaattgaaccgagagagaggtagtatagctatggtttgttgttctcggcggcgagacacgccggcggccggcgggctgctcgggtcgtggctc

SEQ ID NO: 104898 - DNA, 569 bp, Triticum aestivum
  Clone ID: PAT_TA_104898
tcgcggccgcgtcgacttgaatatcatttaacaaatcactgtacttgaagtcagtcagtgcacccccagcatttccggatatccgaagagttgtctcggcggaacttctgagatatgaagaacaacacaactgcaaggattatcaaaactgcagcaagtccgccaacaactgagccaatgatcgttgttttcttcctttgctgatctggtagctcggatgctgctagcctgaggaggagtgtgcctcctccaattcccctgtactgatcttggagagtaatcaggtccccatgccaaacaaagcacccagtgtaattgtaagtgtaagcagtgcaaaagcaactattaagacaaaccacctcacattcctgagagcttgtagccactgcatcctgagcattatcaggtaggcgcacatcttccatgacatggaacttatcagatggagcctgtgcagaagttgagttggtctggcactgcaatggtgtattcctcttgcacccaccactgtaatcttggaggtcccagtcactctgaaccttctggctgaacccctggacacagttgca

SEQ ID NO: 104899 - DNA, 557 bp, Triticum aestivum
  Clone ID: PAT_TA_104899
cgaattcgcggccgcgtcgactaagaagctagctgcggagggatggctccgcatagctagttagcaggctgaggtctcgttcgttaacggaattaaccagacaaatcgctccaccaactaagaacggccatgcaccaccacccatagaatcaagaaagagctctcagtctgtcaatccttgctatgtctggacctggtaagtttccccgtgttgggtcaaattaagccgcaggctccacgcctggtggtgcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaggaaatgcaaccaccaaccaacagcttgcgctttcatggacgacggacgggacagatcattgtgaaaacatcttccacaacttacagggatgatatttactaaaaagaac

SEQ ID NO: 104900 - DNA, 434 bp, Triticum aestivum
  Clone ID: PAT_TA_104900
gcggccgcgtcgaccgcaggggaccaagatgacaatcgtggatcaggaatatagtagtaaggggaccaagatgacattcgtggcctcacacagccagtgacggtgatctttgaaccccacttatggggtcgtgcaatgcaaccacaccaccggccatcggatcggatcggaacagatggaaatagaagagaataaggaaaccaactcttctggtccaattgaccatgggcgagcctcaagttgttgaatctatacgacctgacaaaagaggatgacatgggaggactaacaaaacaaacaaacggcctgacagggacatgtatcacggtgccctacaaacagcaaaaagtaaatgtgtttacatgccattattttctcttccaacttgtgtggaaaacagtggagagactatcaattgtcatattattattttg

SEQ ID NO: 104901 - DNA, 448 bp, Triticum aestivum
  Clone ID: PAT_TA_104901
tcgcggccgcgtcgactttttttttttttttttttagaatcaaactcgcgccttaaatccatggatcgccacaaaacatgtgttccaagccgtgctttgcaatgacattgttgtttgccccgcactaccgccctggccagtgctcgccggagctcagccagagaagctgaacccagacccctggagtgcctcctcgacggcctcgtccagcatcttccccatctccggcgacatgtggctgctccagtccccggcgacccccttccggaagaaagagtcgctcctgatgcccaacgcgttccgccgcccgtccctgttggcctccatgttcttcagcttctccaggctgcacaggtccacgatctcgtccaccacccctcgcgccacctcctccttggagaagccgcatcccatgaactccgccatcgtcttcagactccccgtcggg

SEQ ID NO: 104902 - DNA, 337 bp, Triticum aestivum
  Clone ID: PAT_TA_104902
gcgccgcgtcgactacatgtatgactatacgaactcttcttccctccaggttgatttggcaaatctttgacagtagctgtgggtcttatactgatgacaatcaacgtgtcttttccgaccaaccaggggtcgattccaacatatgtttttctcttatataagggcagtgacttcactactttaggctggatgattcgatgtttagtagcttcatcaaactggatgctagcaaagtgataaaattttggatgttttcggaaatatagcatcacgagcccaataagagaaaaaaatcaaacatcattatgaatgccttaggataatgattttaccttgc

SEQ ID NO: 104903 - DNA, 573 bp, Triticum aestivum
  Clone ID: PAT_TA_104903
tcgcggccgcgtcgactactcaaggtcttgttgaactctgcgcacgtataatcggccattcgagatccggaaggagggaggtacgtagctctgctgccaacatttatgttatcatttgaatgctagtattgattgaggaaggattttgcttgttgtaatcaccaaccatgtagtagtgcttttcagaaaaatattaaatattttgtataaccgtcgtctgaagattatgcccaaactgagaagcatgcacatgtacatttcttcagttggaaaattggtgcaacttctatttatccatttattttgagaggatatgtatctacgtatgctactattttactgtctgctttgcgacatctttcgagaaagccagggtaaaggatttaagatttcctctttaactagaaacaagtgtgactgtaatcagagttcacccctgaaactgtgcaaactactccctccgttcctaaatgcaagtccttttagagatttcaatatctctaaaaagacttacatttaggaacggagggagtgcatgtttacaactgccttccactcacaccctttgtttca

SEQ ID NO: 104904 - DNA, 172 bp, Triticum aestivum
  Clone ID: PAT_TA_104904
ggccgcgtcgactttttgggcggcgttatatgatttcggtgtctctgtataggttggtcgtagggattagtagctcattgttttttactgctaggagtattactattctttgattcgttggatggcagctaataatatgatcagattattactatggctaaaaaaaaaaaaa

SEQ ID NO: 104905 - DNA, 418 bp, Triticum aestivum
  Clone ID: PAT_TA_104905
cgcggccgcgtcgactttcattatcgtttcccatatgtactctaattaggtttgcaattacactttgttttatttatcatctgtatctagaaaatcagattgtgaagcttataatttattagtttttctgtgatttccctttattttgctgatagtccactactcaggattataagagccaccatctttgtgagcatttttccttcaggtgttgcaaggtgttagtatggttctacagagaaagctgcacaacatgcctaattttgtacttaccttgcagttctgtagatctactacaattatatgatgtcctcaaatcagacctttgcaagcatgacaagatatcagtatatatatgtagcgcacctttggttcgatcatacattcatagtagtttgatgtactacgttttggttgg

SEQ ID NO: 104906 - DNA, 447 bp, Triticum aestivum
  Clone ID: PAT_TA_104906
tcgcggccgcgtcgaccaagtgtattcggtatgtagttgatttcacgttgtagagtctatgttgagttcttctaatgagcaatgtcatgtgtaatggatggttttccacattagattctgcacaagtcttttcattggcccgccatatttcatgatgggctgcggacacctttgattggcccaccagattgggtgaataataaataggagatacatcagcatactatttgtttaggaaaatgtttgttttcaaccggatgaaaacattgtcgcgtaaaccgggtcacccgcacgacacgtgtcccctacacaagcgagtccaccgcctccccaccagccttatcttctccgctcatcctctcctccactcgttctccctcctcgtttcttttcctcttccaatctccttttttccgttccaatcgagaggaagggtgaagcccacca

SEQ ID NO: 104907 - DNA, 518 bp, Triticum aestivum
  Clone ID: PAT_TA_104907
tcgcggccgcgtcgacaaagggatatatctccctttgcatcgcggacctaggcggagtaaatcatttgcaatgtcacacagaaccaatttgacgctttggtcttctgatggaagagacgattcaatatccaataggagatcaaagatgaggtgcacttgttttacagtctgactcaaaggatcttccaggttgctccatatgatttttaatacacggttgacaacatccctagagaaaggcttatagtcaccagtgaaatcagtgaaatcagccaaaacagatgtcttaatctgctgcagacatatttgagtcactgtcagagcatggaaattgaagtgcctatcaatggggttctcacagtgcatgcaaagctcaggtaaaatcccatcatacaatacagtccataacgatccatttgaatgaagctgacgcacgttgagtgctttccttggaatagccgtcaaaatccctctgagcaaacatagtctactcaaaacggagagatctctgatttctt

SEQ ID NO: 104908 - DNA, 177 bp, Triticum aestivum
  Clone ID: PAT_TA_104908
cgccgcgtcgacctgtcggccaccacgagcggcgggagcgagcgggacctggccacgccgaggagcgccgggagcggcgcgatggggccggaggtgtcgcacctcgggtggggccactggttcacgctccgggagctggaggaagccaccgacgggctcgccgaggagaatgtgatc

SEQ ID NO: 104909 - DNA, 372 bp, Triticum aestivum
  Clone ID: PAT_TA_104909
gcggccgcgtcgacgaacgaaacagtaaaacaaaccgcaacgaatcggcggcgggggtgcgccgaatgccggtggtgcccgcgccgcctctcccctccccgccgcgccccagccccaccgaatcgaagcggaatagaacaactccaccgcgcgcccacttgacaaatttcctatccgattctaatcggcgcggagctcgtgctcctgcccgcgcccgcccccgccgcgcgcgcaggtccaaacccaaccctagccccccaccacccccaccaccaccctaccagatccggagatcccgcgcggccacggacgcgaatcggcgcccacaatggcgggcctagtggcgccaccctgttccccccgatccggccc

SEQ ID NO: 104910 - DNA, 514 bp, Triticum aestivum
  Clone ID: PAT_TA_104910
tcgcggccgcgtcgacatcatttgggactttcaaagccctactctttggcaaaaattcaccagggttgcgtctattttctatgccaccaaagaagagttggcgaatctgggtatcactattaacattcatgtactttgcatcagggcaatatttagatgcccatttctgaaatttatctgcagctacttttcgctgtgcaacagcaactttttcaatctctgacaggtaagcacggtcaacaagcattccagctgtttccatttttacaagaatagcggcaaaaggacgccagtactcctcatagaaatcatacaatgaacctctggggcaaccatcaaaagtccagtgcttcttttcaagcttacttttcaagctttcataaagcctcaaggtactcattgaatctaaagaagaatagctgatccacagctctctatcctctctttgcaaaacctcaacggactctatggtagtaatttttccttcggaaccatctttttgtcgacgcggccg

SEQ ID NO: 104911 - DNA, 557 bp, Triticum aestivum
  Clone ID: PAT_TA_104911
tcgcggccgcgtcgacttttttttggttaacacaggctccacctccagcccacacaattaatatatccaaataacatacttacggttgcttgagcacactttcaagaacaaacaagaatgaagtagaagtgttcaactgaatactttgataaatatgcacaagcatgctgcatgcaatagcaccatgaagagaaaaaaaattgattcatgcttagttacatataccataggcatatatgaggccgtggaatcattttccatctgcaaagcatagtatacccttcttttagttgtttgctcaaaacatttgtgccaacaatattagctctcgaactccaacttaatctatcttctcacctagaaggacattaggcaatcagtactgcatatatataaacggtctgtagtatatttagacaaaggaaaaaaaataagaagcctgtagagggtctgtgttatatttagaccaaggaaaaaaaatcatagactgcactacattttgtactgagcaaaaaaacaaaaaataaagtaaaagatgctttttgaaccatatatgt

SEQ ID NO: 104912 - DNA, 482 bp, Triticum aestivum
  unsure (1)..(482): unsure at all n locations
  Clone ID: PAT_TA_104912
tcgcggccgcgtcgaccttcctctcttcctctcgtccccatctcaaaggcggcaagcaagaagcaagacgcagctgtgcagagacgccggagcgatgcacagccgcagcctgctgcgacatcccgccacaccgcctcttcgatacagcagtaggatgctccgacagcgagcggcgctggccgctgctgctagcccgcacgagctgctccatggggcaggttacgaactgacgaccactagtgacgtccctgtgttccaagttccaacagccccgaggccccgacgagcggcaacgtcgacggccgctgcatcgcagcttcggtgttgtggccgctgcatcgtagcttcgacggcggcatcgactccgacggccgcttcattgcaactccgacaaccgcagctccagcagcgtcgactccggcggccggtgcatcgtanctccggcggcgtcagctccgacggcgtcgactgcattgcaactc

SEQ ID NO: 104913 - DNA, 277 bp, Triticum aestivum
  unsure (1)..(277): unsure at all n locations
  Clone ID: PAT_TA_104913
gcggccgcgtcgacgaaagggagccgaataggcaggaggaactcatgcggggaggtgcatccagaagggaagagggacgagggttgaggggtgaggtcctggtccttcttcnatgcggcttancggggcgacaatgaacaatgacggcgccgtccggcactctcccacccgcatccgttgctccccgctgcttccgcccgcctgcgccaggctcgcctcgagccggccgccgccatggagcctaagcgacgggaggtagttctgggaggaggaaaaa

SEQ ID NO: 104914 - DNA, 315 bp, Triticum aestivum
  Clone ID: PAT_TA_104914
gcgccgcgtcgacacacattagagttgatagctgaaacacatttgtattccgattgtttgacaaatacatagttggggtggatgtgttgcccacagctccattcaggcatttactataattatctgttctcattcttttgtaggtttcaggaaaatatgacccctgagagggtgcagcttggtacgcatctacagatgccggtggcgttcctctgctggtcaagattcatacccaatggaatatgggcaccattggaagcattgtgttctctggtgtccagtgcatgcacatgtgatgagctgtgtgaaccatga

SEQ ID NO: 104915 - DNA, 295 bp, Triticum aestivum
  Clone ID: PAT_TA_104915
tcgcggccgcgtcgacagccaggtggacatccttcattcctgaccttgttgcagcagcaaagagcagtgaaaccatatgtgaaaactgcatggctatactgaagcttttaagcgaagaaatttttgatttttcaagaggtgaaatgacacaacagaagattaaagaactcaagtcctcactcaacagtgaatttcgactcatccatgagctgtgtttgtatgtcctatctgcaacacaaagttctgagctgatccgtgctacattggctacgcttcatgcttgtcgacgcggccg

SEQ ID NO: 104916 - DNA, 489 bp, Triticum aestivum
  Clone ID: PAT_TA_104916
tcgcggccgcgtcgaccacgatctaatcctgatctcccagcctagggttcaggtcagcaaagttccacgaactgcaccttgccatcatgctatgcgctcggctgaaaagacgccatgaccagctaccaaaattgggttctccacttccttaagtagtgcgccatctatagggttcatcttcccatcaaattccacctgatgcatgacgctccaaagagccatcaggaactccatagaaacaaggggaggtcaaggaatcgtgcgttaaggaattcatgcgtcaaggtagaggcagcaaggtgagatctgagggatttatgcatcaaggcagtggcgtcgaagatgccagccgagcaaaggaaggtcaatatcagattcttatgctggtcattggactgctcccttattttttattcataaattttattgtatgtaaaaactctgttagctctgcaccacttgccgaattgttgtacggcaaattgattt

SEQ ID NO: 104917 - DNA, 181 bp, Triticum aestivum
  Clone ID: PAT_TA_104917
tcgcggccgcgtcgaccctggcttagttactcccctcctgagggcatgctgagtttcctctttcttcccccctaccctcctttagtcccctggtaaaaagctaggcctttggccgggcggtggcggcgcacttgcgtcctggtcctccttgaaagcgccggcttggggtagagttggggtt

SEQ ID NO: 104918 - DNA, 487 bp, Triticum aestivum
  Clone ID: PAT_TA_104918
tcgcggccgcgtcgactgtacatcgagaacgtgtctgaacttgcatttgatgacgtcaccactgaagatcctgattttccatttatacaaggactggcagaagcagggttaatttctagcaagctttcaagatctgatatgaacatcgctgaaaacattcaggacaaccattactttttctccccggacagtcccttgtcacgtcaagaccttgtgagttggaagatggctttggataaaaggcaactacctgaagttgacaaaaattctttgtacaagacatccggctacatagacattgataaaattgatacagctgcatggcctgctttggtggctgacttgggtgctgaagaccagagcatcacggctcttgcattcggttttacaagacttttccagccagacaaacctgtgacaaaaggacaagctgccctggcactttcaactggtgactatgctgaagtggttatggaggagcttgctc

SEQ ID NO: 104919 - DNA, 358 bp, Triticum aestivum
  Clone ID: PAT_TA_104919
gcgcggccggttgggctgcttggggtgggagggctgcgggggaggaacgccggagaggagaatgtagaggataactccagcactccaaatgtcagcctcagctccgtatcgccgcttcagcacctccggagccacatagtatgcactcccaacaagatccctgaactggtcgccgggcttgaagaagacggagagcccgaaatcggtggccttgagcggggagtcctccctcttattcaaaaacaagaagttctcgggcttgaggtcgcggtgcatgacccccatggagtggcagctttgcacaacactgactacctcccggcagagcgtggcggcggcgcgctcggagtattggccg

SEQ ID NO: 104920 - DNA, 580 bp, Triticum aestivum
  unsure (1)..(580): unsure at all n locations
  Clone ID: PAT_TA_104920
tcgcggccgcgtcgacgtaattacatcatccttacatactgatgtactactagtagtctactaagttgtacttaagtgcatccacttttggaattcagagtaagaagtattagctgaaacaaaagagtactcatttcaagtagggagtcatgttcttgtgcctacatattacaaacttgatttcttactctagattctagtatcagaatacaatgatgaacaaggctttatatactaaagtgcatttcagacttctttgaagttttattcagaatgtcctaggtcaaggctctgggcaaatctgtagtttcagactgagcttttttatataaaaaggtatgaaaggcatagtatgaagacgagaagaatggggagaaaccttcatgtgacatacataacaaaatgttcagaactagtatcgcagcataataatatgtgagtacaagtgtgtagcacaacaacgcaattgtacaagtcatacctggacacaagttatctacattcctttgatacactactctgactagaatntagtaaataacactagactcctatcaagataacctattaagattagaag

SEQ ID NO: 104921 - DNA, 462 bp, Triticum aestivum
  Clone ID: PAT_TA_104921
tcgcggccgcgtcgacgaattccgaacctccggacggtcatctgcacccaatttttgaaggacggaaaaaactgaaaagaacagcttattgtaatcaaccagttgttgcaagggatttcgcttgacgccttcctcactggttggtatatctccctcttccgttgatacacccaactgaacctcttcattcaagtgattagctttctgaacagacctgccacttaaccccttcacaataaaatcggtcgcagtccacaaaagaccagctgctgtcaaacttatgtttatgtcagttttctgggcaccatacgccccagtaaccaaaatgcactcatcaagacattgtacaggtattgtcgccagtccttcattcatgatcacacgtacactctggaaacctaaggagatgacatctttttcagatgcatcggcaacagccctcagcattcgtcgacgcggccg

SEQ ID NO: 104922 - DNA, 657 bp, Triticum aestivum
  Clone ID: PAT_TA_104922
tcgcggccgcgtcgacggccagtcatgtatcttgccatcacttggatcataagtggttccatcaaccttaaagttcctaagtgtatcgggccacctcccaattgccacaagcctcaccgctgacatctggttggtggtcagagttcctgtcttatcagagcaaatcactgttgtgcaacctaatgtctcaacactgggtaactttctgacaagtgcattcttctgagccatcttcctggtgcctagtgccaagcatgtggtgataacagcaggcaggccctccggaattgcagcaacagccagtgccactgcaatctcaaagtaatatgtgcacttctcgaatgagaacttgaaattcgccggccacccatccacatactcccaggtaaggaaatacttgacgttaatgagccaaaccaagatacatatcactccaataatggcagtgagcgcctcaccgaactcattgagcttctttttgagcggtgtgtcatcctcctcctgtgatgcctcctggatctgcgaatggatcttgcctatttcagtggccatgccagttccagtcaccacacagacggcactgccgttgacaatggtggtgccagcaaagaccatgcactccttgccctggatatcagtgtcctcgagatgaatctt

SEQ ID NO: 104923 - DNA, 567 bp, Triticum aestivum
  Clone ID: PAT_TA_104923
tcgcggccgcgtcgacgagatgtttagctcaaccgttctattatgcaattgcagagagcaaaataagttaattttacgtgagcatcaaggagtataactggttcatgagatattccgaagtcgacatctgcagtacaatgctttgctgctttggtttcctcagtttgtatagcaagcagaggatgcatccctgagcgtcatagattctaactcgtccttgagatatcctgaagtcaacacatgcattcaattgctttgccactttgatttcctcggtttgcatagcaagcggatgatacactctcatccatgaaatatcctgaagtcaacagctgttgtacaatgctttcccatcactttgatttcctcagtttgcatagcaagaggaggatgcattccttgatgcctccaaacttctgcaacattaagaagacgtctttgcctctaggtcgaggtcggaggacgcgctaccatggttgctgaaacacgaactccgtccagatctcctcatcctactcgaagctgctggtgaatccacctttcttcattcttcacaaatttccagcg

SEQ ID NO: 104924 - DNA, 222 bp, Triticum aestivum
  Clone ID: PAT_TA_104924
gcggccgcgtcgacacgtgggcggcggcggcggcgaggacgggggcgcccgctccggcaaacaactgcagcgcgctgcccaccccgggtcaaatcgcacaggggaggcagatcccggcggctgggtgccgctcatctcgtaggccctcgctccaggtcaccgaggaggggatgtagccgagtctgtgtagttgagggtaaggagggctgaggtgggagggga

SEQ ID NO: 104925 - DNA, 222 bp, Triticum aestivum
  Clone ID: PAT_TA_104925
tcgcggccgcgtcgacttttttttgaacattttaattgaccatttcatacatatgcatttttatgtacaacaaaatcagctcctaaaaagaatggcattcatgaagagtgtcgacgccatctttatcattgatttgttctgttctccttcggtattgttgcagctacaactgaatatgaacgcgcgcactccattgttggagtgaggccgggtggggtgggc

SEQ ID NO: 104926 - DNA, 481 bp, Triticum aestivum
  Clone ID: PAT_TA_104926
tcgcggccgcgtcgattttttttttttttttttttttttagctactgtaaacaatgagttaactttgtgagttctgacagttgagcatggacgacatgctggctctttaaaagagttacaccctattcagtgaaccttttcttcctccatccatgttaacccattgcgattggttctggtagacataccattgctggaaacatctctatagtggcaaacgggatcagtcagcacactagcccagtgttctgtgccccactgccaatttaggtcggggttgtcaacctccagtgggtgacacagttgctgtagctaagctgtggtgtactatattagcaaatcctctagagaagatatcctctctcagctatgagcagttaaagctggtagaaactgcttgcttgtccacttattccacgatgctttgcggcattcagtaacctctgctgccacttacttaactcgtgcagccctcttgtca

SEQ ID NO: 104927 - DNA, 563 bp, Triticum aestivum
  unsure (1)..(563): unsure at all n locations
  Clone ID: PAT_TA_104927
cgcggccgcgtcgactttttttttttttttttttaatgaaatccttgtgaggaagctttgtttggtaggcctaaattaagtatgaacattcatgtgatgtcagaatatcagatgccaacatatcttctggctatactagaatcaggctactattgatgtttaccgtaagcccgtgacaagtgggttctttttccatttttctgagaattgtccagcttattcgtaagcattagtaagccgatttgcattgcaggctgcctgacatgcagatgaagggccagccgcccagagtaagacgcaaacgcccacccgcctccagctagctagcgtcggtcgccgccggcgccggcaatggcagcatccccatctgtgcgcttgatgacgaccgcaccaccgatggcgtcgatcgattgcctcgccgggacgggacagaatcgtggatgcgccgtcctcctcccttccttccttccttncttcctcttggcctccgggacgcacaagcgcatgcacgtacgccctggctaatgttgacaggttgatctcaccttgcacggaaacacaca

SEQ ID NO: 104928 - DNA, 416 bp, Triticum aestivum
  Clone ID: PAT_TA_104928
ccgtttttttttttttttttttttttttgggggctcacacacgtatctgcacctttccgctgccatacatcaattagtatttacaccgcccgtagttattgtcaccaagtgaccttgtgccattggtccagaatccaggagcaagcgagctcgtccgctccattgccactctcccaccaagacagtgaaacacgactgcttctaccacccaacttgacaaactaatccacagatcatttgccgcgtctatctccgccgtccgatctaacatcagcggccggaaacacgcatctctcgcggctaggcggggcagggctatgtgcaaaaattcgcccctactcgctctccaaaatgcgcccctactttttctgtcagtctcgtgtgccctgcacctctactcgctctccaaaatggcg

SEQ ID NO: 104929 - DNA, 615 bp, Triticum aestivum
  Clone ID: PAT_TA_104929
tcgcggccgcgtcgactctaaatggcgaacccacctatttggttactgctgatgatgttgataatctactagccattgaagtccaacccctagacgacagaaaaagaaagggtgacatcgtaaaggtttacgctaacgatcaagcaaaaatcacttgcgatcctcaaacaaaggaactcataaagaaaacccttgaagttgggcatgtgtcttatcaagtccaactgcctcaggtgagattcttagacatgtgggaaccagctgttttggcaataaagagggaaggttacagcattaaatgcaacgggcagcgtggagttgttctcacggagaaatttcagaaagcaactgctattaatattccatacggatacgagcgtcagacagagttttcgattgtatcagctgacggtgacgagtataatctccagccagcagacaataacatgtcgcgggatacgattgtgctagtgctaagactgttcagatccatggccgttgagaagcggcgggggagggaagaagggcctcttcttcaagtagaccgatccgatccgatccggcttaatgtatatccgtccgtgtttattcttcttggggtctacagtcgacata

SEQ ID NO: 104930 - DNA, 579 bp, Triticum aestivum
  Clone ID: PAT_TA_104930
gcggccgcgtcgaccgcggccgcgtcgacatcatggcagcagcagcgacggcggccaccaggcgcaatgtcggcggaggggcgccagcgtcgacgtcgagctccgcgccgccatggcgctggccgacatggcgggggccggggccggggcggccgccgaccacgcgctcccggcgcagcacctgcagcacgccgccgccccagcagctcaggcggcgatggagcacgaggacgaggagctggcgagcacgaggctcagccttgagctgggcaacgtcggcatccagtcctccccatgttccagcagctccagcggcgccgggcagcaaccgccgcagtcgtccgcggccgtgacgggatacggcctcagcagaccgcggcacatgctcaccgaggcagagaaggaggcgaagcggctgcggcgcgtgctcgcgaaccgggagtccgcccggcaaaccatccttcgccgccaggcgatccgggacgaactggcgagaaaagtcgcggatttagcgtcgcagaacgagaacatgaagaaggagaaggacatggtgctggaacagtacctcacgctcaagga

SEQ ID NO: 104931 - DNA, 635 bp, Triticum aestivum
  Clone ID: PAT_TA_104931
tcgcggccgcgtcgactcctcttgttcttccttagataactgccgctccatcaactttcgagtgtgtactgcatctctttccctcatgttcttctctagctgagccctttcctgctgatctcttaaaatttcttgttcttcgtccagagtgtcgtcgccgtcttcatcatccacctcttctgttctccttcggacactcctctcagaaacatgtgctattgtttcatcatcatccttcccatcatcttggtcttgagccttcctcctaaaatgcttcctgctcttggaggatgcgctcgccgagctcgccgtgtggttgtcaacctcgtcatcgtcctcatcggccaacaacttgtaagtgctttgcttcttcacaagctttgctgcctccctttcctgcttctggtaattactgacgcccctgcccttgcgggggaccttggcgtagatgtcggcggcgaagctgctcgtctcggcggacgaggagaagccgtactccacgagcttccccacgagatcgccggcggaggaggagtccttggctaggccgatgacgtagtgcacgaggacgctcgtcgagaagccctggatggacatgagcttgtccgagacccagtccctgagctgcttgtcgc

SEQ ID NO: 104932 - DNA, 439 bp, Triticum aestivum
  unsure (1)..(439): unsure at all n locations
  Clone ID: PAT_TA_104932
tcgcggccgcgtcgacctcgtatctttcgtagttctgtatgtacaggttaagtttggggttcaacgttccagttgctgctgagtgacccatggtttgaaactttgggttcaaactgtatgtagaaaatggtctggatggatttggncttgaaaatacatacagtttgggttggtttggattgtagtttttgcaatttggtctggtttggtttgatcgctggacctatacatgtatggtttggcctgggtttagtttggattacaaactattaccaggtttagttgcaggtttgaggacaactagctgcaggtcatgttccagaaccccccctttcaatcttctctccccatggactgaatatgtatgctttttcttgccctctccctcggttaatcctttttatctgctaatttgttcacaattcctttttcccttggt

SEQ ID NO: 104933 - DNA, 594 bp, Triticum aestivum
  Clone ID: PAT_TA_104933
cgcggccgcgtcgacgatgagcttgagctctcggatgatgatgatgattttattgatagtaggaggcaatcgaaacgacttaaggtcggaggaactaaaacttcccagcgaaaagcttcctatgcaggctccacgcaaacgaggtgtatctttcacagacgaagaatattcttcaggaaaagactcagatgcacccaacagtcctgattttagtcatcgaccgaaaaaacctgtcaggttgcatctgaaaactgtgggccataatgatgttttctcaaatgtcaattcccataatgaatcccgaacttcggggaggaggaggacacagagaaatatctcatatgctgaaagtgacagtgacgatagtgaggagaagtcaactaaacaacaaaagctcttgaaggaggatcaagatgaagaagatggagaaacaattgaaagggtcatttggtatcagccaaagggtgtcgctgaggatgcactgaggaatggtcaatcgactcaacctactgttatgagcatgccattagattttgatcaacaatgggatgatgtagagttctacataaaatggaaagggcagtcttacttaca

SEQ ID NO: 104934 - DNA, 463 bp, Triticum aestivum
  Clone ID: PAT_TA_104934
tcgcggccgcgtcgactttttttttttttttttttttttttctacaaaaccataggattttcattgacgaggtgccggggatccatccttggcttgacatttcgtcagaacaataatagcaaaaatacacattcagaacgtacccaatgctgcaacaggtagtaaaataaagagttttgcaggttcaaaaaaaaagaaaaagagttgccgctgcccccaggtaggctcatcttttcgaagctgtgggccccatattgaagtcatagtaggccttaaaccatttctaggatatttagttcgagtgaaccaccaccatgtcggcttaagcattgggcagatatcccctaaagccatttgtgaaactttgacgagttgactgaccccactggtaatgtgactgcatccgtcttgaatgactcttgaacatttgatagggtgatataaattttttgctccaacaatc

SEQ ID NO: 104935 - DNA, 324 bp, Triticum aestivum
  Clone ID: PAT_TA_104935
tcgcggccgcgtcgaccgaaaattgacgagggtgctgtacatgttgtgttttccaagtccctggataactacataaaatggtgcaactatttaccactacgccctgtctggaataacattgaatcattgaccaaagaaaagaagttgctatatgtttgtttatactacttgatctggggagaggctgccaacgtacgatttcttccagaaggcttatgctacatatttcatcatctagcaagagaactagaggtgattatgcagaaacagactgctgagccagctggaagctgcatttctaatgatggcaggtcgacgcggccg

SEQ ID NO: 104936 - DNA, 457 bp, Triticum aestivum
  Clone ID: PAT_TA_104936
tcgcggccgcgtcgactttttttttttttttatgaaacatactgtaaatattgcctcttgccttctcaaaataatacaacctcttgaataacacaagtacagactaccaacactaacggaaccttcttgagtttacctaccaggaagcatgtggctcaagaaataaattggcattgcctattagggttaggaaattcatccacactcagctgatgcctctctatccctctctctcgattgcattgcagatgatgtgtaggtttagaccatggaccccctttctctctctgtctctccactgatggaattgcatagaattctaaactgaattttcagaaacttggatgttgattggatctacttgaaaggcagattgctagtaccaagcatgcagcggatccataggattaaaacataggcaatctcaaaaaaattacatgtagccgccacagcgtga

SEQ ID NO: 104937 - DNA, 563 bp, Triticum aestivum
  Clone ID: PAT_TA_104937
cgaattcgcggccgcgtcgacaaaggagggcagaattggattaccaaggctaaagataaatttacatttcctgggggaggaacccagttcatacatggagcaaatcaatacctggatcagatatctcagatggtaccagatattgcatttggctctcgcactagagttgttctggatgttggctgtggagtagcaagttttggcgcatacttactttcacgtgacgtgttgacattgtccattgctcccaaagacgttcatgagaatcagatacagtttgctcttgagcgcggtgttcctgcaatggtggcagcatttgcaacacacagactattatatcccagtcaagcatttgagattatccactgttcccgctgcagaataaattggacacgtgacgatggaatcctgctcctggaggttaatagaatgcttagagctggtgggtattttgcttgggcagcacagcctgtttataagcatgaagaggcccagcaagaggcgtggaaagagatggaggacctcacaaccagactttgttgggagcttggtcgacgcggccg

SEQ ID NO: 104938 - DNA, 439 bp, Triticum aestivum
  Clone ID: PAT_TA_104938
tcgcggccgcgtcgactccccgcatcccacctccagccgccgtcaccggcccaatcatcgcacgaaagtcgcgccgcaccctgcccttatcctcgctcggggatgccgccgacgcaggacggcaggagcttccaatccgtccccgagatcggcgaggagattggtcggaccgcttcggcggcatccgctgctgcgcgtcccgctccaccggcgaccactgcgccgtcaagtcgaatgaccgatcgcgcctcgccgacctggactacggcctggccgggctcgagcccaagctggcctccgcgggaaacccagcgtcttccaggtgcacgcggttacgaggacgaggcatggacgcacatggtgatggtccgccttcgccacggcgcgcccatcccggagctggatgccgccgttgtggtcacgctgctcgccgaggccc

SEQ ID NO: 104939 - DNA, 327 bp, Triticum aestivum
  unsure (1)..(327): unsure at all n locations
  Clone ID: PAT_TA_104939
tcgcggccgcgtcgactttttttttttttttttttttttttcacggataaatccattcattttatcactggaagcaacgcgtggcatgcatcatgctacgtacaccggtgacgcgccggcgggtgcgcgccacgttttattacatctcctgacaaaggcggcgagtgggtacatggtagttaaaatacataggtgaccggcggcgccatggacgggccgggggtggtggaactcncccgccggacgtctgccctaacactccctctggcaggggcagcgcctgaatttgcagtagccggccgtccattttgcgccgtgctcgccgag

SEQ ID NO: 104940 - DNA, 443 bp, Triticum aestivum
  Clone ID: PAT_TA_104940
tcgcggccgcgtcgactttttttttttttttttttttttttcttaaccacaaccttcctcaaggataagcagcaacaacaaagataatttagctttgcacgatcctcggcactgattatgcaaatctgaataatctcacttgaatctaataaaaatgcatcaacttctatacaacttttttatgcaaatctgaataatctcacttgaatctaataaaaatgcatcatcttctatacagcttctaacggccgccagtaaaaactgataatcttctctacaacaatctaaagctcctttatcttctcttgtggggcaacatccttcttatcatgttcttgcgccttcccttccagctcttttaaccacccatcctgagttactcaaagcagttgacactgccaaattattcttttgaacttttggagtgatagtgggaggctgag

SEQ ID NO: 104941 - DNA, 603 bp, Triticum aestivum
  Clone ID: PAT_TA_104941
cgcggccgcgtcgacccgaaggccaacacaataggaccggaatcctatgatgttatcccatgctaatgtatccagagcgatggcttgctttgagcactctaatttcttcaaagtaacgatgccggaaacacgacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttatccgccgcctccccgctgcccacgagccagcgtcatccccagctccgtcccccacggccgcaccctccgagtccacgatgtcttctggaaatgggatcgatggagatgaaaagtctgaagagacgcatagcaaagatattagacgcatcaagtgtgatttttgcactgttgttaggtccaagatgtatctcattcgagctcacatggttgctc

SEQ ID NO: 104942 - DNA, 459 bp, Triticum aestivum
  unsure (1)..(459): unsure at all n locations
  Clone ID: PAT_TA_104942
tcgcggccgcgtcgacaagaaccacatgatactatgggactatagtaaatgagttgatgggtgtgaagaaaaaatgtcagcatcacatggactctacaatggcaaaagaaactgatggagatctattgtattatcggatggctcaaatgatgaatgcaccgacataagtgtgcaagaatgaaaggagaaatatgtacgttgggaacaagaaacatgttgaagcaaaagcaaaaaaacctacaatgcttgaagataaagactcagttgcccgttgtggcaaaataagatgtagtgttactgcagccgttaggagagcacaaaaaataaccaaagagctagatggccacaagaccggaattgttgatgtaaaatgctattccctttgtnaagaaatataagagcgtttagatcactagtcttatatttctttatggagggagtacaagacaagtgggcagt

SEQ ID NO: 104943 - DNA, 262 bp, Triticum aestivum
  unsure (1)..(262): unsure at all n locations
  Clone ID: PAT_TA_104943
cttgcacccgtgagcgctgacttgcctcgcgctggggttcgccgctgtgcgctgcacgccgcctgaggaactgcgccgcatccccatggagggctgcaacctcgcgccgctgcgccctgctgccggccgggagggcaaggccctgccgtcgtgctcgatgggtgccatgccttggatgctgcggggtggccgtggctaccancgtatatcgatgccgcgaatcgcgacgcggcgatccgtgtcgggtggatccgccgatgcc

SEQ ID NO: 104944 - DNA, 514 bp, Triticum aestivum
  Clone ID: PAT_TA_104944
tcgcggccgcgtcgaccagcgagcaagcaactgctcgatcgaagcttagctacgcccacgagacgcccgccactgcgccacacatcgctctgatccatggcctccgccgcgagatcctgcgccgttgcccacttcaccgccgacgaggcggccccgcctgagaccctccacgtcatgcgcctgcagcggctgcggctccgccgcgcggccgcgggctgcctggaccccatcgccgaggaggaggactccgacgccgacgacgcccaagtccccgccggctcgccgaggagaaggaccccaggaagcccccaggcgcttttttgaacgtcggcgggcaaaaaacaccccactcaaggccccaggaacctgttttgggccggatttgacaaaagttacggcaggcacgcccaccccaaacccagcccccggaggcagccggggacgccggcatttttttttcgcatgcatgggcccacttgccatcctctctctcatctctcctctcctttctctc

SEQ ID NO: 104945 - DNA, 559 bp, Triticum aestivum
  Clone ID: PAT_TA_104945
cgcggccgcgtcgacccccaagtacaaagcattaccaaactactccctctgtaaactaatataagtgtgtttagatcactaaagtagtaatctaaatgctcttatattagtttaaggagggagtacttgtttaagtacaaaaattacagagctacgaaattaagagccaattccacatagctgcagatttaagactttcggggtatgctacgcaggcctggattcaataaagaagtgcaacataaaactgcactttttaaaaacaaatagaatctagacatgtagatctacgaaacatgtctttacacgtggaatttcagcaacacaaattctccctaaatagtagctcgtagtggtaagtgaggtatagtatgtacattgagtctgtaattcaagtaatttactcaaaatatatgtgccgtacaaagttccatcagaatggcaagctttagctaacaaaaaaactaacactgagagaagcatagacctgacaatacactttaaactctagtaattgtgtgctagtcaacttcatgttccctattcaaactaacataaa

SEQ ID NO: 104946 - DNA, 372 bp, Triticum aestivum
  Clone ID: PAT_TA_104946
tcgcggccgcgtcgactcaggttcctacaattaaacattaacggatataattgccatccatcaggaggttcgctattaaaagttttttatctatgtgcaagagaaattacatatgcacaagcttacagtaaactgcaaaacatctctttgttacactaagaggacagacgacgacaagacagcaattatatctttcacaaaagagaggtatcatttaaagcagtgttgtatcacttgaatgactaggatatcaagaagccatcatctgaagaaaaagaaaaggcaccttaaaagttatacgacaccttagcagttagcatataatatgtcccaagctgagcgtcacttgtcagttttccgtcgacgcggccg

SEQ ID NO: 104947 - DNA, 629 bp, Triticum aestivum
  Clone ID: PAT_TA_104947
gcgtcgacgggaaactcacactaaagagcatggatatttcacagtcagagttctttccctttccacgtgcgactatatcatcgcagcaagatatcctgaatgctctatggtcacttccaaacgtcgatactgatgatatgaagttgctgcgtcgcattatgggccaaggttctcaagtgaagatggcatcattcaaagcagctgtgaggaggtacttgacagaatgcttgtttgagtgtgatgatggtaatttaccagatttggcagtacgtgccattggtttcttagctcaaatgtctcctaaatgtcaacaagctattctcacagatgagagaaaggaagtggaagtagatgctgtcttggatttaagcagttgcctcagatctttggtacgtggtgccactgaagaaaactcgagcgatgacgaagttagcttagagagtgacaggtgcagtgaagataatgattttgtactcaccacgagcaactactttgatattcgttctgagcagcacatggatgagggctgctgttcaaatttcatgatcaatagcattgaagattctgagtacactgctggtgctggacattatggagacagtggtgctgctggcagtacgatggatcct

SEQ ID NO: 104948 - DNA, 193 bp, Triticum aestivum
  unsure (1)..(193): unsure at all n locations
  Clone ID: PAT_TA_104948
gcggccgcgtcgactccgcgatcacggcgtcggcggcggccagcttggcggaggtcggggcggaggtggggaggcgcatcatggcgcataaggcgagggtctcgcggacggtgaggtgcgggtggaggatgtcntcctgggcgacaaaccccgtgcggcgctgcacggcgcggcacggggcactcccgccggt

SEQ ID NO: 104949 - DNA, 393 bp, Triticum aestivum
  Clone ID: PAT_TA_104949
tcgcggccgcgtcgactttttttttttttttttttacccttagatgtttgctgtggcatttcgtgcctgcatgttataatactgtgtttttcggatacttctttcgtgtctaagcatggcccgaattctaagtctccaaccaaacaggatgtaggagtccgtatatctgatagtatttcaaaagaaaaatgaaagaaaaagagagtgctattaggacaccactactgtaatttcagctttgtttggccaacgaacgtctcaggcgggcaaagcggcctcgccgcccgtccgcgccttgcagacgcagcactctgccgctccaccttgaccccccatggccgcggcgcgccggccgtcgaggtagtgctggtagacctatgagaggaaccccca

SEQ ID NO: 104950 - DNA, 99 bp, Triticum aestivum
  Clone ID: PAT_TA_104950
acaagaaattttccgaataacaaagattatttgaaggaaggacggcaggccttcctgctagtctcaggtaggctgcagctgctattgccggtgccttcc

SEQ ID NO: 104951 - DNA, 315 bp, Triticum aestivum
  Clone ID: PAT_TA_104951
tcgcggccgcgtcgacattcagtaaaatccatcgtaggaacgcatgaacacatagataaaaccaagtcctaaccccagactgcacgaagatctaacgattagcgagcgaatcccggttaccagttagccagtccgcatcagcaaccgacgactaaacaaccgattcacgaaagcgatcagatctagctagtccgaaagcgatgagatctagcttctagcaagtagaagcccgattccctcgaaacaagttgaaaggacgcgaaaaccggggggaaatacagagtggcggggggacgaaccggaaagcttgtcctg

SEQ ID NO: 104952 - DNA, 294 bp, Triticum aestivum
  Clone ID: PAT_TA_104952
acggaaaagacaccagcaaccacggtcaacatcaggcacgccactccctgcactagttgccgccaatgctgacgcagatgacgccgaggttgcctgaaccacgggctccttgccctcgaggcacaccgataaatgttctgcaccagatacattactctggtagacactaatccggagtccacagtcactcccaccagcagcggcggcagcagggaagaatgcggggctcatgatcttttgtgtgcggatcatctcccggaacaggctgaagttgaacaccttccaggtgaaacg

SEQ ID NO: 104953 - DNA, 536 bp, Triticum aestivum
  Clone ID: PAT_TA_104953
tcgcggccgcgtcgacctttttttgacgcaacgtacaatgtcgccgtcgagttcgccggaggaggaagtgccgagttcgccgaaggaacaagaccatctgtccaaccgcccaatttcgcctgcctcagctacaccagaggtaatgtatcgccttcatattcactggatggaatcccctgtttgtcccctgtctcttgtctctgattctgctctgtagcctgactgaaataagggacagtactttacttaatttataaagcatgagaaaactgatggaggatggttagtacagcagcaaagttttgtaagctcaaatttatagactgatttagtagtctctgtgagtgctacatgcaagtcagtttagagtttctgaggggaacggcctggtccatcttttcttgtgatgtgaattatgatgtaggacatagccacaagggttatttcttctgttggcaagtaatcttaagacttttttccccgggtgattcgtaagacagattaccctacacaattcacagttttagtatctctta

SEQ ID NO: 104954 - DNA, 335 bp, Triticum aestivum
  Clone ID: PAT_TA_104954
tcgcggccgcgtcgactcacccatacaaggaacgcgacgaagccttggcatggaagctgcacaatgcattactctcgtgccttggcatgaattctatcccggatggccagcaaccaaggaaaactggtggatcaagcatgaacccacaaccgatgacatcttcacgacgtaagtgacaccaggtcaggactacatccttattgctgaaaagactcacccctcgttccatgtggcacgctttctgcatttttgcagcgataagacaggtttctgcacaatgcatttccaacctggaaattgacacctccatacaaatttgttcgtcgacgcggccg

SEQ ID NO: 104955 - DNA, 321 bp, Triticum aestivum
  Clone ID: PAT_TA_104955
aaaatctaattattccgcattcatttgatctatttctatgtcatcgagttgctataaatgtgatccttggtgaaaccattcaagtatcatagactacacactagaacacggcaaataagtaaaagtttgttaatgccaaggtaggatgaggtattacaaatgtaattaggccaaccaagctccttaactacaaaagtgggattgggtagcatgggttttctgtgtgcaaccatggttcttggtgcaaacattgttccttatggtagagaattcagtgtgtgctttgtaacgctagatcactatgttgggataggttgaaga

SEQ ID NO: 104956 - DNA, 361 bp, Triticum aestivum
  Clone ID: PAT_TA_104956
cgcggccgcgtcgaccgccgcagttgcctcgggcgctcctccgacgaccccgcccctcctcgtaaccaccgtccgtaccgatccaaaccccgcagagcaccacggccgccacggcagcctctcccctcgacccggacagccatggcggccgcacttctcgccgccgcgccctcgcctctcccgccggcatcttggagacggaggcctctcctcgcggccccgccgcccgctctccgctgcctcagggctcctgcctccgctcctcccgcaatcccgccgcctccccggagagccctcgttcccgtcgccagagccgcgcgcggggcggcgccggcgctaggcggcggtgaggcgacgggga

SEQ ID NO: 104957 - DNA, 462 bp, Triticum aestivum
  Clone ID: PAT_TA_104957
tcgcggccgcgtcgacctccccgccccccgtacgaaaccctaggccgcggcgcgccgcgccgccccaaaaaccccgcggccgacggtggcgcccgcatggaccccgccgcgccggaccccgacggcggaggcctcccggcgcgcggatccgacgccgccgacgtcgccggcaacacatgggacctcgcccccttctcgccgccgcccgccgcgctccgcggcggcgagctctacatctaccgcaacgcctacaacctcgtcccccgctccatcggcgagtgccgcggggggctcagggcgctcaagttcttcggcaacgacgtcgaggtgctgcccccggaggccggggacctggacgggctacagagcctccagctcaaggtctccgcgcccagggtctccggggccgtgctccgccggatgcgggcgctcagggagctcgagctctccttggtgccgccc

SEQ ID NO: 104958 - DNA, 635 bp, Triticum aestivum
  Clone ID: PAT_TA_104958
tcgcggccgcgtcgaccgaggcagcaacaaagatcacggaagtgagattgctatcctgtggtctcttaaccagcgagacagcaatatctctctcatcctgcaccaacttggaggttcttgatctgtcgggttgcaggagcattgcagactctggcctgtcctccatctcacagctttccaagttaacactattggaccttgccggagctgacatcaccgatgcaggtctgtcagcactcggtaacgggagctgcccaatatcttccttgtgcttgaggagttgcagaaggattaccaacaacggcatagcctcattgctgtgtgggagtggcatcatcaacaaaaccttggtcgcgtttgacattgggaacgtaccaaggatatcgggtagagccgtcacattgatcgccaagaactgcgagcggataagcagcctgtgcctccgaaactgcgtcctcatcaccgatccatgcctcgagactctaggtttggaccggcatggctctggcaaaagcaccctgagaatgctcgatctctcctactgtaccaggctgtcccgcaacttcctgaggctgtttgatccgctggttgacccgccgctgttccgaggcctgcggtggctcggcgttgggaag

SEQ ID NO: 104959 - DNA, 502 bp, Triticum aestivum
  Clone ID: PAT_TA_104959
tcgcggccgcgtcgactgccatcgaagctgaatctggaatatgaaacaaatagctattttgaatcagctttgccagtgaaactgaatgtggaatcggaaacaaacagttatctcaaatcagcttcgccagtgaagctgaatctcgatttgggacattgtcagcgtaatttgctgaagcactttaaagtgtactttggtggcgaagctgattctgcaaatcagattggccactgaagcaaatccaaagatgattcgactgcaatcaaagtgaaacaaacatggccttatatcttgcgaaacaaatttgacactgaagcaaatctgtaggtgattcggattcaatcaaagctgaaacgaaccgggccgatgcaaggatgtaggcttcatgtgtgtcatttcaaagaaaagttaataagtatgttatttgtttttccttgatgtgaattttgctacttatttttgtccatgtaattctataggtcctggtttgtcgacgcggccg

SEQ ID NO: 104960 - DNA, 556 bp, Triticum aestivum
  Clone ID: PAT_TA_104960
tcgcggccgcgtcgacattttgctgtcgtttcttggaggcttgggtagttcggtgtttagggtcagtgattttagtggttcttgaggatccaagacgtacaacattgaaatcttgttccttgtgcgatttggttgtgtacgtcatagcaggtcatagatattagttagtttccttcctcagatgcatgtgaaaacggtgcagtctttgatagtcggaggctatgtatttgaacttggtcattgcccaatattgatttcattgcgcccaaatccaaacagcatcggaagtttgtatttggtgaacaaccagacaacatatagagttgaaaatagtgcttaacaggagtgtatatcttcaagaactatccccccttttgtattctctatagtctattctgcgttttatcatgagtaatcggttgatttggttagtgtttgcacaggacagtcggaagttaactattaatgtcactaaggctctcattctttgtgcggttttggattgttcaagtgactgcctatctattatatcatgtaatatgtggcgtactgatga

SEQ ID NO: 104961 - DNA, 447 bp, Triticum aestivum
  Clone ID: PAT_TA_104961
tcgcggccgcgtcgactaccaaacccacagtttcaaagcaaagcgcccaccaccttcagcgtctatccacacatcaaacccctagctatctataaccatgaagccatcccgtgcggcggcgcttgtgctggtgctggtagcggcgctcgtgctggcgctggcgccggtgacagaggaggcatcgccctgcgacccctatccgatgggagtttactgtgagcaaggggtcgatgctggtctttatggagaggatatgaagccgtgctgcgcatttatatccccaggctacattgactgcctgtgtgcgatcagtgagcggatcccgacgggccatgtcctctgccccgatatttcatgcccgtcgccgccgtgatcagtttcttcgttcccctgcagctatctaggtactggtagctagctagctcggtttgtagtgagtcttgctgg

SEQ ID NO: 104962 - DNA, 303 bp, Triticum aestivum
  Clone ID: PAT_TA_104962
ccgttttggtgactgtacggctggacgtgaactgtggagttaaaacatatccattcagctcttggtcaatcttatcagaattctgtacaagaagtcctagctgttcaagcagtgcaactgtacaagcaattctgatcagttctacccatgtagataatgttgtaaagtagcatctgtcaggtttagatattgtaaagtaacatctgtcaggtcttgatagtgtagagtagcatcttagagacataaattaggccatgcaaagtagtaatactgtattcatgtgcaaatttatctgtcggctcg

SEQ ID NO: 104963 - DNA, 404 bp, Triticum aestivum
  Clone ID: PAT_TA_104963
tcgcggccgcgtcgaccattctggaacttctctccgtcttcttacttccggaacagctctttctttggatcttcacgtggacttggtgtgaactctaattttctaagactaagaagacaaaggaatagcaactccaatggcatggctagtagtatcagtagtgtcagtagcacttctaatggaagtgagcatgcaattgctgctaaaggtggtgatcttttagcagatgctgactctgcagcatgccgtcagtctgatctgccattgaacaatgacattgctggtagcaaggtatccaagcgctctcgttctgaaataacagaagtttcttctcatgctggcaaagaagtaaacatgcaaggtacaaatggtcagggggggatgttcttggggctggggtgaag

SEQ ID NO: 104964 - DNA, 692 bp, Triticum aestivum
  Clone ID: PAT_TA_104964
tcgcggccgcgtcgacaagagtgagcatctcaagaattggagagtgttggagaatgcacaccaagtcaacagttgtaaaccactcactgagtaatagagtcttcagtttgtcgaatatggggcagcattttaaatcccatgtgtagataaacctttcagatccatgatcagcaatcaactccaaattcacagcattggacaaaccatggagaagcacaccttcgccaacgggataagcatgacagccacagtcatcaaactcacaatcctgccggttactacgacagaaatcatagcattcatcgcgaagcccaacataagctatttctagaaatggcatgtattcaagggaaggggtcaagccattaaaaccatcaagttgcaaagagataagacccggggcaaatatccgaacgtggaaatcctcagggaagtaacagaagtcggaaatgcacaaacgctttagtgatttggaagatatcctgcgtccatcaatgccgcaacgttgcatctttagatcctctaataccgggcagcgcgagaaattcagagcggagaatttcaggttaacctgttcgaggtgtaagagcttcaagtgctgggagatgagaggcgcatcaagtattattgggtcgtacacagtgtcatcatcttcaacagcaacactgagtaggagctccttaacttggcac

SEQ ID NO: 104965 - DNA, 586 bp, Triticum aestivum
  Clone ID: PAT_TA_104965
cgcggccgcgtcgacccgaggtggtggcgcacgcagccatcacacctccttccgcttcagttgcaccacccccctcttcacatacaccctgtcctagccggctgcacaagggaggcgaccgggcacctcgtagaggaagacgaggcgggcgaccaccagggcagccaacccatggtgatggatggcggagagggactatggtgacgccactcggcaaagaggtcgcgatgggaggggcgtttgtggtggtcggtcgcggacggcatggtcatggaacggcgactgggcagaggagcggcggcggcaccaggcggtggaagttcgcggggaggagacgaccgcgtcaagttggtgctcgccagcattctcaccgatgggttgccgtcccacccatcaccacgcaagagcggtccgctgcgcccgtgaagccaagactgagagtgtgcagcgccgtcctgggcacatcccggcgagcgccgccccagcaagctgcatcaccgccaagcatcccccgtgccctgagtgacgatgtttcacctgatgtttctccccacggcagcgcagaagggaaccaacgcgtcgtctg

SEQ ID NO: 104966 - DNA, 467 bp, Triticum aestivum
  Clone ID: PAT_TA_104966
cgaattcgcggccgcgtcgactttttttttttttttttttttttttgcacacagttaatatgctctctttctcatttgagatgtatgggattgatttacacacaacacatggatagatgactaaccacatggaaaacgaacagccaaaagtacaaaaaacccattctggatccatgagagggggtacccggcaatatgactgtagttataactaggaatgtgtatcctaccactagactaagtatatggttttccatcctaaaatgtgatcttttgcaggaacaatcttgtgtttaactgcaaccactaaactgtcgagatatcatcaaaaaagggtcagttcttagggaagagctggatgtcaaagccatccgggaagccgaggcccggcgtccggactatgttccctccttttactggcttccatctgtatttcgtaacaagattgtgaatgaatgttgccatca

SEQ ID NO: 104967 - DNA, 600 bp, Triticum aestivum
  Clone ID: PAT_TA_104967
cgaattcgcggccgcgtcgacaaatggtgcaaaacatggcactggcccttcttcagcgcctgatgcccaggaaggtccgatggacaatgattcccatggaaaagaaactgaagaccacaatcctgttcacaatttagatcctgatatggcttacgaggctcctgttcctccagaaagaagtcaccatcctcacctagatgaaaccatgaaacccgaagggcacacaagctatagctttgtctctgcaaatagggtttttgctgcgtactcagctgattgtaaagatgatagtcctatatttgtcagcactcctgaaaggatggatgaaaaaatacctgaaggcacatctttagcaaaggatggacggactgcccacaatgaagctgccaaacagaagaaaaagatgtgctttgcaccagatgatgattcttatgtggatcaactgacagaagatccagtttttactagcaggcttggtggcttgagacaatctggagaatacttaaataataatgctcccacaaatgaagcatcggggacttgctccttgcctcagaaggatttggttgaagatcctgaaaagttaggacaatcttctat

SEQ ID NO: 104968 - DNA, 531 bp, Triticum aestivum
  Clone ID: PAT_TA_104968
cgaattcgcggccgcgtcgacgggatggaatggctatgtgcttggtttgtaaatcttcatttggcgctgtcacgttcttttcaaaatattccctcgacaacaagcctggaaggtgatcttttatgtgctctcaggaaattaccatgcattccactttcagatggttcatttagttctgtagcagatggccctatatggttgcctcatgatattctcggttccacacctgactgcaaaggtagcatgaaggatttcccaattctgtatggtaaccttcgatttgttagtccattgcttttctctgtgtcctgtaaaaataaataccttatagaagaaatgagagctaacgatctgacggatattcttctgaaaatcggggtgcgaaagttgtctggacatgaaattatcaaaaatcacatcctcacatccttgccaaatggtacagatgctaagaaggttgataagatgatgatgatagagtatgtgagttttatcatgcttcatcttcagtctccatgtacaagctgtaat

SEQ ID NO: 104969 - DNA, 573 bp, Triticum aestivum
  Clone ID: PAT_TA_104969
cgaattcgcggccgcgtcgaccgccaatatagttcaacattatcataatatcccctaaaaatgcatttatgcctactgcctactatcaggatcaaagaatttgaaactaaggagaaagttagaggaattactgatttcttcatgggcagatgtgtgaactctgcatactctgtcaaaaaatcccaacctctatgctacaggccctaaccatgtcagtctcggtcctaaataactacagagaggaatgtagatgaagttggcagcgataagaaatctctactacagcctactagcactgctgacttgacttgtcccctaactgtctaaatccttatgcctagaatcaaatcaaaataaaccaatatcgcacctaacaaattactagagtatactgcagtaccttaagcaaagcatgggattcttcatccatagcagagttggtatcttccatgatctcaatatccagccaagctctacctgaatctctcatgtatgcttcatggagaccaattgggcatgcatgtacaggtataacaagcgtgctaacacatcaatgacttgagtgagcgagct

SEQ ID NO: 104970 - DNA, 488 bp, Triticum aestivum
  Clone ID: PAT_TA_104970
cgaattcgcggccgcgtcgaccacacagctacctgcccttggcttccaaaagcccttgaaatctgagccacagtagattcagttacaaatgactatttcaccctcctgcagaaagcacgctacattttattaatagtttatgaagcaactgtactcaatctgctgagctcaaaacattgggttattatctttttttccaattgtattaattatctaatccactaaatgccatatgaaacgtggatccattaaggttcatattttggtatagttgtacagtattaaaccaccttgtttctaacggtcaaatacagccaaaatgaaatgtacagttgtttggtgttcagatagaacatccaaacaagactatatactacaactgttggcacacacaaacgaaaggttctgtgttgatggcattcaggtacattaattgttgaatattaagtgcatatgtaaaaggcatactccttggttcactgccagct

SEQ ID NO: 104971 - DNA, 416 bp, Triticum aestivum
  Clone ID: PAT_TA_104971
cgaattcgcggccgcgtcgaccgcggccgcgtcgactgttcttcaattgctgctttatcagtgaagcaacgtacaaacacagctataccaactccacactcaaccgcaagccaagcaagactcacagccataaggcacaaaaaagtcatataatttctccttccaacacaattgttcagccaccgacaatgatgatcaaaaccatcaacacacttgtcacagctccgacaatgtttactattttttcgcacctctgtgttgcaaagggtgcaaaagagtgcctcctcggcataattttcttgttggtaagcttcatcttctttgcgacaatcctctttcttaaaaatagcacaacaaaaacaaccagttcctaaacatgatctatgctttctgatttcctcgttggcttccatctg

SEQ ID NO: 104972 - DNA, 385 bp, Triticum aestivum
  Clone ID: PAT_TA_104972
gcggccgcgtcgaccgcggccgcgtcgactggctttgctctattatagtgcatggattctcaaggccctgttaggtgatgatgccttgaagcttcagtgacaagaatggcttgacagtggcacaagttctattcagggaagctcctgcgtttctcttttttgaattacgcaaggagccaagttagctcgaatcagagcagaaagttaacaacaatgctgccagaagctatcagacaacaactattatactcagaagagtatcaacattttctattatcacagcagcatcagtatgacaagcagttcttgtgttttcagaaccttgggagtgggcttagctagttatgatgacaaatcaaaaaaaaaaaaaaagtcgacgcggccg

SEQ ID NO: 104973 - DNA, 605 bp, Triticum aestivum
  Clone ID: PAT_TA_104973
cgaattcgcggccgcgtcgacctccatacagcactcttcggaacaagcaacatgaaacttacccgtgcaattttcagccaagcatatgaaatcaggttatgtatacacaaaactaaataaaaccatataaacggtacaagttgcccagccagacgagttcaaatatacaatgctagagtaaattgttgacatgtactccctccggaaacaaaaatggatgtatctacaactaaaatatatctagatacattcatttcttcgacgagtaattccaaacaaagggagtaactcactgagctcgttggccaaaatgtaacagattcagaactagtccttgaattcaagatccatcggctcctaaaaatactctacaactaaaaatcaagaaacattgatcccacaatgcacatgataagcatcaccaatcaaaattaaattgatagtctactttgatattaatatatacgcagagtctaatttgccaccaaaatccgagatttcaggattcttcgtagtctactacagatcatactcgagaaacattcatcccacaatgacctggcacttgacattacaactagataaacacacggtaaaatacatac

SEQ ID NO: 104974 - DNA, 476 bp, Triticum aestivum
  Clone ID: PAT_TA_104974
ccgtttttttttttttttttttttttttggaacaaatgaaggaattttatattcataataatctcataacaagattacatcgcaatgtcgtgtaacctttcctaaatttataatattgcaccctctgtttcataatataaaaatgttttcgacagtaaacgctcttatattatgggggaccaaggaagcagtaaagaatatcagaaacaatgtatagacaacagcaagcagagtcgtcgctgcatctaaaacacgatggcgggggcgacagctccggcgactgcgacgaaactggcggcggatgaatacacggcggagctcgcgggggtgcccggtgggggcgcccatgggagcgccggagggtgtggcggaaaccgcggacggcgtcatcgaggagggagcgtccgtcggggcatcggtgggcggggccggtggaaaggccatcggggacggaaaccctgcggtgggcggggggg

SEQ ID NO: 104975 - DNA, 668 bp, Triticum aestivum
  Clone ID: PAT_TA_104975
cgcggccgcgtcgacttcttctccccccttcatttgcacaagagccaactgaaggaaatgtacatattcgcatcaagtcaatttgttacttaacataatgcctgtatgttccgtagttcagtgtcgattcatgttagatgaattcccagagctaaaccccatagtttcctctccaatttcaccaaccagtgtatcagtttcttcttctgcgacataactactagcaccatttcatcctaagccggtaagcccgtatgacagacagcaacgaacaattaatcaagtatcaacaacaaagctcatttcaggtgctcctcaatccaattcaacatctcatcattctgcaagcttgtcatctcatggtatccataagcaagattcagctcctcttggatgtgcttagcccactgggatagctcctcccagaaccccctcttcaccactgcattcttccatggagttgcccggccatccttcctcatgtaccccctctcatcaacgaatccttcctcactgaaaaccttccaaatcctttcagacaacccatgatccagccctggtatcctatcggacagcagcgtcggcgtcagaggaagctccaggctctgaagctccctcacctcaacgccattgctcctcagcatcttcacattccttcccaccagcgc

SEQ ID NO: 104976 - DNA, 426 bp, Triticum aestivum
  Clone ID: PAT_TA_104976
tcgcggccgcgtcgacaagctacatcaccattgttgtttctgttccgtccagcagtgctgctcctcatggtctttgcatgagctctgcggtgctgaaagcgcaagtggataaagaagttaaagatgaatcacacccttttgaggtgccatcatatagtgtgttgtttattttgtcaaaatcacaatcatagaaattcgttttcatcatgcaataaatatacggtccagccaacaactacgtggagaaagcacataatgatagaacgcaaatatgacagaaatactgcttatccatgaacctcgccatctaaacaacaattaaatctagtttaggaaatgtcaacagccagatatggcaaaaacacatagtacattcaacataaaggtggggaagaaactggaaagcagactaacacacatgacttg

SEQ ID NO: 104977 - DNA, 529 bp, Triticum aestivum
  Clone ID: PAT_TA_104977
gcggccgcgtcgactttttgtgacagacgacaaacatattatttgtcaaaatgatggtcattttgatcatgagaaatgatgacctcatgtaaatggaggtggagggagtactaaaaacagagtgagctgagccttcatccactgggttacagagtactaaaaacagttttcattgctcgttgataatcaaattaatattgcttgtatgcgcaagtttgtgctgatgtaataatatgtccagccaacagtcatctagctctggacatgtaatactcatattaaatcagaaactgctgatgacattgttgtccaaaagttattttctgcatcatagcgttctgctgtcagttgtagctgaagtctagtagccagcttttgcacctgtgtgttgctatttaagccttgggttacagtggttttaggcaccttaatatgatattaattttggttagactatttgtaaggttaaatttacatggatgtgtcatatactcatgataataatgcttcaacacttgtgtatggatgc

SEQ ID NO: 104978 - DNA, 435 bp, Triticum aestivum
  Clone ID: PAT_TA_104978
tcgcggccgcgtcgactcggctctgcgctaacgaccgctcatcagcaatcagtgtgtggtagctcggcagccttgtattccaaagtccaaactttgagctccggcctactactgattgcctaccaaggtcagccccctaaacagttcagtccagaaggtgatcatctttcgtgagcggtcgggtcaggcccagaccgcgagcagcgacatgaggccggccccgagcagcagcgagacgttgagcgcgagctgcagccgcgccctgctctgcaccctgggcttgctgaagtcctcggccaggatgtccaccagcgccatgtacaccaggatccccgccgcggccgcctccagcagcccctgcaccaccagcgccgtcgggctgctctcgtcgtccaccgaggatatcgcgatgcccacgccgatccccgccggcgt

SEQ ID NO: 104979 - DNA, 247 bp, Triticum aestivum
  Clone ID: PAT_TA_104979
tcgcggccgcgtcgacctacctgcttcggcatccgccagagcgccaacgccaagcccaccactcccaaaagcggagcagccctcctcccccctcctcctgctgctaatcttgggtccgtccgtccgtccgtccgtccgaggcaggagggcgcgggttcggaggcgcacgcgatcgatcgcgattggagtgccgatcgcgccgcgggagggtcgagggcgggcgcttggaggtgatggggcggctctt

SEQ ID NO: 104980 - DNA, 548 bp, Triticum aestivum
  Clone ID: PAT_TA_104980
tcgcggccgcgtcgacctcggcgccgccgccgctccaggtaagggtagcccacgccatagccgacgccatgtccgagtcgagtttgagctcgtgctcggcttgatccttccagtggccaccctcttctttctcgggggcgtcaagatcgtcgtcttcgtcttcatcatctcgcccaaggatcgccaagtccctcgacgtcttcttcctccgcttcgtcttcttcacggttcagaggaacgccaagatcagcgcatcctcacgtcgtctccggtcgccgtcgaccttgtacgactccagcagcaacccctcgttgcaggtacaggttgtgcgatgatcatgacgcgagagcgatgcttgcttgcgttgagttcttcttctgctccttcgatcgggggataggttccaggtcggcagcctgggctagcagggtggatgtcgtttgagtttctgtttgtgtttcatccgtagttgtgtgatgctctatgtattgtgatgttgtattcgtgtggcatttgatgccttatgtatgtatccccatctattatgt

SEQ ID NO: 104981 - DNA, 552 bp, Triticum aestivum
  Clone ID: PAT_TA_104981
cgaattcgcggccgcgtcgactgcaagctcggttgtctgtcacacagggcaaggataatgccctggagaacactaagatttaatgagtctgtatgcaacccttacaatgccgattttgatggagatgagatgaatttgcacgtcccacagacagaggaagctcgtactgaagcacttatgcttatgggggttcagaacaatttatgtacccctaagaatggggaaatactggttgcttccacgcaggactttttgacatcttcttttctgatcacgagaaaagactccttctatgataggtcttcctttactctcttatgttcatatcttggagatgcaatggaaaatattgatttgccaacaccagcattaattaagcctattgagctttggactggtaaacaactattcagtgtgttagtacgtcctaacgcatttacaaaggtctatctgaatcttggtgttagagagaaaatctgtacgaagaaatgcgctcttactgtcgaagataagacatctgaagcagtacatgatgcaatgtgtccgaatgat

SEQ ID NO: 104982 - DNA, 443 bp, Triticum aestivum
  unsure (1)..(443): unsure at all n locations
  Clone ID: PAT_TA_104982
tcgcggccgcgtcgacggcaatttcaagcactctttgactctcttttcaaagtccttttcatctttccctcgcattcaaacttcttatttttctttgaatatctgctatccatgttcttgaaagattccattgatgacaatctagacaattggacatttgatcttgtctccaaatcatcattgatagaatcattgaagccttgtaagatagctccgcgctttgctgaagaatacctatctgtctcaggtcccttattaagtttaccgtagcagctatcacagacacggtaaggcttgtttgggtttggtgctaatgaanccttcanagatttcttactgctgcaggaatgacaaaatacaagagcacagttgtagcaattatgccgttttctcctcaagttaaacggcaagcgacatccagaacacatggactgatcaactcc

SEQ ID NO: 104983 - DNA, 548 bp, Triticum aestivum
  Clone ID: PAT_TA_104983
tcgcggccgcgtcgactttttttctgccaaacatctcactctagcataaccaattaaattcaccatccattgttgccatacaaacaaaacaggatttgagtttcacaaaaccaacttaaaataagtagccagtaacatggtttgctccaagctgctgctacagcccgtgactgaattagtacattaaaagcataaggtgacagaattcaaagtttggtggtttttttttgtttagtctaagaacacaaaaaacagagcttgagattctgcgtgagcttcagatctctctgcagtcggcatgcagggcaagatcacttcagttccattgcctcccagaataatttctcggtctcttcgctttctgggtccaactctaaagcgcgcgagagtgcggaatacgcagcagcatacttcttcatgaacattagagctgatccttgtcgatagtgcgcctttgcccactttggacgcagccttttgcatttagttgcatcatcaaaagccctttgtccatcacccatgcgaagccagcaaaggcttctgtttga

SEQ ID NO: 104984 - DNA, 554 bp, Triticum aestivum
  Clone ID: PAT_TA_104984
cgcggccgcgtcgacgttgtgtgccacgtgcttgattaagcaccctgggttctcctactgtgcgcccttggccttgacttttggtagcgcctgttctcggctcgtctcgtgcataatccaggtacgcgtcgaccgtctgagctcctgctcaccattggtggtgcttgagcgtgcggttatggtgtcacacataaagggaacacaggatgtgggattgagacagtgcttgtagcaacccgcagaaaggcaaaggatgcccatcaagactggtagggagcgaaggtggtcacaaaggtggacgttgctagtgacgatcctggtgccagtgatgatcgacatgtagaagtgttcgaccacgagccttcaacaaggcaatgtacttagaatcgttgccagtgatgatcgacatgtagaagaagtgttcgaccacgagttgaatggtggaccgaaagtgtaggataatgagcactcgccaaaaactggccgcaatcaccaccgagacgaagcgctcaaagcaggcatgaggggtttgattagagccatataaacagcga

SEQ ID NO: 104985 - DNA, 667 bp, Triticum aestivum
  Clone ID: PAT_TA_104985
tgcggccgcgtcgactcagattttatctgtgatctgtagcttgatatgctaaaagtaacatcagcagttacagcagaaggcttaacctctccaatgtttggttgcttcacttgtgtgatcctaaattctttgattggaacagccatcctggaccatccacgaaaggaagtgtccccctcattgttgatgtaagcatgtagatgaggaacagcttcctgaatatcttcacgaatttcatatgttgattcaagacgaaagagattaaaattcctcagcaaataatcatgaagtgtcagaaattggagattgagttttgggagggcaagacagccttctccagaataattgatgctaggaacaaggctctcatcccacatgatctgttcatttggataaagaggaagtgcattaactgcatctttctgggattgacgcttctcaaaaaaagcaactaggacctcgataaggaaatcacgccttccagtccatggatccttctctgaaattattttaagcttattgcaaaccagatcttgcagttccatatctgacaagacaagcagcttctttgttaaatcagcacacttatggattgaaccaatattacacaaggcaaggtctcgcaacttaggcacttgtttgaatgctagcagctgaaaagcttgga

SEQ ID NO: 104986 - DNA, 674 bp, Triticum aestivum
  unsure (1)..(674): unsure at all n locations
  Clone ID: PAT_TA_104986
tcgcggccgcgtcgacgaagcatatggcaagtgctagttaactcatgctttaaaagaagaaaccaaatgtgcaaatagaaacaaaacggtcctcgcttatcatacatatatacatcttgacagaaaactgatgaactaactgattagccgaaaaatcgtccagcttgcatgaatcgtcaccaaagcaagaccaaagtagtaagaaacggagagggcatagattagattaaattaaatcaaatcaaatttcattcaacaaacgaacagtgggtgatggacgcgttctagctacagcttgatctattcgacagctgcttgtcacaaaccaggaagcaaggaactaataatcttgttggaatgtcacaatcacacccatatacagcccttttcccatgcacctcgcaaacaaaatctgtgaaaagaggagcattaacttttgcatctagcttgtcacgttctaggaaacaatggatggatggatgnggaaggccatccatgcatgcaccattgctttgaccaaattaaaataccaaaccaaacaaaacttgtaatgaacatgaacacatcccacacatatacacgccatggacgccctaactagcaaaccggaggaagattaattaacgaagcaaatcgaacaaagagcagacttgctggactaaacatgcatgcgt

SEQ ID NO: 104987 - DNA, 552 bp, Triticum aestivum
  Clone ID: PAT_TA_104987
cgaattcgcggccgcgtcgacgccacaacagtttaggttcacagagtttctaatttctagctacacatatttcataagtatccacatcactatggtatgcagcaaactgaatacaatttgatatggtgctatcaacatgttccttgcaataagttctgcttctgctaatatactgcagcaaacaatgttctatatttaacaaaattgcctagatgatgatatgatctttgacagtgattgatgatacatcaaggattacgaagttctgcttttcctaatatactgcaggaaacaatgttgtatatttaatttttttgctgagatgacgatatctttgacagtgattgatgatacatcaaggatgacgaagttctgcttctcctaatatactgctgcaaacaatgttgtatatttaacaaaattgcctagatgatgatatgatctttgacagtgattgatgaggattacgatggtctatatagattatccaatcagtacatgtggtccactactctggttgatacacaacctcaaccagtgctgcctatttct

SEQ ID NO: 104988 - DNA, 566 bp, Triticum aestivum
  Clone ID: PAT_TA_104988
tcgcggccgcgtcgacaacgagctgggttcaacgagtaaagtactagtagtgcagtactaggctaccgtttcctttttacttatcattttttttactctctagactagatggcatacgtgcatgctactctgatttggatggtttgatgcattttatctctcaatgaaacacttggacgtatcacaacctagttaattaattatggcttgcccaacatggccctgttgctggatctttagattttaaattaggaaatataaacatggttgtgaaataattatcaggagccgatctcggatccgtaggagccacgcccggtggttccgagttggtcgaagcactatccggcaagtcgtcatctccttgaccatgtcttgataaatgttttccgggctatgggtcatttccaaaattttgcataagattttaaaataaatatttttcataaataaaatgaaatttggatcaggtggatccactgatttggcaattggaccagatcaggtgaagcatctgtattaagtagttgtgacccgggtagggttacaatataaataaatatttg

SEQ ID NO: 104989 - DNA, 626 bp, Triticum aestivum
  Clone ID: PAT_TA_104989
gcggccgcgtcgacccacggaggagtattataacaaactgcatgagacaacaaagtgagcttcaaagcgacatctaaagtgctgcaccattgtcgtcggtgagcagaaacaaaataatttgacgagtactgcaccactttttcctagtgcattgcattataaaactaacaacgattttgcgagtactgcaccactttttatgagtgcactgcatgactaagtataaaattaacgaccagatagcgtcatgcaatttttctgaaaatggaaaaacaatcaacttcacaacagccaccggcaacccacgcgccgtgtgctgcatacacacacgcgctgtactgcatggacgtgccagcggactgcacggagggaggctcgctgtccaaactgtatgatcagggaaacagaaaaaaaatgcaacgctgcatcaaaccgcactctaccactttcttcctgcaagaacaagtattgaacctcatgagcaaacatgtttctcgtcaggggacatgagcgggagatgcataaggaaggagaagatgcaattcacaacatagtatctcgcaaacgaaccacgtgccgagctcatccctggtgcatcaatggtcgagggatccggcgcctggcgt

SEQ ID NO: 104990 - DNA, 584 bp, Triticum aestivum
  Clone ID: PAT_TA_104990
tcgcggccgcgtcgactttttttgagaaatggtgtaacgttcagctttggctaggtaaaatgtgtaaggaaaggtgatgtagccagtcaagtaagatatcatgtgataatttaaaatatcatattgtgaaaaacaattagatttaagatcccgtgaacaaataaatattagaatattcgtttgattcccagaggaagaaaacgtaggaatggtaacgatggaaaatatttatcacaaatccagagtagttaattcaagaacaatctattttgcatcagatacatactattctttgtctcttgcagaaaaaaaaatcaaaacaacaaattatctaccaaattcaaataaacctaacttacttcgcttcatcaccgaataacctagtttccagtcacgctttctctgattcatacatggaagatggagaacaaaagttaaaacaattcattgtgcaaacttatatgggcgcaaccatgcaattgcagtcagataaaacaatgtgaagttactgcatagcttttcctcatgggaggtgaagactaaatattaaaacaactgatactgctagcttatatggacggaac

SEQ ID NO: 104991 - DNA, 356 bp, Triticum aestivum
  Clone ID: PAT_TA_104991
tcgcggccgcgtcgaccacaaattttgtccggaagaagcgtagcggaccatatatctgtgcacgatctgcaaaccgggtctctgacgatgacatggccacaaacatgagcagaaggaaaggggtgcctcaacgatcacctttgtgctaataaaaataaaacactaaatagtctctttttttacttctttgatgctctttatctcttggactaagctggtgcactactgacagaattttgtcttgatggaaccatgtaatttcaatgtacatcaccagaggcaattgtacccaaattcttcaggtagatgcaccagttcatatatatgtacgccttaaaaaaaagtcgacgcggccg

SEQ ID NO: 104992 - DNA, 654 bp, Triticum aestivum
  Clone ID: PAT_TA_104992
tcgcggccgcgtcgacctcatcaactttgaatcgcaacgcactcaggttatgtagttccctcgtccagttagggaccctggaaaaccagcaatcccatctcaaatcgcctgcggcaagtctttggaggctcctgggaggagacaagctatccatgcatcctccggtatatatgtgtaggtcctcaaggctaccaagttttctcaaaagcagttctcctggagaccatccacccgaagttcatctctctaccactcgctttgttcagtacttttaaatactcttatcatgttcttttcagcggttagagcccacaactaagatatgtttgcttcacactaatgtttgtaatccgcctatatgggtccttattttatcatgtccacgtttataattctctggtgcagcaaagctgaccgatattagatgttaacctttttttgagccaaagcttccagtattgtactaattatatgtgctctttggtgcagcgctcactgaacatattgatatgtaagtcaatttaacaaataactctttgctttttcgtggtggcgcaaatacatcaaatttatcatcacttagaaccgaacattggattctttttgcctgcatgtcaacactaccgcaaatgacgatgatactgcatagttatc

SEQ ID NO: 104993 - DNA, 501 bp, Triticum aestivum
  Clone ID: PAT_TA_104993
tcgcggccgcgtcgacttttttttttttttttttttttacaaaaaaagatgattatgtacagaagtaagacggtttaatctacaaagtgagatggccgtatggcataacaagaatatactgtcaaccaaatcgcaactacagcactgcatcagaacgagtagggaattcaaggccttgaattgtagcaatgttttgcagatcctcgggacagtacataggaagaaaccagagcaacttgttggtgccaaatacctgctccaagttttttctccatcctaggtcatactcccatgagcatgttttctttcgctcgtatacctcgatagaagtcgtattactggcagcaagagacgtgtgcatgcatatgaagcaaaggaggctcagcgcaaacgccaaatttagaacgaaagcaagaaatagaatggcaatatcaccagctgagctggggcgcctacttccatcatgaaagaagataataaagcttggaagtagcaccaatg

SEQ ID NO: 104994 - DNA, 341 bp, Triticum aestivum
  Clone ID: PAT_TA_104994
gcggccgcgtcgaccgggggacctgcatgtccatttggatggatgcattgtcggttctattgcttctgctaagattgaggaagtagttaactatcttcgaagattaaagctactggcacacccagcgactccggaggatttagaagtgggctatgttcccttaagtcttggtggggcttatcctgggctctatctttttacgggggctgcaagatttgttcgaccagtgaaaaatctggttagcctacctgatggagagacacgtattgagcttattggaccatttgaacaggcatttatggagatacgatgtcctgatggtggggacggtgggagaaaaa

SEQ ID NO: 104995 - DNA, 515 bp, Triticum aestivum
  Clone ID: PAT_TA_104995
tcgcggccgcgtcgaccgcggccgcgtcgacgaaaaggcggtgatagaagtgtgcatggatttgctccatccaacaatgatagttgttgacctaggctgctcttcaggtgaaaacacactcatctttgtctccaacgtgatcgaagcaatatgctgcaaccatgacaagcttcatggcaacctcatggagctccaagtcttcctcaatgatctacccggaaacgacttcaaccgtgtgttccagtcacttgagcagttcaaggagtcaattacaataactcataagctagaagcgctaccacctttttatattgccgggctaccgggctccttctacaccaagctttttcctcgtcatagcgttcatctgtttcactcatcatattgccttcattggcgatctgagctcccggatggatttgcggccaagagagaaatgtatctaaacaaagaaaacatttatattgcgaggactacaccaccatctgtagttaaattataccaggagcattttg

SEQ ID NO: 104996 - DNA, 368 bp, Triticum aestivum
  Clone ID: PAT_TA_104996
ctccacatgctgacaccgcgtgtgcatgagccatgcatgcatgtacggcggctgggctagctgttgccatcctaccacgaaccgccgccgccgccgccgccaccgccggcgtcattgctgctgccattcccgatcatgctgttattccagaaccccagggtctcatggccaccgccgccgccgcctgggtctttgctgtgctcaaactgatcaccgccacttgcacctcctccacttgggttcgcacccggcttcaagtcctcgaacgggaacagcatccttcccgttgcgctctcctgcgccccctgcaacccagcgccgtatcccccggcgtcgccacctcctcccgtgtccagcgagaaccccat

SEQ ID NO: 104997 - DNA, 224 bp, Triticum aestivum
  Clone ID: PAT_TA_104997
tcgcgccgcgtcgactttttttttttttttttttttttttttttagccaaatcaattataaattgtatttgtaaatctttacacaaagtttaaatgtcaaggacaaaactgaagggctgcaatatttaaatttttacagtaatccgggaaaaaatatgtacatcagttaattcacaatacatggaaaataatcggggtttatctttggtataaaacaaatagta

SEQ ID NO: 104998 - DNA, 122 bp, Triticum aestivum
  unsure (1)..(122): unsure at all n locations
  Clone ID: PAT_TA_104998
cagtttctttttgagaaaataaagcttcaggacggccataggcccccgcaggcgagcagcaccccngaaagttgttacttttgaggaagatacccttgaaggaacagcgttcttgtggacca

SEQ ID NO: 104999 - DNA, 124 bp, Triticum aestivum
  Clone ID: PAT_TA_104999
tcgtcgccgtcatggattcagccgccgcctatactgctccatcccaccgcaacgtcgtcgctggccctagccacgacttcgtcgacgcagcgaccggatcggcggatccagcccgtatggtgcg

SEQ ID NO: 105000 - DNA, 685 bp, Triticum aestivum
  Clone ID: PAT_TA_105000
tcgcggccgcgtcgacattcctataactctgcgtgaagcagaggtactgaaagcaaatgcaaaattctctggttgatcgaattccacaaccaaaagttccaaaatcttcgtaatttagagtttcagactcgctgacgaaggaagatgacagaagcaacccacctgatcccgagctgcaagttcagcatgagctcgtagtgcttgtgtcccttgacgatggtctccctgttgcttcgccagcgacggggacacccacttgacttggcaatgcgcggcgccttggggacggcggaggcagaagcgccacgctctccccgccgtcctccgtcctcacactcctccgcgcgtcgtccaacagagcggccccgtccacaatgtcgcaggtgatgtcgccgtccgactcccagatgcaaatcttgtcgtacttcgggtcaccgacggagcaattgctcatcccggacactgagctcgctctcccattggccgtccggttacccgaactgttgagcggcctctgcagcggcgtggactcggtggcgccgacgtgaaccccggcagttccctcgcgagccatcgcgggggtcgcgcgctgtcggggacgccgccgccggagacgggtggtactggtagacgcccttctgctggacaatgccgctcaggccgtctcacgtccagaagccgacgt

SEQ ID NO: 105001 - DNA, 127 bp, Triticum aestivum
  Clone ID: PAT_TA_105001
ccggccgcgtcgacccccattatctgcactcttaccatgctcctgtttattgccaatatcaccttccttttcagcaattcctctactattcccttgctcatgaacctctccatcattgttattactt

SEQ ID NO: 105002 - DNA, 180 bp, Triticum aestivum
  Clone ID: PAT_TA_105002
tcgcggccgcgtcgactggcattgtgactgctgcattatttgtcggttaacagatgctgttattgatagctagcttggttatgtacaagttgtgctgctgcagctcatgcccctggcaaccaaggatcttgctgcgtgaagagcttttccctgttcgtgttgttgcagcacttggtcgac

SEQ ID NO: 105003 - DNA, 554 bp, Triticum aestivum
  Clone ID: PAT_TA_105003
tcgcggccgcgtcgacgttctctgcttggttctacggctgatgcgcaacaagaatatacatatacaatgggtcatattcgtcgtacagaggattcctcttatgatattgcctgcttttgtttgcgtggttgcaatcttgcaagaacctattccccgagaatatcaggctattccaccagcacttgtttattctcttgtgtataataataacctggatgctcttagtttcagcatatatttcccggtccgatgcaagttatagagcgcaaacacatttgctagatttgtccagtgtctcctgacatctttacctgagggcattggccttgaaagattatgttctcagacttgtttgttctcatttttagggccatagcttctcctgtccatcacatctgtcaactgttcggcgcaatgaagccttcagatgacaggatgcagctctcaggtttgacgcagtcggaagagtcgtcgcttgacgtggaggggcattgctctcaccatgaggcatttccttgttctccatcgatgcaaccggttgcttctgggtgtgt

SEQ ID NO: 105004 - DNA, 564 bp, Triticum aestivum
  Clone ID: PAT_TA_105004
cgcgtcgactgggaaatgcaacagaaacagaacctgaaatattagttaattggatagcatggtcccgacggaaatgcaaatgaaacagaacctggaataataattaaaattggatagcatgattccgatggaaatgcaagaaacagaaccaataataagatagataagatgtgactgacactggagtagggagcacacgacggccgtcgttcgcgcggccgacaccgacactggtgtagacagtaggccactgaagatcatgttggcgatgtagtatttccatgagcatgcatcaaatatcaaatctctttaccagtctcttccgctgtccacatggctcccctttttatgtaccaccacctcaacttggtaggacttgagatttactttggtgtctaccccgtgcaggagatgactttgtcgtacctgacgtgcggaaatgcgatggtgtctaccttgaagcttgaagagttcatgaggaagtcttgctagcatctagagttggatgccctcatgaagactactgtcagtcaattttcatgactgttcacaccgttgatgttg

SEQ ID NO: 105005 - DNA, 201 bp, Triticum aestivum
  Clone ID: PAT_TA_105005
tcgcggccgcgtcgaccgacccggacaagaaattccggttagcttggtttacgaccaagtaaagacagccgccaaattttcccaacatgactataaactagacagccttatagatggtatagataaagagtaggcgtttgattccatgtaacaatgcactttatcaccaatcttatctccgaccgaacttggaaacattgg

SEQ ID NO: 105006 - DNA, 452 bp, Triticum aestivum
  Clone ID: PAT_TA_105006
gcggccgcgtcgacccggtacaggaagaagcggagggaggcgatgggcctcgaggaccctcccaagaagaggcagccggcggccgccgccgcgcccgcggcgtgctcggaggccggcggcgagagtgcggatccggagcagcagcagccgcagcaggccaagaagacgacgacaacgaccaagagggggcgcgaggtggagctccgcgtggtggggttcggcaaggaggtggtgctgaagcagcggcggcggatgcggcgcaggcagcggctgggcgaggaggagaaggcggccatcctcctcatggcccagcaatcaagcaagcatgcaggcagagatgttgcggcgtctctgcctgctcccccttgttctttcctgctagtttttccggctgattacttgttgaataacgaatgaatggtcgacgcggccgcgaatccagatctatgaat

SEQ ID NO: 105007 - DNA, 326 bp, Triticum aestivum
  Clone ID: PAT_TA_105007
gcggccacgtcgaccaagccaaagtggagcggactccccccaaactcctcctcgcaggccggagagaggagttttacagagagagaaggggagagagatcgcggcgggcgggcgggcaggcagcccgtgtgtgcgtgcgtgcggtcgcgtaatcgctgtcgcattcgctcctccagaccttctcctcctctccccagcggcagcggcgcctccagagaaacccgagcaccaaatcctaaccaccgcctaatccccgcccaccaccgccccccacgcgtcgcggcgcttccaccgcacgccagatcggcggcgcgcaccgctgcggc

SEQ ID NO: 105008 - DNA, 599 bp, Triticum aestivum
  Clone ID: PAT_TA_105008
cgaattcgcggccgcgtcgacatggataagccaataatatagcttatctttgaccgatctctcaagattcttgtcctgtgcagcagaaagttctttttcatccgatggtgctgacaggtttgtaaatttatcatcaagcatcagggaaccaatagtgctgattaactcggacttctcatttccatcactcataacatacttctcatagtcatctggtcccagggaaagcaacttctcaagacgaatatgtaaatgcatttcattgataccagtatatggggatctgctgcctccatatactgggtctcggaatcacgaaactcgaattctcttacttcactacaagctaccctattagagcatgtcacataaaatggaactcgtccagattgatgtactggtgtatagcagcgcagggagccatctgctaaaacctcaaccggtacttcaacatccccgaacatacatgaccacttacaattttcgacatgttctttatttgtcaagaatgtaccagtaattaagaccttattttgagagccattgtacgcccagcttggggaaacatcaataatgctaaagagctgatcttgggaaag

SEQ ID NO: 105009 - DNA, 218 bp, Triticum aestivum
  Clone ID: PAT_TA_105009
atggcttcccaggggccaagtgcactaaaccaacgactgatcacctgatcgacgccgcccagcctgagctttagtagctgcagcagcctgcagtgtgtttaataagcaataaaataaaatgggaacttgggcaatgatgaataagacaagccgtcgtgcgtgtgtactccgtgacggggaaaaaaaaaaaaaaaaaaaaaaaaaaaaaaaaaaaaaaa

SEQ ID NO: 105010 - DNA, 319 bp, Triticum aestivum
  Clone ID: PAT_TA_105010
gccgcgtcgacatcatccaagtgcaagcagagaagttcatcattgatcacctttatcctctcatcatgctaaatccatgccgcaagaggccatttgtttattttacctagggcactggaaaatgttggaattgctgacttggctacaaggatttagcacaatgagaggataaagtgaagtcagtggtgatgagatgtgcgtgggacaatgttggaatctctggctcggctacatggatttagcgtgatgagaggataaaggtgatcaatgatgaaggtttcagtgaaggaatcatccaagtgcaagcagagaagttcac

SEQ ID NO: 105011 - DNA, 619 bp, Triticum aestivum
  Clone ID: PAT_TA_105011
tcgcggccgcgtcgaccttccatgtggcaagtgtatcatctgatactgtgccattttggcagtcatcaggatcattgattgaataatcatccttctttgaccatgaagacttaacatctgattcggtattttttccagaatgcagtggcggtggaaaagaaaatccaccatcaccataagctgctcctggtggcatattgcccttttggatatcataatttatttggtcctgtttggctccattcgcattaacctttttcttttccgtttcttgctgagagtgtctctttccactaacactcagattactttcattgaagtattctatgtccccttcactgcttcctccaatcagactttcacgcacctcactgccaatgtcagcagcatcactacttataccaacaccaattgacctgactgaaccgtgctgatcatcctcaacaaaagggtcatcaggatgaggtcgtgcagaatcattaaggaatttcccatttcctaacatgcctagttcactattctgtgacacaaaaccctgccatactggttcagaatgcatcaaatttagttcttctgaatccaaaagttgaccatcatactgggctatcatatcattatc

SEQ ID NO: 105012 - DNA, 507 bp, Triticum aestivum
  unsure (1)..(507): unsure at all n locations
  Clone ID: PAT_TA_105012
cgaattcgcggccgcgtcgacgtccgcagtcaagtccaaaatatatgtgaaatggtacaaggtgaggtgatattagaagccatctaaaaacaacgcacgatacaatacgtgccaaaccacagtaaaaatgatgttggatagtttcatatacataacataagctactttgtgtttcacgtttaaacaagttgttcttaaggaacaccttaatccttagatgtaatttaaggcaccataatctcttagatttaatcttgattcgtatatgattaaagcaaagtacatggagtatacaggaacaaccacaattgtatgaaggtcccacttaaatgactcattctcctaagttagttgcatcttcacagctttgtggacgatatcattgcactccgctaaatgctgctaaaactgagagccctacagaatgtcaactagtgggttntccactccaagaacaacaattacagtagcatccttgtaatgaacaatattaattatctcctagct

SEQ ID NO: 105013 - DNA, 186 bp, Triticum aestivum
  Clone ID: PAT_TA_105013
tcgcggccgcgtcgacatttggatggaagtgatttagaatcttggagatctgttttagagaaggactcaaatgggaattgggttgagcttccacttgtgaagaaatcactcgaagtgctgcaggcactcttgttagatgattctggacttggtggtggtcttggtattggaggggggtctggccct

SEQ ID NO: 105014 - DNA, 440 bp, Triticum aestivum
  unsure (1)..(440): unsure at all n locations
  Clone ID: PAT_TA_105014
tcgcggccgcgtcgaccttcgacggccgtgcgcgagtgtgcgcgctgagtgccagcatagatggcgtgggtggcggggacatggagttcttgaggcggatcgaggagctggcggcgtcggcgggggtgcggacggcggggtgcgggtggccgccgagcctcgagcggagcgcgagcggcgtcgggctgcccctgtctcttcggatgctgaagcggaagaagcagcagcggcggcagcagcaggtgccgcagccgtcgcggtgggacgggcggctccgcctgggctccgccggcgagtcggtgggccgcgccttctcctccatggtgctcatcgtgcgggagctgcagagcttcncgctgcagcagatgctctgcgacgacctgcaggccgtcctggcgcgcgcccacggcgagatgcaggactcgttcgtctggctcttc

SEQ ID NO: 105015 - DNA, 472 bp, Triticum aestivum
  Clone ID: PAT_TA_105015
tcgcggccgcgtcgacttttttttttttttttagacttgttaccgtagggtgtataggctttggatatatagatgctaaatggatatatagatgctaaatacgtcgtacagttattctgtacgatcactagcgtagaagaactcttgactgaactaataatacgagctcttctccggtgttcacatcacagctcactgactgtaatatgcagctactacactacgctacgctacactggacgcgcgcggtgaccagtgatcgatcgttcgcgccaagaaacagagagggagtcgagcagaggcagaggaagcagagcacgctgcatggctggcttggctaatggcagatctccatggagaagtcggagtcgagcagctccgcgatcatctgctccacgtgctgctcctcgaggagcgtcccgacccaccccgtcgatgacggcagcgtcggccccgcgtgtcgacgcggccg

SEQ ID NO: 105016 - DNA, 554 bp, Triticum aestivum
  Clone ID: PAT_TA_105016
tcgcggccgcgtcgacgctcctgttcctcagccatctgagtggccttcttggattgattgtctggtggcggcgtggtgttattggtttgctcagcattcgccatcatttcatcaattcgcaacagtggccatcggttcggcccttctgctcctgcgaatctgtggatccagcccacgcgcatgatctagccgaggcgggggccgctcgatccaattcgacgcgggggcaatccatcgcagcaagggggaaatggagggatgcgggtgatgcaagccgacgcttcatctgatcgaaactgctctgctcatatttgaaggccgcaatcattatacggttactctgcacaaattcatggcaggggatgtcctatcctttccgctgcctcatggtacaatgtggggctcgccaatcaatgcggagaggatctcaccggccgatgcaaggaagttcatccgccgtttttcaagcgaggagtaaagtgctcgcttgttttgtatatatcaattaatggcagtcgagggagcgatggtgacggatggtggaggttatggta

SEQ ID NO: 105017 - DNA, 545 bp, Triticum aestivum
  Clone ID: PAT_TA_105017
cgcggccgcgtcgactacaatcttgtcgtttacgaaacaaactcataaactcatgtcgtccgtagaatacagtgtactaaatacatttccaagttctggtcatgcaacataagttatatataatatgtgaaagtacaatcagcagaggtaccacactagcattcaacctgtcatcaaagagatttagaacaacacataggctacatcttgatttgacatgaaaaaagggaatcagatgagaattaaaaaacagaccataggaaatgaagcgattagatcaataggcacccatccttgattatccatacgttccctcaagtatgtgtcgtggcaaagattattagtgctaaaatagtgctcgatctgcagctgaatgtcacgttggagattaatttgatcttgctgaaacgccaatggctgcattggcggccggataagatgcatgttttgaaactgctgctcaacttgtgtgacatagtaaggataggagccttgtaaatcggctgcagattgccacaccaaccacattacatcaaaaagaagaa

SEQ ID NO: 105018 - DNA, 497 bp, Triticum aestivum
  Clone ID: PAT_TA_105018
tcgcggccgcgtcgacccgggggcctatttggaatgcaatggctattatgacaattactaaaaaaaagccagcttattggtgggactcgccaggagatgattgcccagagttgcagaggtttgcaattagagttcttagcttaacttctagttcgtcaggttgtgaacggaactggagtgcatttgagcaagtaagaatcaatgtcatgtgttctctaggaaatattatataacacgtgtagcaatgctaagttctcaaacttgtgtaggttcactcaaagagaagaaatcgtctgcactaagataagataattgatttagtccttgtcatgtacaactgatgagcagactgcagaagacaaagacaagttgtggaatatgacattgacgatgtctcttctgatgatgaatgcataactgaaaaagaagaacatgaccttcctccacaaaaggactggttgcattcttttaatagcattgctcggtcgacgcggccg

SEQ ID NO: 105019 - DNA, 494 bp, Triticum aestivum
  Clone ID: PAT_TA_105019
cgcggccgcgtcgactttttttttttttttttttttttttgaaacaacaagttacctgttattttccatagttcattttcacttaaggggatcctgaaaaggggcatggcaggcaccacttttaatgacctgtaatgttgggggttaatcaataaaccacttatttggggtaatactcatggggaaatcattgacccacttatctgtggggatgattttatttgtacttactactgcatcccataatggaaaacgttttttgcaagctattttgcaagctatcatagcttgcaaaaacgttttacattatgggccggaaatagtccttgaaaatttccccatacaaattaaattgataggctgccaaactgcatgttccattcttcataaatccccaattcccttggggaaacaaaagggctgacctcctgcaaagcagcctcaaagtccttgagcatcaccggacccacttcctccttgtttagctttgggat

SEQ ID NO: 105020 - DNA, 357 bp, Triticum aestivum
  Clone ID: PAT_TA_105020
tcgcggccgcgtcgacgtcccctgcctgccaaccccaaatctcccctccctctgccgctctcgaaattccccgagcatcgaccatgtcggcctactgcggaaagtacaaggatgagctcatcaagaacgctgcctacattggcacccctggcaagggtatccttgctgccgacgagtccaccggcaccattggtaagcgctttgccagcatcaatgttgagaatgttgaggacaaccgtcgcgccctccgtgagctcctcttctgcacccctggagccctccagtacctcagcggtgtgatcctcttcgaggagaccttgtaccagagcaccctcaaggcctgggctggtaaggcgg

SEQ ID NO: 105021 - DNA, 154 bp, Triticum aestivum
  Clone ID: PAT_TA_105021
gcggccgcgtcgactgagcaccggcggcggcatggggtgctcggggagcggctggcggcatggtggcgccgttcgtggccaagacgtactcgatggtggacgacccggccaccgacgcggttgtcgggtgggggcctgccaacaacagcttctt

SEQ ID NO: 105022 - DNA, 501 bp, Triticum aestivum
  Clone ID: PAT_TA_105022
tcgcggccgcgtcgacttttttttttttttttttttttttgggacttctgcctgttttcagccatcaccctctccctcatctgaacaagtagatctagctgcattgatggagggagagaagctaacacagcaggatcaatgtcaccagttgtaataggaaatatcatctcttcatcatcgtcgttctcatcttcgtcaatgccagttccttcttgtgatggaacacttgcaggattgtgttcccctttgccagtcaaacctgcctcatcctctgcagcaagtgacgctgccagcagttcatccaatttttcctggttgattggtgcaactgcccccctgctgttctcgccatcgtcatttcgggtttgacctccatctgttttctcagtttcttctcctctactgctctcaacttgcttgcccttagcatcatgcttagccctgtcacttttgatttgagctgccaattcttcaagcctacttgccttgagatgggagatt

SEQ ID NO: 105023 - DNA, 314 bp, Triticum aestivum
  Clone ID: PAT_TA_105023
tatcgaatgcctgcctcagatcgctagcaagtgcacccacatcatagaccctatctgggaagtcgggaacgtccctgtccctacctctatcctgcattggtggccgccggccacaagcccattggtaaacattttctaccgcgttgcgctttgttaggatactagcatgccactcagtccaaccagaattttgctgcaaatgtgactgtattgtgctgttgctgttggccagctgaatgagcttgttggctatgcgtgtaatatgaccaacaaatccaacccttggtggagttcttccctctgaagatagggta

SEQ ID NO: 105024 - DNA, 559 bp, Triticum aestivum
  Clone ID: PAT_TA_105024
tcgcggccgcgtcgaccgcggccgcgtcgacctgagagtacgaaacacaaagcacctgctctagagagagattcaactcttttgcgattacaagacaatctttgaaaggaattctcccctcctcactgatttttctaatacgcttttgtaactcccgccgttgttcaatagtcattactctacgagaactccacgaacgaggatgagaaacctcaggtacagcacagccagggaaggcacttaacggctcagtcaagccagctgtcagatagcagtactctaatgtttcccagtaagcatcaacaaactcctgctttgaaagcacaaaatcatgccgaatttggacgatgattcaaattaacatgtgatgatggaagaattcttcgtattggttcttcaatataaggcctgagctccattgaatgtgtaggcgcagcatctgatggtacacctgactcatctacaagttcatttgcaagttggagcaacttgagcttatctaaaatatttattaagcgtgagagtcgtcccttagcatgagtgtccgtcgacgcggccg

SEQ ID NO: 105025 - DNA, 621 bp, Triticum aestivum
  Clone ID: PAT_TA_105025
cgcggccgcgtcgaccaaatgccacttctttgacactcaacatgtcacacgatacatcgtcgttacaccaaaatagtccagtttttcgcaaatggcagagaaaacatatatggtactaacatctcagcctcccacttcatgtaatccagtctagtgcaaaacacatgccagctacaagtctgcaaccctatcctgcgtggccctcgcacgagtgttcatgtaagggcatcgggcgatacacagaagaaccaatggccgccaaggaagcggttaaccgtgagggggcgcttgccctttgggttccccgtctgcagggtttcattcacagcagacaactctttgggcagacaagatcagacagatgcatgctgatgcacaacatttctaacactcggaaatcgatcagcccagcgcctataacctgatgcaatgatttgcttttggttaagctgttctctatcttcgtcagggatatcctgacgcaagcttctgacaatgaggtcagataaactcccaagggtcttggggtcaaaaccagagaagctcaagaggaactcttcagatgtcaactccatcaccatcgtgcataagctggaggctgtcatgatgactgatgaagca

SEQ ID NO: 105026 - DNA, 476 bp, Triticum aestivum
  Clone ID: PAT_TA_105026
cgaattcgcggccgcgtcgaccgaaagacaacctgccaagaggcgggggctctgacgaccaccaaaaagctgtgccactatgtgagggatgtatctgggtcactcctacctcgatgaccgcacttacaagggaatccaaacccgtcccgagtaccatgcaagacgactcgaaagaggtgcaccaactgagccaacaatgccgccacccacatagcacaaagccaaaacctcacccctctagggcgccactgtgtcgcttttcagggatggtgccccggcatccactgcctcggcctcactggtagagcacccgcatgccaaggccttcccacgcacctgggcaagggagaagccacggccgcaccaggcacgctttccaaggttcagcgccagattcgaagccagcacatcaaatggtttttcttctccctgcagctaactagcctgagataatgccagcaactctgctcggtagc

SEQ ID NO: 105027 - DNA, 412 bp, Triticum aestivum
  Clone ID: PAT_TA_105027
tcgcggccgcgtcgaccagtgatgtacatgtcgtgccccttaccctgagcggcaccgacggcagcaggcctgtcactgttctacctaatgtggctcacgacttggacaaattgcaaaacaacacctactcgctgtgcattgaaggaaactgctatgttctgctatcccccagggatgatggtactgggtctcaatccagcaaggaaaaacttctcgtgttccatgtgcagagcgagttggtgaccagcattgacacgccagaggatggcaccctgttttcaggcataatggagatgggtaagagtgtgtgcgatacgactttgtctcgcgaccgcccggagataacattgtctgttctgaactctggtcttctctgggagcggatgtgctgtttgagcgtctcaccatcacc

SEQ ID NO: 105028 - DNA, 486 bp, Triticum aestivum
  unsure (1)..(486): unsure at all n locations
  Clone ID: PAT_TA_105028
tcgcggccgcgtcgacagaagagcaagtgacagtaggaagatccatttgacacccatcagtttcctctcttccatttcaggctcagcagcccacgacaagaatgacacaacatccttgcccatctgggcttcagttgcaggagtagggatgtagggattgtaatgcagaccctcacgaatctgaacaccancaggtgggtcatggtaaccagtaagaagagcaaacacgtagttctggccatcgtgccttgccttcgtgataaggctgagatctgggggatatgccccaccatttgcaaatcgggctgcttgttcatttggataaggctgcgggaagcgatcactcagcttgccaggacgtgtgaacatttcaccctcatcattaggaccatcaaccacttcaatttcagcagccattgccttagtttcctcctcagtataggccaccccaaccaaatcacggtgtgaaatcaatgacatggagtg

SEQ ID NO: 105029 - DNA, 203 bp, Triticum aestivum
  Clone ID: PAT_TA_105029
atggaggcgtaggtgtcgccctgctgcatcacgtaggtgacgagcgcggtggcgttctgggcggcggtggggcactggcagaagatggggaacgtgaccatgtcggcgacctcgagcttggtgggcaccaccgtggggttgacgcgctccacggcctggtactgcgtgaggttctgcagcttggtgacggagacgatccagaa

SEQ ID NO: 105030 - DNA, 588 bp, Triticum aestivum
  Clone ID: PAT_TA_105030
tcgcggccgcgtcgacttttttttttttttttttttttttacttaagccacatcttcatttattcatatttcatacagttgaacaagaaaaaaggacttgcttgccaattgctaccctatttgacacacaatacatactgttattgtcaatctatttcctttagctatacatacatacatacatacacactcctacatacataacattgacaataataatgcggacacttccaaagtacagaaaaatgctcgatcatccgaaaaaacatagcatctttcctccagttcaggacaaatcaacctgacaaaagccatctcagatactcagttccatcactgtaagcagggggagcatcaggagcagctaccctcttccgcataaaagtatcgactgaaatgggcttcctcttgcggccgcctggatgaggtcggagttgctcatcagcctccacaaaatcgccctcaaaaagcacgtgaacactagatttctcatgattgtcccttacatgcttgtacgaaaacttctggccgcacccagagaatccacatgtgaaaggtctactctgctcatgaactgccttaatatgc

SEQ ID NO: 105031 - DNA, 556 bp, Triticum aestivum
  Clone ID: PAT_TA_105031
tcgcggccgcgtcgaccgcggccgcgtcgacagcacacacttccatctggaggcgttagctcttcaactgaatttgttcctaaaattctgaaaggaactgaggactgggaagctgatgcaatggatgataagtactccttgtttctcaatggagtacttatcatccattgcgaaacaaggcatgtcaaaaaatggtggttcagttggcaaggacaattcaatctcaatcttggaggagttctttggcaacgcattgtcaaaaggcagtggcaatttaccgacatatgttgagagtcaacagctgaatacgggtgctgatatgatggcctcttctgtaccagaatcatccaaatttgctcgctggtttcgtgatgaagattcaaaaccttcagaggacttgccatcaaagagcctgctctccatgattgtgaacaatgacaaaacaggcccacaaaacatagctcctggtccaactttgtctgatggtgctattcatcagaatttatcatcaaaattaactaccgataaattcgatgcttcatcaaggctactacca

SEQ ID NO: 105032 - DNA, 365 bp, Triticum aestivum
  Clone ID: PAT_TA_105032
cgcggccgcgtcgacgaaatacctagcatttctgctactacggagtaatgcgctgaatgtttggtcccgcgtcgctccggctccaggggcgacacgggcggcgaccccagccaccgaggcgctcgaggcgctcggccctccgccgcctcgcagtcgctggtgcctcccgcgggcaaagctcgtgcggagcgggcggtggcggagtctcctctcgcgctggcgggcgctgcaagatggggatcttgtggtgtcgggcagtggctggcgtcggcgagcggccttgtgccccggcgtggaggcggtggtcctgctgctgcttggcggtgcataaatataggtgtgctaatgcacttccaaactggatg

SEQ ID NO: 105033 - DNA, 111 bp, Triticum aestivum
  Clone ID: PAT_TA_105033
gccgcgtcgacccaaaatgagtacgttctatttctgacccaacaaatctaatatgcaaggataacaataaaatcaggatgatcaaaattaaaacacatgtgcatgcttcat

SEQ ID NO: 105034 - DNA, 604 bp, Triticum aestivum
  unsure (1)..(604): unsure at all n locations
  Clone ID: PAT_TA_105034
tcgcggccgcgtcgacctgaactttttttatatatatctgggagtcatacgctggacactacactcctgcatttgcaactcatgtgccaaggcggaatagaacaatgagggcatttaccttgatttgaaggtttcagtcaactccttttggatctccccatgttgtaaattgttatgaaggtttttgtagtttaatcttctttctcaaggtgtttgcaattagcatggcttacaaatccagtataaggtatgcaccaattatgcattggatgtgggtgttcggtgtcccatgtcagtctcatggacttgattaatttgcatactgcagaatgcagcagtactttgctcaacaaaggtacaagttaatcgattcatctatttgctggattaaataatatatgcatgagcatattcagttaattagcatgagcatatccatcttctgaggtatacatcagagagagggagaattcttattagccttgctgcctactgacatcgaatttaattntatcttttctttcaggtagctttggtgttgtatcttgccttgctacctgttttttttattgcgataccatattcagttccgtgaggctgaaaa

SEQ ID NO: 105035 - DNA, 567 bp, Triticum aestivum
  Clone ID: PAT_TA_105035
tcgcggccgcgtcgacaaaagatgagagaaaggagagaactccatggcagccgagggttccagcggcgtcggctcggcggccggaaaacatcgttgtctcataacccaagagagcgcggagtggcgaaattcctcaccggcttgccagcgcgaggaaacttctcctcaagttccatctcttccaatctgggaggcctcagggtttatgtctgcgagcacgacacaaatcctccagatgtgctgccagaagtttgggtgtgcagaagtcatcaaaaaagcccaacttgggcagttcttccggattgtcttcctctgatgaagcaatatctggcttttcacagcacacactgcagtccttcaccgtagagaggttgcgtgcacttctccgacaaagtggcctcacaaccaaggggaaaaaggacgaactgatcactcgcttaagagaggcgcagagttgatatcaatctcaagtttctgccttgtttgtgattgatcaattgcctactggcactgtaaaacgttgctgagctgaatgaatcatcaggctttacttgttgacattttgta

SEQ ID NO: 105036 - DNA, 357 bp, Triticum aestivum
  Clone ID: PAT_TA_105036
tcgcggccgcgtcgacctgaactgaactatcattgctttagatacaatatctcgaacaatgaccgttccagcatattcactgtcaatagtatgcccatttgttactccatttgctttgaagccagcattcccttgctttatattaccattaccatttggaatcatgcctgaataatacctggacagcttcttatagccaacatcaccaagcgtcacaatgccagcagccaattgcttgcttgattcttttgcatagtatgcaaccacactgccatttgaaccaggaggcggaactatgggagacaggctaagaagctgagggctaacacggcctgtatttggaactggaactggact

SEQ ID NO: 105037 - DNA, 587 bp, Triticum aestivum
  Clone ID: PAT_TA_105037
tcgcggccgcgtcgacttggggatacaggtgcttgagagggaaactaagatgctctgatgattgtcagtaccaggtaagtagctacatgaaagcctgttccagttatctaggcctcctgcttggaagtcatctggtggtaggccactcccactgttttccaaatgagataaatccacgggtatctttgccaagacagctttttggcaggcattaacggcattcagagaattggcatgattaacaggaaattcagattcggtacactcaggtgcacttccaaggctttccccatccaatcgtaatgaaggcggtgatgcagaaataccatcaaacatttgcgtgatggcagcagtatgaggccatttctcttcagcggctctgagactatcagtagtatcacgaccagcagacttagcagaaatgtgatctgtattggtccatgcttcttgtgcacacattgcagttactgaaataactcgtggaattgttgcgccctcatcagcaaggaatgatgtctcgagggacagatgataagcagcaaacactgcaagttgcattgcatgcttaatcttcttcagttcttctc

SEQ ID NO: 105038 - DNA, 430 bp, Triticum aestivum
  Clone ID: PAT_TA_105038
tcgcggccgcgtcgactttttttttttttttatagcggagttcatctcattcaaacggtaagatagcagcagacacaggaagataaccaaggcggccggacagagatccagcagcccaaagagtccacctaaaaccctcctaaaccaaccacggagatctcatcggacggaccaggggaagacacgacacgacacacgactctcttatttagatcgacgacacgacacgggacacacggggcggcgacgacgacggcgaaaggcgacccgcgcgcgggcggatctagagctggccgcagtcggcgatgaccacctgcttggagcaggtgccgctgcgggagcccaccttctcgatgttcttgacgacgtccatgccctcgacgacctcgccgaagaccacgtgcttgccgtcgagccaattgcaggggac

SEQ ID NO: 105039 - DNA, 539 bp, Triticum aestivum
  Clone ID: PAT_TA_105039
ccgaattcgcggccgcgtcgacatttgggactgcatttagtgatagaatttagagatggttacttctactgttgttccgtctggtcaaggccggtgggggcgtcctcctggaatccggccggcggtcatcgcgagatcgacggaatggccgcgggctcgagcagctgccgtgtggaaccctgtgttgcaggggtggacgcatctaggcggtaggttgtgcggggaggacagacagcggtggccggagtgtggggccctgtggactgtggtgcaggcggcggcctctcgatacttctgccacgccgagccaacgtgttcctgttggagattccttcgcggcctttggcgtccgtcctccactggttcatcgccgtcgtcggtatcgtctgttcggccgcccaagccgccactgtcgtcccgcggcctgctttaccgggcgaacggcccgtcgcttctcttgcggccgccggcaatcggaaagcaaggagaataggaagaccaggtggtggaagagaactacgtcggcaccgcattcctgc

SEQ ID NO: 105040 - DNA, 563 bp, Triticum aestivum
  Clone ID: PAT_TA_105040
tcgcggccgcgtcgaccacgctgctccaacgttcccgcccgcccgccgccgccgccgccaccaatatcgacatcgccgtcgtccccagaggtatcatgtcaggcaatcccggttacgcggcagccccgaagcggcagcggaggcggcgcccgagggacgcggaggacggctccgcgttccccagggttgtcacgagccggccaagaggtgccgaccaggtccgcgaggtggccgtggtgccggcggaggccatggatatcgatgcggggacaagtgctaacgcccccacaggaggcgtggatggatcgtacctcagcgacacgcggttcgatcaatgcgctgtttcaccattgtcattgcaaggaatcaaagatgctgggtatgaaaggctgacccgcgtacaggaggcaactctgccagtaattcttcaaggcaaggatgttcttgcaaaagcaaagactggaacaggaaaaaccgttgcatttttggtattctttcgccttcagcacaacaagtcaatttgatggctttcacagctcatgggttattgcagtgatgttacc

SEQ ID NO: 105041 - DNA, 231 bp, Triticum aestivum
  Clone ID: PAT_TA_105041
acgctcttcctcctgctcaacgtcgtcatcggcaccatcgcgctcaccttccgctcccaccgcctccgccacgaccaccacggggaggaggaccgccaccaccagcataaggaccatgacgaccggtacgctcctcccccgcctccggccccgctggcgcgcacgtagtccgtgatggagcgcctgcactccctcggcctctaccgcttccgctccggggacttccctccc

SEQ ID NO: 105042 - DNA, 393 bp, Triticum aestivum
  Clone ID: PAT_TA_105042
cgcggccgcgtcgacttttcattgcctgaatcaacgttacacaaatagatgtaaggacctgataaagttaccaagaccattccttcattgatcaggaaaagagatgaaatacgcatgactatgtaatcatataaatcctgacatatcgaatacttctttttgtgaatgtcttaaaatatcattgtcttatactacaaaggtaatctccaaataagtcaataagttctttctttcttatacaatcatatcaatataaagaatccctaccagcaaataaaaattcacagatctgtacatgtcttgtttaaaagaacatatattagcaaattcaaatgtgactgatggagaaagtaataggaagatagagatagtaacatcatatggaaaacttct

SEQ ID NO: 105043 - DNA, 210 bp, Triticum aestivum
  Clone ID: PAT_TA_105043
gcggccgcgtcgacccaccaccatcaacacacacacacacagcagccaagagaagctcgccggagagagaagagtcgacgatgtccggccgcggcaagggagggaagggcctccgcaagggcggccccaaccgcctccggaaggtgctgcgccacatcctgggcatcaccaatccggcaatccggcgtctggctctgcggggcggcgtga

SEQ ID NO: 105044 - DNA, 214 bp, Triticum aestivum
  Clone ID: PAT_TA_105044
cgcggccgcgtcgacccactcaccactcgctagaagtgctctgttttgatccaagaaaaagagagggggcgctctgcttcgttcgatggcgaccgtgatggaggcggctgctgctccggcgatggtcggagctggcgaggaggtgaaggaggcggttgctgcgccggagaaagtggaggaggtgaaggaggcggttgctgcgccggacaaagtg

SEQ ID NO: 105045 - DNA, 467 bp, Triticum aestivum
  Clone ID: PAT_TA_105045
cgaattcgcggccgcgtcgactttttttttttttttttttttttttctttgacaaggaaatcaactctttctggtagatattaaagcaacaaaccacttggtttttcacacaattctcaaaatctaaaaacaatactaaggtaccacttgcagagcacatacgcacatacaagtttattgatagagataacaatacacttcgatgaaaaactaaagattgcattattagaacaagaaggcagatcaccacactgcctgatttattagctaggctgcctgtatgaatgaatcattccaaagctgacttattaaaatgtcgtaggctatcgaaaagtaatagttcgacagctgatcggagaaggataagctgcctttaggctttagccaaagactggtctagccgacggttgcctgggcgagataaaacaacctggtaatctccaagtgcccgtgccttcatacaagcc

SEQ ID NO: 105046 - DNA, 381 bp, Triticum aestivum
  Clone ID: PAT_TA_105046
tcgcggccgcgtcgactttttttttttttttttttttttttataggaatcgcgtacaatttgtctgacatccaaacgtgcatgcggcgataactctcgagcttatatccggcgaacatgcaaaggcatgtgccgagtattcctaaaccatactaattcttcaggaccgtaccacgactacccctaagatgtctgaccgggcaagcctggaggcaaatatcggcgcctctaataagcgcaacctaaaacaacccacttctcgtgagacagtataccgcacgctatcttcaacagcttatgcggagatggatgtatcgggtattgacgctatcatgcggatgctgagcggctctcactcgtcgtcctcctcttctttgctatc

SEQ ID NO: 105047 - DNA, 521 bp, Triticum aestivum
  Clone ID: PAT_TA_105047
cgcggccgcgtcgacagggattccgccctaaaagttttactgccgagccaaagaaacaacgagcagaaacaagaactggctgtgaagcacacatgactgttaaaatcactactagcggcaaatatgtagtgacagagtgtgtggctgatcataatcatgatcttgaagctcctgtggtggacattcagattctgagatcacagaagttattagcaaagttacagcagcctccagatccaccaaaagttattagcaaagttacagcagcctccagatccaccaaaagttgttttgataccaaatgactataaaaattatgttaggacaaggcacacgacggatatgcaattgggcgatgctcgggcaatttctgaatatttacagaggatgaaaggcgagaatccttcattcttctgttccattcaagtggatgaagacgaccaattcagaaatgtattctgggcagatgttaaatcagtgatggactttaactacttcggtgatgtagtatgtgttgacac

SEQ ID NO: 105048 - DNA, 526 bp, Triticum aestivum
  Clone ID: PAT_TA_105048
tcgcggccgcgtcgactatttttgtttcagtttggagtactagcatttactctgttctgcaaacatctatatctaaaacaattcttatcattgtctaagaatcgtacagacaaatgatatatgaagccttgaaatttctctccaggggtcataaaaattaacagtttgctaagcgagcttttagcactgcaaaattgggcttgcaacttctatggtagtaggatatgtcccccggcgttcttggaatgtattcttgtcgcaccctcataaacgctctgttcttcttctcgttgaagtttcttctcactcaaggttctagcaccgcggtattcgacagcgtaggctgcggttttgcagaatgggcagtggacagctttggaagccttcgacggcatcaactgcaagaagcactctgtgcagatccctttgccgcagcacttggatcgattcaaactcgggtagaaggaagcagatggggcactccactgcgcgtccgtcctcctcggcggcgtcgaagcacggcgcg

SEQ ID NO: 105049 - DNA, 265 bp, Triticum aestivum
  unsure (1)..(265): unsure at all n locations
  Clone ID: PAT_TA_105049
tcgcggccgcgtcgacgtctgctcggtgccggcacgggccgtgtcgatggtgtactgggcggcgccggccgccttctgcttggcggcctcggccgtctgggcgatgtagctcccggtctgctgcgcggtgtcagccgcgttgtccttggcctcgtagcccttctccttggtggcctccgcggcgccgcggcccttgtccatggcgcggccagtggcgtccaacncctcatccttggcctcaaaccccttctccttggtcgcctcc

SEQ ID NO: 105050 - DNA, 657 bp, Triticum aestivum
  Clone ID: PAT_TA_105050
cgaattcgcggccgcgtcgaccgcaacactaatccactcagattgcacgagcgagttcgggagttatgccagaacatgattgtgagtcaatctgatcttattattcgaaactttgttccgcaccttagggggttactaatgcaatacttatcaattttattgtatgcaatcatatatggtgcagaggtcaaaacgatttaaagtactgtttatattctgcatttaaaggctcatctcctcatattgtcatttattttttgtacagtgcaaaacatagcagtttttttattccaatttatcaggtgcaaacttctatgggttatcaagtggtacctttttattttcctaattgacttgcagctagcagactggtaatatacactcaccctctctatatgctcgatctcaatactggaatgattttttttgctaccatgcaatattgtttgccggatatttctacattgaattaccctaaatcatttgtgcaattaaaggtgtgtaatcctgatgacatatgtttgctgtatttccttggaactttcattttctgtttgtgaattaatcgccaaatgaacgagtgacagtgttgcttcagtgccaaacatgtcaagtacttttatactcctttctgtgacaggactactgtaactactt

SEQ ID NO: 105051 - DNA, 627 bp, Triticum aestivum
  Clone ID: PAT_TA_105051
tcgcggccgcgtcgacctttccccggctgcgcatcccttgccagcctcccaccctccccacccccgccgccgccgccgccgcccccgccccgtcgatgccttccatcgccgccatccccgagcccatggccgtcgacgactccgcctccaagaaggccaagcgcaagcagctcaaggccgaggccgccgcctctggcaagaaggacaagaaggagaagaaagacaagaagcggaagaccaaggagccggcctcctccgacgaggagggccggagcagcaccagctccgagtcggaccgggcgcccgccgccaagaaggccaagaaggagaagaaggacaagaaggccaaggccgagccggccgaggagccggccaacgacgacggggagctcaccgccagcggcgaggaggaggaggagcccgccgaccccaacgcgctcgccaacttccggatttccgagaagctcaaggacaagctcaagtccaagggcatcaacgcgctcttccccatccaggccaccaccttcgccctcgtcctcgacggcaacgacctcgtcggccgcgcgcgcaccggacagggcaaaacgctggcttttgttctacccatattggaatcattgtcgacgc

SEQ ID NO: 105052 - DNA, 657 bp, Triticum aestivum
  Clone ID: PAT_TA_105052
tcgcggccgcgtcgactgacaattgatattaaggtttagtagttctactcatttttagtcttttagatactcctccaatgcaatttattttcaccggttttgaagttataataaggtcaccatgacagctgatattaaggtttagtagttctactaatttttattctttgagatactccaatgcaattttgatgcaacattggatatttccacagctttaaccttatgccacaattgcttttgtcttatttcagtgtgttcatttgccatctttagtgctcaggaccaaaagaattgctaatcttgtagttttagtagacgtacattctacaacatggtagaaaataaggggagcttttagacggcctctaggttatcatatgaaatacagttaaattttaggaaggtttaggagtatctccctttttgtataaatttggctccacgattgcttaaacaaatagctaggttctagaacaaacctgctatgaataatcgcatcgttacttcagtgaaaagttcccgggaattctatgtgttcctatggacttggttgtaagtattccttttgttatccagtttctcactaagcatgttacctttgttgctgaatttttcctatagtttatgtatattagactcacatgattacttgat

SEQ ID NO: 105053 - DNA, 510 bp, Triticum aestivum
  Clone ID: PAT_TA_105053
cgcggccggtcgaccaaccaagggcagcaccaaccccaagtcgtcggcggcggcgggcggcgcctgcaaccccgtcccgctcaaggcgcgctccaactccgcgcgcgtcgcgggcggctcggccgcggccaccgccaccttcttcggcctcccggccaggatccggccggccttcacccggcgccagccgtcgcagggccggatcttgcccgacaagcgctctggcggcaccggcgaggagccgcggtcgcccaaggtgtcctgcattgggaaggtgctgtccgaccgggagaggtgcgggcggcggcgccagcgcaggtggtggcgcggggtggcggccgtgttccggtgcggcggcggcggctgcgcctcccggggagtcggcggcggcgcggcgggcaagaagatggcgctggaggggagtgaatacgacgaggaggagaaggaggcgagcgtggcggcaatgcggaagttcaagtccgggaggagagccgccacgtggggggagga

SEQ ID NO: 105054 - DNA, 219 bp, Triticum aestivum
  Clone ID: PAT_TA_105054
cgcggccgcgtcgacgagcctgcggggagacacgtggcgccctggggttggaggagggcgcggtcaacggtggcggagccaatggaggcgtgacaagtggcgcgggtgaggtggctgacgccggatttggaggggaaaggcggcagcgcggcccccgaggtgggaggagctggtggctgcgggttgggggcgcggaaaaagagaggagggggggagggg

SEQ ID NO: 105055 - DNA, 677 bp, Triticum aestivum
  Clone ID: PAT_TA_105055
cgaattcgcggccgcgtcgacggcagtatagattgaatctctgaatctgttggcacgaagttacaatcaacaaacaatccatcactatcctctgttaacctttcccataccgcaccggtttcagtacttaacaaggacaaatcgttcagcaacacatatatttggtctcctaccttagatattgtaattaatgtttcattccaaatcaggacagtgggctgtctcgcttttaagtcatcatgtaaggaagaaaatccatacgaggttagctgagggccatgcaaaaaagttgagatcattgcacaagaaatagaaccaagttcttctgatctggttaaagagaacacaagtgtcgaatcaaacttgtcatcatctttacatccaccatgcttttgaggccctgaatttgtgctggatcgaatcgattcgtacacagcaagaatatacgaaagttggtagtaggaacttttacgtattgaggagcccaattcgcatcctggggatctaccaaccagccatggtgtagagggacaccaagaaaaccaaatattgcggtttctgaggtctgctcaaagccacaagagctggcaaatgtcacatcaaagtataaactgcccggaagcttcggcaatacaccaagaacttgtttattgaactctgatagttccaagttctgt

SEQ ID NO: 105056 - DNA, 592 bp, Triticum aestivum
  Clone ID: PAT_TA_105056
ggccgcgtcgacctgaagatccttttatctcctttacctttgtattgtatgcaaaaaatttttaatttcattgctcactggcctatattttgtggattccacaaccttaaaattgctgaatccgtaaatagacttctcattgatctttgatctaaaagtatctattagattcttccagatagaagcatgaattgtttcaccctgtaaaaacaatcaattatggttagtaactgttgcttaatctgaaaaaaatccaattaactatattgaaaaacagacctgctcatccatgagtatcatatctaggctaataagctcatcggtagtaggattaactgaatcccaaatcctcattactttcacttgaatgttccagttttgtccccttgtagttaattcgctcaactttgtgtatgccatagtcttatgtcttcaaaattaataggaaaaaattagtcaatggatatagtatttattgaagatcctatccataaaaaaggttgttaaataacaattaccaagtctggtaattcaccccagaagttctttgtcgtcacttcttccgacgtcgattggagcagctgggcgtggc

SEQ ID NO: 105057 - DNA, 499 bp, Triticum aestivum
  Clone ID: PAT_TA_105057
tcgcggccgcgtcgactttttttttttttttttttttttggcaacttaaagtaaattttgccatggcaatgtaaactaaaatttgccatgtgaacaaaagtattcttgccatggcaaaaaggagtaaaatttgccaaacaagtttgccataaacatctataactttgccatggcaagtttgcatgtttttgaacatgttaattaaagaagtttaccatggcataaaatggagtaaaatttgccatcgcaaaaatggattaaaagagtatcttcggttgccaaagagctaaaaacgccctgatgtacatacttataaaaattgccatgctactgtcaaaatgggtatttggaaaatttcactagcaggtcccatgctaaaggaatttgactttttttgtttgttttaaaccaattcagtgaattaacacatataccccgataacgtgtgaccacttcggtctgggagcaccccaaaccgaacgtcacgttcgggacggga

SEQ ID NO: 105058 - DNA, 624 bp, Triticum aestivum
  Clone ID: PAT_TA_105058
tcgcggccgcgtcgacggcacatattccccgaatctactttgacagcttttgccaatgatttttcagatcagctttgtgtttgcatattgcaaactgaaacatggtagtgcacacttcagtatactggtagcgctcggtaactctggtaaccatgaaccctgaactagcaaggccccgttgaattaactatcatgtgtgtacgtggtgtatgtgcggccgtgtgaagaatctagattacggcgcactaataacaccaagtaaactatgcgcagcgactcatgacaccagtcaggggcagtcagtcagagcccatgccgaaccatgcgcagcgactcagcgacaaggatgaacgacactgcccggccgaaccatgcacgatcgctgattgaacggcttgatacagtacatcttgtgtaaatggacgtcttgatgggtagcatcgtgtgtaaatcgtccatccttgtcgtgtgtatagcagcgttctttcgcttaagatgctctacttcccagattcaagtacacgaatcaggagtattaaaagggaaatgcccccaaatcctttaataaacagattcactgatctagtagagtagtaagcatgctccaagccaagcaagcatgtg

SEQ ID NO: 105059 - DNA, 300 bp, Triticum aestivum
  Clone ID: PAT_TA_105059
ctccggccgggattcggacccggtgggtgccccggcgccgctcgccatttggtctgattccgaggagggacgccatgcccggcagctcctcggattgatcctcggcgccggtgctcgccgcccccctcccggttctcctcgccttcttgtcctgcttcttcccgggcctccggatcgaaagatccaattcgcggggcatttttccgtcctcctccccaattcctccgcaggactgtccctgtctgccaatcgctctcaatcccttcctctttaaaaatctgctctttctctccccccctc

SEQ ID NO: 105060 - DNA, 602 bp, Triticum aestivum
  Clone ID: PAT_TA_105060
tcgcggccgcgtcgacctgaagcttcttcaagtctgtctgcaaagcatcatcgagatggactatttctttttcctcgagcaacccagtcttcccgaggtcttgaatatactcactcaagtgtgtcaatactgcatatgttacttgtcgagtctttaatgcacgaagcacctgagggaatgtaacacgaacgtcttccagaaactttttagcttcctcccccgcagcagtactttcatcgatgacaattcttgcaatctcactatcaccaagaaaatcatgtagttgtctcctcgcaattctatgagcacggagaaatgccgcacagatgtagcatcctaactccaatctatctactgtgaagtatgtgacaagccttcttggcaacctgctcatctgaaggaacctatagtaatttgggaaatggacattggaccgcaaacccttccaatcgcataatgattgactagagacaagatccatagcttcatcaactgatctcattaaaatatttgctgtagattgagttattcgtccctcttcaagcattccccagtaagcagcttgcacaccattcaaaatccgcactcgagtatgtcgacgc

SEQ ID NO: 105061 - DNA, 220 bp, Triticum aestivum
  Clone ID: PAT_TA_105061
cttacgagggagatgagaatatctctagttatgtatgttctgcacatatcgagaaggaacatcgctgcgaaaaaattggacactgaaatcatttctgtgctggtttttcactccccattataagaatcatcgtgcatccacatgccctttgcgcatgtggttagaaaaaaaaaaaaaaaaaaaaaaaaaagaaaaaaaaaaaaaaaaaaaaaaaaaaaat

SEQ ID NO: 105062 - DNA, 461 bp, Triticum aestivum
  unsure (1)..(461): unsure at all n locations
  Clone ID: PAT_TA_105062
tcgcggccgcgtcgactcagcgtccccgcgcaggtcaccgtgagcgacgccgccgcgctggccgcggacgacccgtcccacggcctccgcttcccgctcatcgccaagccgctggccgtcgacggcagcgccagctcccacgacctgtgcctggtgtaccgcgccgagggcctccgcggcctccacacccccgtcgtcctccaggagttcgtcaaccacggcggcgtgctcttcaaggtctacgtggtgggcggccgcgccgtctgcgtccgccgcagcagcctgccggacgtgcccgcggagcgcctcgcggaccccgacgccgacgcctccgtccccttcgccaacatctccagccgccccgcgctggacaagggggaggactcgatgccgcccgccgcgttcgtggaccangtggcgcgcgggctccggcaggcgctggggctgcacctcctcaactt

SEQ ID NO: 105063 - DNA, 221 bp, Triticum aestivum
  Clone ID: PAT_TA_105063
cgcggccgcgtcgaccgaaacccaggccacagcacaccgcgcggcgcgggccttgaagagttcacggggacgcgccacgtcgccgccttcagacgggtcctacttctggttctcatccgcgagggaggaagagagaataaaataaagagaataattccgccgagggggaggaggaagaggataaactagtggcgagagggagcggtggtggtggtggtggg

SEQ ID NO: 105064 - DNA, 179 bp, Triticum aestivum
  Clone ID: PAT_TA_105064
tcgcggccgcgtcgactcaatgaaacggttgcggaatgccggaagatgagctaatcacaattttggagcagcgctgtatagttgctcgcagttatgccacaaaaatggttcaagttatgaaagatctgcaaatgcatagacaaaacagtagagtgtttgccggcagacatggtggtgtt

SEQ ID NO: 105065 - DNA, 424 bp, Triticum aestivum
  Clone ID: PAT_TA_105065
gcggccgcgtcgactgccctccgccgccgcgccctcggcgacgccaccgccgcggtgacctcgccgtcccacagccttacaacggtgccgtcaagcaccgccgtgtcaaggtggcggtaccagcccaaatctccccgcctcctcacggccatctccctcttctcccagcagggcaccgccgtcgaggctgccgacctgatcctcatcgacgccgtccgtctcggctgtgtctcgctctggtcgtcgacgacgggcacgccgtcctcgtcctcgtccctgtccgcgcatttcctgacgccgtccactaccccatcgtcagctccggccccgccgtagtatgccgtgaaccggaccttggacggcgagctcggctcgctaatcggggaggacggctccaccggcacggcgagtgcgggccgtggct

SEQ ID NO: 105066 - DNA, 467 bp, Triticum aestivum
  Clone ID: PAT_TA_105066
gcggccgcgtcgactgaccaccaccggcgtgccccggtaggcgccggcgccgcccgccgcaagggcggccgcggcaagaacgccaagcagatcacctgggtgctgctcctcaaggcgcaccgcgccgccggctgcctcgcctcgctggcctccgcggccgtcaccctcggcgccgccgccaggcgccgcgtggccgacggccgcaccgatgccgactccggcgcgcccggcccggctcgcgagagccccgtgctccgctcccgcttctacgccttcattagggccttcctcctcctctccctgctcctcctcgccgtcgagctggccgcgcgcttccaccgctgggacctcgccgcctctgccctggccctccccattatcggcgtcgagtcgctctacgcctcctggctgcgcctccgcgccgcctacctcgcgcccctgctccagttcctcaccgacgcctgcgt

SEQ ID NO: 105067 - DNA, 513 bp, Triticum aestivum
  Clone ID: PAT_TA_105067
tcgcggccgcgtcgactctccagaggcgctggccggtggtgcgcgatctgggcgatttggaggcgaggcgacaccgttgaccaggacgccgtcgaaattctcatcatgccgctgggagaggagctcgtcgaggatcccctcgactcgacggatccgcgatggaggtgcttgaggaggggcttcttctccggactccatggagagaggaaagaactcttgcagacacccttgtcattgcaaaaatcaagagaagctatgaaggggcctacatcgtaatgaagaggggcagggtgcaaaaggaagcgtgccttttcttgatctcttaaatataaccatgggagcggaagagtggatatgggaaagtggcaaacacaagtgctatgaatctgttgttgcactaatatcatatcatcctaaatgcgaaatccagctaaatgaactaaatttctcatattgaaggagtcaagaagggaagttacccaatattatgttaggcactttgtcatgttgact

SEQ ID NO: 105068 - DNA, 518 bp, Triticum aestivum
  unsure (1)..(518): unsure at all n locations
  Clone ID: PAT_TA_105068
gcggccgcgtcgacctcaggctctcgcgatccatgacggccgcggcgaggtgatccgccgggatcggcggcagtcccggggagtgtacggggtcgccgcccatgtcccggaagctgagggtggtcccctcgtggatgaccggctggtagagacaaaaggcgacgctggcgatgcaggtggtgaggaagaagtaggtggggacggcgagctcggcgccgacgtccagcgcagcgctgcagaagaagtcgatgaggagggcggccgggcgggcggagcggaggaagtcgcgcaggtccgggttggaggcgcgcgcgagctcgaagaccctggcctcgaagctgctgctgcaggcagcggccacgtcgggggcgagcgcggccgggggcaggcagtggaaggacatctccaggttggcggcggcgacgccntcgaggaacgacgtgtcaccaccgccgaggaggacggtgacctggaggccctgcgccaggagcagcttgccgagctccaccgtggggacc

SEQ ID NO: 105069 - DNA, 627 bp, Triticum aestivum
  Clone ID: PAT_TA_105069
tcgcggccgcgtcgaccacaattccaatcacaagctgattgctgccatctagaacttggtcagtaactgtccaagaaaatgctgttttagcaacaaataagaaaaagaagcaagcaatacaaagtgcattctttagttgaattacaaacaccactaggatttggtggttttagttttataaaatgctttccctagctatctaggtactccctctgtccgaaaaagcttgtcccaaacttgtccctcaaatggatgtatctaacactaacttgatgctagatacattcatttgagggacaagcttttccggacggaggaagtagcatataccccctccgtccggaaatggataaaaaatggatgtatctagaactaaaatacttctagatacatccatttctccgataggttttctggatggatggagtattccattatctgtgcaagatgttgttcttaacaaatgctgttcccatccaatctaatataatttcagagtactggtggacatacatgagagctgatcctgacggtctccatgagatccagaggctgtccggagctggaaaactacagatacctgtggagaagacttttcctatcagccaagtaagagaagctcatgag

SEQ ID NO: 105070 - DNA, 237 bp, Triticum aestivum
  Clone ID: PAT_TA_105070
cgaattcgcggccgcgtcgacctctcatctggtcgcggaagtagaaagcatcttgtagccggctgcccttcatggtgccgactatgagattgtggaatgtgtcccgcacaggctgcaccccgtcgagtaacatgtcatcgtaggcatcacgaagcaggtagggcctgcgctgctggatgagggacccgatgacggaggagtacatgcgccgcaactacgccaacgttgacgcggccg

SEQ ID NO: 105071 - DNA, 551 bp, Triticum aestivum
  Clone ID: PAT_TA_105071
ggccgcgtcgacaacaagacaaagtgtcggtatatgtggatcaacaactggcatagaacgcagagcctttgcaacgtttattaaatcctcaattgcattctgaccacgctggaaaacttcctcaagttccttccggccctcagtgagtcgctcctctgcttcacgcttcgtcaaagacttagcacagacagaagcatgttgcttcccgacagaagttatctttttcctaagagcatccactcgccctagtaccttttcataatatccctccccaaaggtcaactcaatgagagatctctcataaggatgtaaatctctccttctagggaagttctctgtataagttctcagtggtaccgaaagttccttcattaaggcatcaagttgttttgcacctttgtttctttcacgcttggctatgttttgtatacccttcatgggtggcacatttcttgattttctttgtgctgacataagtatatcagttgcaggcatcaccataggtattctttgaaatgcaccaaccatttcacgcttttgcagaagttctc

SEQ ID NO: 105072 - DNA, 607 bp, Triticum aestivum
  Clone ID: PAT_TA_105072
gcggccgcgtcgaccgatcgaggccgcatcgacagactcagcgggatggaaagcagcgacgcattgtccacggagtgcccgccatgggactaaacctgctgtcgggcgtggcgagcttgccgacgttttactacgagctgtccaggcacggctgctctgtcacggcaagcttttctggcgcggctgcttgtcgcagtctcatggggtgctggtgctaccttgcagcatgctctgtcgcgacaagcttgcctgcgtggctgctcgccagagtctcatgggatgctgccttgcagcatgccctatcgtagcaagctcgccggcgcggctgcttgccagagtctcatgggatgctgccttgcagcatgctctgtcgtggcatggttgccagcgcgctcgccggagtctcatgtgatgctgcgttgcagcatgctttgttgcggcaagcttgccggcatggctgctgcaagtgggtgctatgggtcggcgggctggtgcccctgcagatagaggcgctcctacaggagatgagggagtagctgcaggacgacaaagatcagctcaacgccgtgccagtgccacattttggctggtacacgctcgaacgggt

SEQ ID NO: 105073 - DNA, 376 bp, Triticum aestivum
  Clone ID: PAT_TA_105073
cgcggccgcgtcgaccagccggcagcttggaggcgatcttctcgtccttgatggtattgcgcatgttgtacgagtagttctccagggcattcttggactccgccttcttcttgggcttctccggcctgcgctcctcgacctccagctcatcctcgtcatcgtcggaggcggtgaagtcctcctcccaggtgtaggcatgcgaccatggctcgagcgagcctttgcccttgatcttggtgccccacttggtcttggtcttgcctccggcgccgcccttggacttggcctcctacctcctccctctccgcctcctgcgccccttcctcccacccccatccccatcccgcttcgccttcccccaccaccccgacctcct

SEQ ID NO: 105074 - DNA, 650 bp, Triticum aestivum
  Clone ID: PAT_TA_105074
gcggccgcgtcgaccttgaagttgtattctaaagttcttgacccatggaatgcttgacttaactgttgaagagcattttggtaaatttgccaaacacaaaaacgatgtgctgtctcaggccaacttactgcaacagcttcacttatcacagccgatctatcagttaacaatgtcttgggatgggtactattcattgccatcttaaaagtatcaaatagccatctgaaagcttcaaagctctcatcataaagtaatgcagtaccaaagatgacagtttgcctatgatgattcagacctgtaaacaaagcaatcggcctaccatagccttgcacttcataccctgaatcaaggcatactacatcaccaaagtgggtaaaatccatgatggacttggaatctgcccaaagaaaatttgtcaagttcccatcttcatcagattttactgcatagaagaatgaagggttgtcatgttgcatcttttgtaggtactccagagtggcacctacatcaccatagtgaggaactttacacttgtaccttttccaacttctaccttctagacagtttgaagtggcatcgtctttgataagattttgcttgccgtaacaatcgtctagtgcttcatcatacaaatctactccacaatcttg

SEQ ID NO: 105075 - DNA, 572 bp, Triticum aestivum
  Clone ID: PAT_TA_105075
cgaattcgcggccgcgtcgacttcgccgctttcaccacatctcccccacttagcacaaacctgcaacccagacccatcgccgtcgagggctcggcaggcacgtctctgccttgcgcgccaccagcgtttccgccacccacggctccccaacaccttctacatctcacgccccctcagcggcggacctctcctgctcctcctcttcttcctcctcctcccctcctcgtaccctgccataccgcctgccgagaccaccaccccggcacgcaaacgaagctgaatcggcggtgacaacactggccgctgctatcttcgccaccatgcggctagggggactgggaggttgccggtgggcagtgagggcgaggaggcgaggccctgacatggatgagaggagaggtggtggcgacaggaaaataggggagatgagagatccgatcttctccagcagccacacctaccccactcgacccctatgtccgccgtctctccatcttcccgacctccccacactacgcgtccggccgatttgactggacccagcgcctctcccgctggccacgccatggatg

SEQ ID NO: 105076 - DNA, 534 bp, Triticum aestivum
  Clone ID: PAT_TA_105076
gccgcgtcgacgaaaaaacctgaaaaagaatgtaggcattcagaaggagtgtgttgctaatcttgaaaaagcactgcatgatatgcgtgcggaaacagccgaaataaaggtttcctatgaaaccaaatcagctgaagcacttgaaatgatggatactgctcaaaagaaatttgatgaggcagaagagaagcttcttgcagcaaaatctttggaagcagagtgctctcgtgctcgtaatgctgcattgagaagtttacaagacatggaagaacgtgaagatcagtttagaagataccgcctttctagtgatcatgaatacgaggccaaagaaaaggatattagcttacaaaggaaatcgttgaatgatatgaagaaaatgttgcatgaaaaggagcaggtgctactgaaagaacaatcgcttcttaatcagagggatgaaaatatcgttgagaggttagcacgtgtaactcagtcggagaaaaagttagaagaggacaaggtgattctcgaagctgaacggatggctctaatgga

SEQ ID NO: 105077 - DNA, 265 bp, Triticum aestivum
  Clone ID: PAT_TA_105077
tcgcggccgcgtcgacctactagtcgctatcctatatcaaaccgaaaaaacaatcccgaccgaaccatccctctcgtccctgtcttgagtccccacccaacctgaaccctagcagcggcggcggagtgctgactcgtagcggcggtggcggcatgagctgaggggccatggaccaaggggtggctgcgggtggcggctcaggcacggctgcggggcccggagcaagcacagcggcggacggcgacccaggcagtcgacgcggccg

SEQ ID NO: 105078 - DNA, 595 bp, Triticum aestivum
  Clone ID: PAT_TA_105078
cgaattcgcggccgcgtcgacatttgcattgagcttatacttccttgccccaaggagaaggtttcatgccccaagaagtagaatacgtacagacaggcacccatcgggatggacgatcaagaaaccaaagtctaggccctgataactactccctccgttccaaaatagatgacccaactttatactaactttggaatggagggagtacaaagcaagtcgatgccagcatacatatgacaaaatgatgggcctgtcagagcgaacccttggttgaaatttgtcaaaagactgggcggtaaactgagtggtagtcttagtatcctaatacacaacttgcctactatgttttttttttaacaacagagagcgccagaggcgccagatttcattcagctcaacaacataatacagcatttattacaatgccctgcagtagtgtagcagactgaagagcaagcaaaacaggataacagtttgaggaatgagctgatttagagcatacatagatagattggtcaaggcgtcgctttcaactatggagttgtgtgcaaagaaaggacataatgtttctcaaattgccctttgtatctctatg

SEQ ID NO: 105079 - DNA, 330 bp, Triticum aestivum
  Clone ID: PAT_TA_105079
gcggccgcgtcgacgaactatgtgtgcctctatgaaacccttaaaagtcgagactgtttttctctagcgttgtgagttagcattattatatattgatcaaagttggtttcgtccttcgacaagtacttatgaaatgatgttaccatggtattgtggaatgttcatactaaccatgacattattgtggaatgttcacgctaagagtagccaatttatgctttctcgtatatatggtcgagcggagaatattacaggcggtttcgatatttgatactcttgtacggaattttgtatccacacatgttctcagacgaattattagtattatcc

SEQ ID NO: 105080 - DNA, 567 bp, Triticum aestivum
  Clone ID: PAT_TA_105080
tcgcggccgcgtcgactggggatggtggcacactaaacctttgaagcatgtgtccggtttttcaagccatatctggagtctttgggagcgctgtcgccagatccactacatcgagcgcccagccggaggtacgtgcagacatcggatcgatttcaattggggcctctcggttgggaaggactcagggcatgcatcacttcggggggctcgaatgggtataatacagaaggtgatgagtgtattagagacttcacgaaatctgaatcggaagttgtcaaacttgagtatacagaaggtgatcagtgtattagagacttcaagaaatctgaatcggaagttgtcaaacttgagtaccgaatgtcgttgatccagatgagagtcatgtgaaacaaatccgctatggtttgaaggaattaatcaatcttcattttctggacacacttatggtggacgatgtgtgccacttgccggcaacggttaatgttgcaggtggtgttcatactggctgcagccaattattgattcgggtaaatcttggaggcaagttctagcattttgatatgggga

SEQ ID NO: 105081 - DNA, 560 bp, Triticum aestivum
  Clone ID: PAT_TA_105081
cgaattcgcggccgcgtcgaccgagaagcgacgacgccgactcaatcctcccgagcttgtgcctccgttggccacccgcgcctctagccaagagcttctccccccgcgcctctagccaagagcttctccccccgccgacgacgtcacccgctctctcctgccaagatcctctgcccggtgatggcgatggcccagaggtcagtttctacttccggcgagatcgactacccctcgcggctcatatctcctcagacgaacagcaatgggctagcggtcaccttccccgtcctccgagccagctaatcagacttggacctctcccaccattgtcaaattaatggtgagcacaatctcttcctttcgcttctcccccctagatctgcacagtgttttgattggtcaattggctcttgtgattgattgtgaggtctgatgctatattttggatatttcaaggaccatttttcttgtttggactcttgttactacagagcaaagcattgcctaatgtgtggcagtttgtctattgaagttagattattggctgcatacattagaat

SEQ ID NO: 105082 - DNA, 461 bp, Triticum aestivum
  unsure (1)..(461): unsure at all n locations
  Clone ID: PAT_TA_105082
gcggccgcgtcgacagagttgaccgggatctggtagacccagccctggttcttggcgccggggtggagggcggcgtcccggtcgtccgccccgcggcggaagctggcctcggagccggacaggccgccgccgcgcctggagcgcgagcgcagcgcggcggcggcggaggaggaggcgtgcttgggcttgcgcttgccgcccttgacccggacctggccgatgcaggtgaccttgggcgaggagggctcggcgggctccatcccgccccgcccgcgccggccccccgacgccgtgcccggcgggaacatgggcgactggccgcccttgaggctcccgctgttcctcagccgcctgctcagcgaggggcgcancagcgcggccggcgccgcgtcggcagcaccgccagaaccagctccgctcgctcctccggcgccggcggcggtgcggccggggctgaaagc

SEQ ID NO: 105083 - DNA, 608 bp, Triticum aestivum
  Clone ID: PAT_TA_105083
gcggccgcgtcgacgtcggcggtgtaagattgggcgcacaagaacgacggggctgtttggtttctagccacatcttgccacactttgccacacctcaccttaggcaaatttgaccaagttaggtgtgtgtttggttctagccacacctaaggcaagattttttttatgagaagtgaaccccacgtgtcataggcacaaaaagtgtggcaagattcccttaggcaagccaaagtgtggcaaacaatttaagcaactcaagttaggcaagtgtggcaaaaataatgtggcaatatatggcaagcatagtcacaatccaaacagccccgacatctcccaagtaaccaagcaacaggctatcgccctccaaagagaaagaacaaggcgcacaagagttctgcggaaaatttgtctgcaattcttcaacgttttgccactcggccaccatctaggaaatatcaccaaacggaaccagcctccaaactacgtcacgatgaagttttcacatgtagttcgacctactatcttgtcttgtgtcctaaagatgtattactcctgccggcaaaaactctctataaaaatatcaacaaaaacataacactcaccaaaaa

SEQ ID NO: 105084 - DNA, 250 bp, Triticum aestivum
  Clone ID: PAT_TA_105084
gcggccgcgtcgacccgttagttcaactagctagctagcaagggaaaaaggcagaaccaagaaagagatcgcatgcaagcctttgttcaggtgtgtctgtagctcggtgcttagcacttttggctttctatatacggtgcagccggtttcgacttgcatgtgtattctgaatttagaatatatgaatgtttgtcttcaaaaaaaaaaaaaaaaaaaaaaaaaaaaaaaaaaaaaaaaaaaaaaaaaaaaa

SEQ ID NO: 105085 - DNA, 467 bp, Triticum aestivum
  Clone ID: PAT_TA_105085
gcggccgcgtcgacttttacggcaacagttggaagagggccaggtaaaatgcaatctcgccttgaggaggaagaggatgccaaagctgctctgatgtgcagaatacagcggttgaccaagttaatacttgtttccacgaagaccaatattcctgctttgacagattcgtctcggcttcagcgccaaaattctgttagtgaggaagataagttaagctcttcccaagatagtactacggtagtccaaaatgacagtacatcaaaggacaccttatcatctgctttgcctgatccgttggatgagatcaatggactaaggtccgctagcggagatccttcttcagtaactggttcaggacaagattcaatgcaggtgggaatcacggaatcagatcatttggatctattgattgagcaagttaagatgcttgccggggagattgcttttggtaccagttcgctgaaaag

SEQ ID NO: 105086 - DNA, 374 bp, Triticum aestivum
  Clone ID: PAT_TA_105086
gcggccgcgtcgacggcaccctgaagaaacaaataatggaagtgggaactggaacaaagctggctcatcagaccaagttggtggcagtgattggggtaaaccgaaattttttggcggtgctggttcatcaagctggaacaagggagaggcagctgagggggataatcagaatagcacctggagcagaccttctggaaactttgaaggtggccgtgggttcgggcgaggacgtgggagaggccggggccgggaatcttgggattctggtgacagaaatgaccaagaaagccgaaagggctcatggcataatgacagttctgcaaagccctcttgggggtctgatacacaggtaggtaatgaagtcgacgcggccg

SEQ ID NO: 105087 - DNA, 532 bp, Triticum aestivum
  Clone ID: PAT_TA_105087
cgaattcgcggccgcgtcgaccaaaatttaatacaattttactgtaatgttttttaaataattcattatttttaaagacaactgtagtgaatgaaatgaatataatgactatttattttacttatgttaaatattaataacagttgaattttatactgtttatttagttcaataatgataggttttttaaacatttataaatttgaaatatttattcactatggtagtaaactattttgttcattttgcgttgtacgactagatgaaattcatgcttaagaaatatatataggaagccatataatactatcatagggtgcactagccaaaaagtgtgattttatctgttttatggttattttgttttcttaatcatgattatggtatgtctatataatgatgccttttgtttctccaggaaacacaatgaatgttcacttattcaactactttacagtgtttgcgagacataacttaagttatgtgaggaggaatgaccttattgttttgttaattatatttatattatgta

SEQ ID NO: 105088 - DNA, 415 bp, Triticum aestivum
  Clone ID: PAT_TA_105088
cgaattcgcggccgcgtcgactcgcggccgcgtcgaccctgctcaatacagattgcagcctattagcaagattctcaattccagttgatgttagaagagaacactcgcttaaatttagcgaactcagagaaggtgctgctgagatgagtttgtctaacccattatcagaaagacggtaatttcccatcagagatatttttcttaataatggcatgcaatttggaacctttgccaaggtagtaggcaaaatatagtcaggcatgcatcgcccagataagtcaagctctaaggattcagtcatgcatttcccaaaaacagcctcaaagtcatcctcattcaaccacgaacactccctaagctgcagtgccacaggattgtcacacaagatttcagtaagaagatgtcgacgcggccg

SEQ ID NO: 105089 - DNA, 516 bp, Triticum aestivum
  Clone ID: PAT_TA_105089
gcggccgcgtcgactccctccatgccacagccacagccacctcccacgctgcccccgccccagatcgccgccgacgtggccccaccttcctaccatccccagccaactcccttccctgcctctaaacaacaccggccgtccacctcccctggcgcgtcgatccgcctccatccatcacggtacatcaccgccatggctagatccgcgagatccgctgcgccacgcctccaccggcctagcctcgcgctggcgcctccaccgagtcaaatcccacgctggagccccccaaccttcttctccgccgacgcacctcggtcggcagcgaatcatcccctgcgacacggcgcggccccgtcccagaccggcagcgaatcatcccagctctccttatcggcatcgtcctgggccctgccgcgtcgatctctggccgggtccatgcatcccgcggctgaaggtccccgccggatctggacccttctcgtccaacgacgacaacaaattctccggccggcccca

SEQ ID NO: 105090 - DNA, 261 bp, Triticum aestivum
  Clone ID: PAT_TA_105090
cgccgcgtcgacctcccggcgtgcgtggtcggcccgctgccgctggaccaggcggtggcggagatagaggtcatcaagggcagggccgaggagctgagcgcctgctactcgcgctacagctgcatcggcgagcctgtctccaacctcgtcatgctgcagcagcaacaggcttccggccgggccgccgacgcagcagcggccgacatgctagtcgaggcacgggattcggcgaagaggcagcaattcctgggtcgacgcggc

SEQ ID NO: 105091 - DNA, 318 bp, Triticum aestivum
  Clone ID: PAT_TA_105091
gcggccgcgtcgaccgcatccacacctacccgttcggcaaagatgaagctggggtgttctcggtttcttctttcttgccatgttcttctctgcctttcggcgatttgggtgctggccatggccgatgtaccggccggccagcgtcccggctgcctggccaagtgcggggacgtcgacatcccgttcccgttcggcatcggcgacaagtgcgctttgcacagcggctttaacctcagctgcacgaacatgattttggatggcgtcaagaagcctcaagcgagggatatcgaggtgactaagatctctttgtctgacgcc

SEQ ID NO: 105092 - DNA, 582 bp, Triticum aestivum
  Clone ID: PAT_TA_105092
gcggccgcgtcgaccatcttcactatcactgaacattaaagctttaccacaatctgcattatagtaaatattttgtcgatgaaatgcagattggtcttcggtcatcctctggttcctgtccaaaaacacccatgttgtataaggtggaaggcctgacactgttggtagttcaattggcttattagcattctttgcagtgagaattccacccaaagtagcagtcaatgtgccatacggactatcttcttgagaactgccaccatctttctcagcaaggcacagttcaagaccaagcgttgagcacgacacatcgtcttgcctaggtgtcagcagattcgtggctaaacctgtaccatccaatgcactcatttgccagattgttgaagaaccgcgattgctctgcataatggtgctgagcttaatcttgttattctctaccatatccttaatctcagcagaacgaagtgtcgcgaactcattcttcaacgagttaacataagttgaaacggagacctctcctaattctccatccggtatagcctcatcatcctgaggaacctcggcggcggcggcgatgcgcgt

SEQ ID NO: 105093 - DNA, 513 bp, Triticum aestivum
  Clone ID: PAT_TA_105093
gcggccgcgtcgacctgctatgtgcggcggagcgccatgcagtctgcgtatcctgattgtgctgttcgttcgacggctctggtcctcttcatgacccgtccccattcgatggacaccccgtgctaatcatctccccttgcagtccacacaccggatgcgagcagagcatccgttggctcggtgcagctcgctccgccacatatcacgccttttttttgcagattgtttgtagcccacttcggcgcctctgaagtatgtggcgcatacaggtgcaatgcagcaaacacatgcgtgcagtccccagcagaaacatgcatgctcacccctcgttggagcagcacggtcatggcgatgcagtgcacttcaattccgcgtggagcagcacggtcatcgcgatgcagtgcactgcgactccacgtgtagtgcaaattttttggaagtgcaataagtttgtgtaaaaatactatgtttcattacccctatgtatgaagtgcaatttctttcgtgtttttg

SEQ ID NO: 105094 - DNA, 551 bp, Triticum aestivum
  Clone ID: PAT_TA_105094
cgaattcgcggccgcgtcgactccagatggttcacttcctacaatagatcaccctacagtactatcaattatttagtcagagaatcatactatgctgaacatattggtggatcaggtacagcaatatgcacccaatgtttagtcatatgaagagagtgaaaacagtgtttactctgaatttttagacagattggcattgcagctggaagtttgatgcgctggatctcccctgacgcgggaacggtcaagttaaatttagatgcttcgttctttgctgagacttggaggtgctgtattggggccatcgccagggggcctgtcttgtctaaacagactgcacttgctgttgaaagaactgtcctcgcccgctcccagccgatatgtatgattcccaactttatctgacattaagaccagctcttcatttgtttctgtccaattccgggcgatcaacaggaaccataatactattgcacatgcccttggtgtgtgccagatctaaagacaacatactcaagattgcagatgtccttgcggagctacgtggagca

SEQ ID NO: 105095 - DNA, 682 bp, Triticum aestivum
  Clone ID: PAT_TA_105095
gcggccgcgtcgaccgagcgccagcctctgccaagtcctagatgctcctggtaaggctgcccctccactaggatgcctccttccattgggattctgcccgccgcagcctattagttggccaccgccatccgcaagccattcaactttgcatatctaggactttcgctggaagcctactgcaaaatctcccgcaaaaattgaccattgttgcatgccagctttgcatgatgcaccgatcctgacgagacgtgaggcactctcctggtgcttttctgcacctacacctgcccccatagataccattatcttgttctcttcttttttggaattgaagttcacacataacagaggaagaaaagttcagagagattttgcatacaaaattcagaaaaatgctattcagatagtgatgcacttttttcattatatatgtacgtacatgtttatgctagctcgtactctcttttgctatcactttgttaaggttctggatttgaaaactatgtgcatgttgaagagaagcaacaatctgtgcgagaagttcaaatataatgacaacacatgttcatgtattaccaagagagtgagaggaggccgagcttttgcaccacatccaacacgacctcccgtccggcgactccgtgagccagagcatgcacgtcctcgtctgccttgtatgctg

SEQ ID NO: 105096 - DNA, 634 bp, Triticum aestivum
  Clone ID: PAT_TA_105096
gcggccgcgtcgaccggatggcacaacttctagatgagcgtgatctaggtgtgctgacatctgtcatgagcctttttgtctcactagtatctaataatgctgaagcatattggaattgccttccaaagtgtgtaagaatattggagaggatggcaagaaaccaagatattccccaagaatacacctactatggaattccatctccttggcttcaggttaaggcaatgagagctcttcagtacttccctaccattgaagatcctagtgcaaggcgagctttgtttgaggttttacagcgtattttgatgggtactgatgtcgttaaaaacgtcaacaagaataatgcctcacatgctgtcctctttgaagctcttgctctggtaatgcatcttgatgctgaaaaggagatgatgtcccaatgcgtggctcttctcggcaagtttattgctgtcagggagcccaatattaggtatcttggtctggagaacatgagtagaatgctgttagtaacagatgtacaggatataataaaaaggcaccaggctcagatcattacgtctttgaaggatccagatatcagcattagaaggcgggctcttgatttgctgtatggcatgtgtgatgttacaaatgc

SEQ ID NO: 105097 - DNA, 506 bp, Triticum aestivum
  Clone ID: PAT_TA_105097
cgaattcgcggccgcgtcgaccttctcttctcaaaacttgcctcttgtgcctgggtatatttccagaggatactgttatcgagaagaaatgtcttataaggagatggattgctgaagggttatttcacaaagaaggcagatatacagtacatgagttgggggagatgtgtttcaatgagcttgtcaataggaatttgatccaactggtgattgacgaacaccataagctgaatacttgtagagttcatgacacaattcttgatttcatcatatccaagtccattgaagataactttgttactttggttggggttccctttgtaccagttaatgtcaaacggaaagttcgtcggctctctatccaacttgatacacagggaaattgtatcgtgcaaaaaagaagactggtattgtcccatgccagatcactcaatatttttggaaattcaggggaaatgtctcgattggatgaattcaggcatttgcgtattgtagattttggatgt

SEQ ID NO: 105098 - DNA, 512 bp, Triticum aestivum
  Clone ID: PAT_TA_105098
gcggccgcgtcgacgccctcgccgccggccgccgcggacgcgctcgcccagatcctgcacgcgctgctcccgccgctcctcctggccgcggcgtccgccaacgcgctccactcccgctggcgcgcgctgcacgccacgctgctcgcgctccagtcctcgctcgtctccgcgcccgctccggccgccggccacccgctcttcgccgatctggtggcctcgctgctcccgcccctccgctccctccacgcattgtccgcgcgctgccaggacccggccctccccggcgggcgcctgcgcctccagagcgacctcgacatcgccgcttcctcgctcacgcttctcctgcacgacctctcgctgctccttcgctcggggctcctctccgtcgattcgtcggcgtcctcccccaacgccattgtgctgcaggtgcccgcggcggccgcatcccgctccgacaagtcgctcttcatcagggacgcctttgcgcggctccagatcgggggcctcgacct

SEQ ID NO: 105099 - DNA, 568 bp, Triticum aestivum
  Clone ID: PAT_TA_105099
cgaattcgcggccgcgtcgacacaatctccaccggtgcagtggagcaccaccaccacaatggccatggacatgcgaggggatgccgaggctagtgcggccatggcctggagctgtccccttctcccacgcggggactccggcgaccgcagagcccagctacctacggatcccaccggatccccaccgctaggcacgccacctcctgttgcagtcctccctccccgttgcaggacaggcatctcgggcttgtagtgcgtcggggcacgcgatgtggtttggcacacgtggccgtgcaggtgcatcacgccccgcccccaacaaacacgagcagcagtgcgtctggcagtgaacacaatcgagtacccttctcctctgctcccttccccagccgacatccatggaggtgcatgtgacgtcatgacgacgagttcattcttagttggcaaggtaattcatttttcaatatggtgtgcagttccatcagtgtggttgtgcagcacacgggcgtgggtttgaaatgtggtgcccatctacgtgcagcccatgatgatggccatatccgttggg

SEQ ID NO: 105100 - DNA, 594 bp, Triticum aestivum
  Clone ID: PAT_TA_105100
gcggccgcgtcgacttcaagcatggggcagaagaagctaagaaggcatatatggctgctagagaggagtcaggcgacaccacagaggttgcttcagaggaaaaggtctcgtcagcgctgattgacaaggttgatgctatgcttcaggaactagaaaaggagattgatgatgtggatgcacaaatcggaaaccgctggcaactgcttgatagggatcatgatggcaaagtgactcctgaggaagtagcagcggcggcagcttatctcaaggacaccatagggaaagaaggcgtccaagagcttatcagcaagctttctaaagacaaagaaggaaagatccgtgtggaagacatcgtgaagctggggtctcaagccgaggaaaacaatacctccacagattgacctggcggagtattgccaatgatcagtttaacagttgtagaagcatatcttttatgaaaacatcattaggcaaatataccagatgtacatagcacctcatcaaggttttatttggtgccttggtgatgcatccaagcttctatttccatcagtggagcgagcgttctctgctggcaccgggtcgacgcggccg

SEQ ID NO: 105101 - DNA, 555 bp, Triticum aestivum
  Clone ID: PAT_TA_105101
gcggccgcgtcgacatcaattcacttctctagtatttaaaatatacatgttaggaatgaccaacagtacttcttctctcaaagctgtcaagaaaatacagccaaatagagaagttagaaggactttgagctctaaactccaggtatcaatccacttgactatctaccgatcaccggccaattaatttatgaatcaacggatttatctataagggagtaattgtctgtaagataggacttgcttgcatgcatttcatagataataaatctgtaaagagaagttaggaggcagcttacatatctgaatatttacacttcatatacagcgacagtatatcctcgattcagaggtaggacagaagaccgtccggacagatctccatagctgcaaaaagtttgaataatctgcgaactccgtcagacagtaatattaaaaattccttgttttattaatatattcacatctagaggaaggagatatgtcaacaggggaagaaaagcaaccatcaatcgtgctaaagttatctctccagagtggcgtcagtccaaagacact

SEQ ID NO: 105102 - DNA, 496 bp, Triticum aestivum
  Clone ID: PAT_TA_105102
gcggccgcgtcgacttttttttttttttttttttttgctgctcatttctctatttatttattaaataaagaaagaagctcatttgtgcccttccgggagtagaaaccgagcgctttcacattggggggaaacctttcccccgatgcttactctctcttcttcccatatttggtgaaacacaatctagcactagcagtactctctagatctttacattgcttaatcagttgatcacactagtagctccacagcgacgtgtcgaatccgtcgtcgtgttcgcggtcctcctgccaagctccgtcggccggcggctccatgagcatcccctgcgccaagctcgcgtagtacgacccggcctccatgccgccgatccagtgctcattgtcgagccccgacaggtcgctggggatgatggagagcgcgctctcctcggccgtggacgacggcgccgttgactcgtcggcagggcgctgctgctcctggaactccttgaggg

SEQ ID NO: 105103 - DNA, 467 bp, Triticum aestivum
  Clone ID: PAT_TA_105103
cctcgaacaagaccgcggcagtctggtacgctttagtgagcagggcacggtcggccttgtcggcggcgttctggagcgcctggatgtacttcttgtagtactcgcggtagaagcgctgcatctcgcgcgcgtcgctctggtgcaccctccccttgagcgtcgggtcgttctccctctcgagcctttgcagcagcgcggtcttgaactggcgcactccacggccgctggaggtggggtcgagccggtgggccttctcgaaggcgtagaagcggcagaggtatgcgacgcgcgggttgccggcctcgacctcgttggcgacccggaggatgggcgcgatctcgacgagcgaggagggcacgacctcgctgtcgaagatggactcccccatgttgccgacggtctgcgtgcgcagcagccgcctccccgcggacgacgcccccgccggcgacggcccccccggcgacgcg

SEQ ID NO: 105104 - DNA, 530 bp, Triticum aestivum
  Clone ID: PAT_TA_105104
cgcggccgcgtcgacctttccccggctaaccgctgaggcgccgacgagtcaacacacctaagatggcgtcggcggcggcggcggcgctggcggcggcggggaagcgacagttatccgaggacgacctgtacctcatcctccacaagtactcgccggcgacgatcctgacggcgctccaggaggtgacgcagcacgcgcagcggaggagcatcgactggcgggcgctggtggccaagacggccacggggatcacctccgcccgcgagtaccagatgctctggcgctacatcgcctacgggtacgacttcgtcgagaacgtcgaggacggcagcccccagccactgggtgatgagagcgacttggagtgtgagattgaaccctctcctaagccgagcaacgaagccgcagccgaggcctcacggttcgccaagatcttgatgtacggaccttcacgcgagcaaggttctagtcatcgtgctaactcagatgttcctctgctaaacactccaaatgaaaagtcgacgcggccg

SEQ ID NO: 105105 - DNA, 332 bp, Triticum aestivum
  Clone ID: PAT_TA_105105
gcggccgcgtcgacataaattgtaccttcaagacttgcgtttgcacgctctactctttgccttgagcttccgccaacttctgcctctactccttggccttgaggttccgccaacttctgttgtacacatgaaagtgtatccatcgttgttttcatgacaatgcagtgtcccaatagtttctggaagctcgtctgcctctgcttgcaatgttatttcatgattttcaggaacagatccactggcatcagtcctgattgatggaatcgtgggcacgactacatcagccgcgtcaactcgccctacatccgcttgcaccctggtcgacgcggccg

SEQ ID NO: 105106 - DNA, 617 bp, Triticum aestivum
  unsure (1)..(617): unsure at all n locations
  Clone ID: PAT_TA_105106
taagtctcgtattcttttcttgtgcacctacttctggtttgctgtgtgggctgtaagttgtaaacgggtataaatgtgaggggttgtgcatttccatggtcacagtttctgttttgtccgtaaaagattatgtgatcttttcataaaaagtaagttgtttcattgaatggtttgtttgaagatgttgttagaacacacaattaacaaagataatcaatgaactagatatgtagatttaatgtggaacccaaatatggaaagaaacaggcacacaccaaacgtggtgaactacaagaaggggagtttacactggcgtcaactaatccatgcagctataaaggctatacataagtggcatgtgagaaatacatgagcaaatccgaaaattatacacatgagtggctgttacatacttgttgtcaagtaacaagttcctgaaccgattgttgcctttttgcctgagttgtggtcaatgttgacctctgcaaaggatcatggaagaagcatatttttttatcctggaacttaacacacaggagtaaaatnttataccaggtacatggtaaattgctaatgcagactgaaatcgccatgtttcttgtcatccatgtcactca

SEQ ID NO: 105107 - DNA, 494 bp, Triticum aestivum
  Clone ID: PAT_TA_105107
tggagcaaatctgaatcggccggattacgactccctccatcgacgaccaagaagatgagtttcggagtcgatgcttcgcaggacctgcaactgcctgctagggtgcaaggcgacggccacgacaccggagtggtcatcaggcagagcgtggaggccgtgcctgtccggcaggggtggcagaccggcctgttcgactgcgaagacgacggctgcgacgcattttgctgcagcgtgtggttcccctgcgcggcgttcgcctgcgtcgccgacatcgtggaccagggctcggacggccggtgcgtgcacttcacctgctacctcggcgcggcctacttcgggctgtggtgggtgtacacggggtggtaccggcgcaagctgcgggagcagtacggcctgccggagacgccgctgccggactgcctcacccacctgctctgccactggtgcgccctcgctcaggagtaccgggagctcgccagacggggattcaacgt

SEQ ID NO: 105108 - DNA, 480 bp, Triticum aestivum
  Clone ID: PAT_TA_105108
cacttctctgctctcttcacaactgctagagagatccctcaagagtccgatcttcacaagaaatggctactggtgctagcggaggtagaactcaacagaacaagccgagcattttgagcacattacccaagcatctgccattagactttctgaagagtatcacagatcagttctcagagaagcgtgtaattggtaaaggcgcttttggaaccgtttatgagggaactgtgccagatggggaaaccattgctgtcaagaaacttgccgaaaattcgccccttccacgagatagagcatttaataatgaggttcaaaatattatggctctccagcatgaaaatgttgtaaagttggttggctactgtcatgaaagtcaaaagaaagtggtgcagaacaatggaaggtatattgttgctgacattgttgaaagtgtactctgctatgaatatttaccagggggggagccttaagaagaatctt

SEQ ID NO: 105109 - DNA, 225 bp, Triticum aestivum
  Clone ID: PAT_TA_105109
gcgatgatgagcaaattgatattggaacaaatctcgattataagagcacatcatcacacattgatctgaataatttgaatgtcgacaatgatgagccggcatatgccgctacagcaactgagaaattcggtgcaagcaatctagacctgccatcagaatttccagaaagcgaattcttggtgagtaccaggttagatccaagtctagttgatggcgaatatcctg

SEQ ID NO: 105110 - DNA, 321 bp, Triticum aestivum
  Clone ID: PAT_TA_105110
cttcggagctcgggatcggcgatggagaccggagcgaaggcgccgaagaaggccgggcgccgggccggcggcggcggccccaagaagaagtccgtctcgcgctccgtcaaggccggcctccagttccccgtgggccgcatcgggcgctacctcaagcacgggcgctacgccaagcgcgtcggctccggcgcccccgtctacctcgccgccgtcctcgagtacctcgccgccgagctcctcgagctggcggggaatgcggcgcgggacaacaagaagaaccggatcatcccgcggcacgtgctgctcgcgatccgcaacgac

SEQ ID NO: 105111 - DNA, 534 bp, Triticum aestivum
  Clone ID: PAT_TA_105111
gctccgtcgataccaccgtttatagtgccgaagcaatccaaattaaatggggatgattcagtattcctgaaagaattggatgatagaagatattctgaagtggctgttgctggaggaggggtatcggttgcagtaactcgctttcctcctgagcagaaaagacctattgggccacttgtcctggttggtgtcagagacggagttctgtggctcgttgacaggtatatgtgtgcacatgccttgtctctcagccatcccggtattagatgtcggtgccttgcagcatatggagatccagttagtgctgtcaaatgggctactagacttggccgagagcaccatgatgaccttgctcaatttatgcttggaatgggctatgctactgaagcacttcatttacctggaatatccaagaggttggaattcgatcttgcaatgcaaagcaaggacttgaaaagagcacttgcatgtctactgacaatgagcaatagccgagacgtgggacaagaaactactgctactgatgttacgcag

SEQ ID NO: 105112 - DNA, 475 bp, Triticum aestivum
  Clone ID: PAT_TA_105112
ctatgagccccctcggcaactccgtgatctgtgcatacagcatggttttagtagggtcccggcgtggtttaattgctcgcttcttccaaacctctccagcctagacatggaagtgggtgattttggggagcaagatgtgctgaactttgggggtttgccagagcttacttgcctttggaacgcgattcctgggggcatggaattccctgatggtgctttccccaagttgagaatctgcagggtgcatgcgccattcaggtttctgcagggaagtatgcagagccttgaatccatttatatcatagtgcacgtgcgtgccttgaaggatgccagcactgatttagactttattggtagcctgggggacctcccttcggttcggagagttgacgctcagatcggttgcaatggtgcctctgcttctgatattgaaaaggtgaatgcagcggtgaggcaagcaatcgacacccatccc

SEQ ID NO: 105113 - DNA, 435 bp, Triticum aestivum
  Clone ID: PAT_TA_105113
accaatcctcctctgccccccgatccccaggagctcacctgcaagcaatggacgtttcgggcaccggagctggcgccaagggcaataagggcgcggccgggcgcaaggccggcggccccatgaagaagtcggtgacgcggtccgtcaaggccgggctccagttccccgtcggccgcatcgggcgctacctcaataatggccgctacgcccatcgcgtgggcaccggcgcccccgtctacctcgccgccgtcctcgattacctcgccgccgagctgctggagctcgccggaaacgccgccaaggacaacaagaagagccgcattatcccgcgccacctgctgctcgccgtcaggaacgacgaggagctcggaaagctgctggcgggcgtcaccatcgcgcacggcggtgtgatccccaagatcaacccggtgctcc

SEQ ID NO: 105114 - DNA, 624 bp, Triticum aestivum
  Clone ID: PAT_TA_105114
agcagtataaatgtttctgataagcaacattcccgaaacgaggggcatcaggctagaacaaggaatgagaatgctgctgagtctcagaatgctgcaaaggctggaaatgggccatactctactgacgtcgcatgcaacggcgcttctaatctgtcggagaaaggcctaagagagactggtgaaaagagaaaaagatcaaccggacatcacgatgtgcagagggatgattcctcggattcctccgtggaatctctgccagatctggagatctctccagatgatgttgtcggtgctattggtccaaagcatttctggaaagcaagaagagctattgtcaatcagcagcgggtttttgctgtccaagtgttcgagctgcatcgactgattaaagtgcagaagttgattgcagcatctccacacctacttattgaaggggatccgtgccttggcagtgcccttgtgacaagcaagaagaagacggctgcagccaatgtggaaaagcagcttctgtcagctaaaagcaaagatgacgatgatgcacagcttaccctgcagcaggcggagtactcgaaagataacactgaaggaaaccaggcttcaccatctcaagacaatgacgtagtc

SEQ ID NO: 105115 - DNA, 334 bp, Triticum aestivum
  Clone ID: PAT_TA_105115
tcctcccgttcccctccgcccttgccctcatcgaggcgaccggccgaccgatcggtctgaccccaaacccctccgccgccgcccgcctccccatggccggccgccgcgcgccgcacgtcatgagccttcacgactccggcccgccgctgctcggccgcgcgccgcagcaccctcatcccggcgacgaccgctacgagcccccgcacggcgccctcctccgcacacttgaattctgctctgatgagagcacggaaagcttctcggaagagcaagagaaagcgctacagctcctcacctcccttcacaatctaagtgtttcaggctgctgcgatct

SEQ ID NO: 105116 - DNA, 441 bp, Triticum aestivum
  Clone ID: PAT_TA_105116
cgcaaggggctctgccagttggatctggccgcctcgctccctcgcacctgtgtgccggggagcgacaccgcacgacgcagaccgctggccgccgcgtgcaccgggcacgtctcagccaggagcatcggtatcggggccgggggccaccgtgcgcactatgcgctagccatgcctccagtgggtcggtgcagccaaggtcgccgtctcgtcgggggcaacgtgagggtgcgggcgtcacgggtcgccgtcatcgtggacggtgagcgtgccgaggatgccgcttgcgcgtgcaggccgggcgtcgagctgcatcgacgtcgttgaggtccccgacagcggcaggtgctagcggcctcctccgccgcgtgatgcggctgtgctgcggagagccgggccgagggccactcttaggagcagcgtgtcgtggctgtggtctccact

SEQ ID NO: 105117 - DNA, 527 bp, Triticum aestivum
  Clone ID: PAT_TA_105117
gcttgtccccctgctctctcccttgccttcatgtccactgcaagtgaatggcagcaagaccatgatgtagggaagaagatcaagagtgagtcggcggcggaggcagaccggatgatggcggcggcacggaggagtagcagcctgcctgcagcaggcgccggaccaggatcgacaccgtcgttcaacacgatgaccccatgtgccgcgtgcaagttgctccggcggcggtgcgcgcaggagtgccccttctcgcctttcttctcgccgctagagccgcacaagttcgcctccgttcacaaggtcttcggcgccagcaacgtctccaagatgcttctggaggtgcacgagagccagcgcggcgacgcggccaacagcctggtgtacgaggcgaacctgcggctccgcgatcccgtctacggctgcatgggcgccatcctcaccctgcagcagcaggtgcacgccctcgaggccgagctcgccgccgtccgcgccgagatcctcaagcacaggtaccgccctgccgccgc

SEQ ID NO: 105118 - DNA, 171 bp, Triticum aestivum
  Clone ID: PAT_TA_105118
tccttgctattcaaagtgaacaaccctgaatgtaatctgtagtttccttgtctttctgtagtgaaaactctgaatataatcagtagcttgatgaaaatttaccttccaacttgaacttgtcttctatcttgatgagtgtggttgtaatgaaagtgcgggattccgtcgaca

SEQ ID NO: 105119 - DNA, 456 bp, Triticum aestivum
  Clone ID: PAT_TA_105119
cttcctccgcctccctccggacgagccggagcacctcgtgcgcacctccctcgcctgcaagctctggctcggcctcctctccggcgctcgcttccgcggcctctacggcgagttccatggagctccccccatgctgggattcctctacaactggttcttttgcagcggccccaaggaggatgaccccgtggcaaacttcgtctccaccacgaaattcggtgcgctcgttcccgacggcgatggctgggaccgtcagtacactccctgggactgccgccacggccgagtcctcctcggggactacactgggctcatcgtttgggaccccatgacaggccgccggatgaagctggaaccgcccgtcgggtatgttggcgctgccgtgctctgcgctgcgaggggctgtgaccaccgtgcctgtcatgagggccccttccgagttgtcgtcatcggcct

SEQ ID NO: 105120 - DNA, 420 bp, Triticum aestivum
  Clone ID: PAT_TA_105120
ggttttcttttgttttcgattatgctgctgcttgatctataactaaagggtacacatagtccaactctgtattctgagaaatgcattttttactccgcttcgtagtaatatgtttttcaccaacatatattgtgataggaaagagatgtttcatgaattgacaaataaattttggcacctgctgttctcacctctcgatgctttgcatctcataattatgccataggttttaaggtgacacttctgtcatgcaaagtggaactaaagtagcaaaaacagaaattgtgattctgtaatgcacatctgctaaaaaaacttatgagttaagaaaagaaaatatgttgttgaaaaaatttagggcagcttacataagaatcaaatcctatattgattataggtctttttactatcatgtttttc

SEQ ID NO: 105121 - DNA, 484 bp, Triticum aestivum
  Clone ID: PAT_TA_105121
gccattatacatactacccgttcccgccctccgtcattcttcaattccataccgcagtaattctccgactttaacactcgctctctgtcgatcgacgcacatcttcgccatgtctagccatccacgatactacttctcgctgcctactgaggcgcctgcacgatctcgctcagcaagccggcggccacctctaacaccatcaaccgtttcttcgccatgcctcaccacgcttgtgcctgtaacctctcgacgggactctggaacatcaacatccggtagcccgaccaaggcctccatcctcctggccaaggttgcttcatcgcctactacacctcgaggcgagacgccacctggaagcccgatgctcactccacgatcgaggttgcagtcggaaccggcctacacttctgagaggccttccatgtcaagaaccgagagtgaccgctacgtccgccaatacaggcagcaggatggctacatcagc

SEQ ID NO: 105122 - DNA, 513 bp, Triticum aestivum
  Clone ID: PAT_TA_105122
atcatccttcattttgagcatctcgggtgctcttttagccctttcgatcgctagggcatggtgttcaacaaattcattggcaacaatgtatatccctttccctccttgcttggagacattctctccgccatcatcctcgttttgccggcggtgaccaggtctgaagcacgtgatctttgtttcgccagtggtggccaagatattgttgctgatcaattttcctcggtcggtggccacgggttgcttttgggcatataggctggtaagtggctgccagcggcgaggcttggcgacgaggagcctgtgtggatgcgtagaagacagggagtgtcgcggcggcagttggcagggggcggagccacgttggagccaacctgggctgtggcctgcccagcccaggagcaaacgctgcccaactagtctccccttctagcctggcccaagtatttttgggggctcttcttcaacctggcccgcccaaccagttgactgtagctccactggcagttggag

SEQ ID NO: 105123 - DNA, 497 bp, Triticum aestivum
  Clone ID: PAT_TA_105123
tcctcaattactacaaagaaagtttcagcatggttcctttgtaccacagggacaagatcgttcttgttgcttttggaggaaacaaaaaagatccatccgacaaggttgaagtactggtggtactgcaaaacgaccattcttatagctggcggtctgccccagatgtagacccattgctgtatgaatattctccaagcaccaaagagctcgccgggcatctcaacaaatgtgctcccttgtactctaatagttctgttgcaaggcacagtctcacctctacagtcgagcgtgcgtctagagaggagcatggagctctgggcacttcgctccacaggaagtatggtcaggtagaagactgcagcagcttagcccaaaagcttgagaaactgatcgatgatgacaaatacgatgatgtcgatgactgttcttcatgtccagcaagcaccccgaaagatcaccggagcaagaggacaggggccgatactcggactgacatg

SEQ ID NO: 105124 - DNA, 424 bp, Triticum aestivum
  Clone ID: PAT_TA_105124
gacggtgacagtgagtcagtgacaaggcggtgaggcgtggtgcgggccgacgatggcgtcgaccccgccgccgcgagatctcacgcgcctcgaccccgccgccccgcccacgcgagatctcgccggtctcgccctcgccgccgaaagatctcgccggccccgccctcgccacggctctcacgcggccacgccgtcagggcggtcgcctgaccggcgcagttcatcgtcatccgcctgtgaagatttcctccgcaagtttgtggacagcgagcttctcactgcaagcctagaggattggttttctggggacagcgaggactgcggtttccggaagccggctttcgatgttccttttgaccttgcggagctgcagaattttgactatgctttggaaggtgttacttttcagcagctagtgcggatg

SEQ ID NO: 105125 - DNA, 307 bp, Triticum aestivum
  Clone ID: PAT_TA_105125
ggatacctcgagtgacctctcccaggtggagatgccaacgcagcagcttcaggtttgacacaaatatgacatcagcgtgtggcacacgcagtctcctcaagccatgccttcctcggtgccgacagatcttaccaccatcaccaccattgggggaggcccctaattgagatgcatctccgccagatcgagaggcgactgaccacactagatctagattctggcatattgattcagattctggatcaatatcaggtgccagcgatgtcgctgatgcgctacttctattatgcaacaaagcaggtcatct

SEQ ID NO: 105126 - DNA, 452 bp, Triticum aestivum
  Clone ID: PAT_TA_105126
gtactgggaggccagcctcagccgccggaacgagcacccggacagggtcctgttcctcaggtacgaggagatgctccccgaccccgtgaggagcctgaggacgatggcggagttggggtgcgccttctcccgggaggaggaggagcgaggggtggaccgcgccatcgtggagctgtgcagcatggggaagctcaagagcgtggacgccaacatgaaggggcggagggttcaggcgtcaaggccgacgccttcttccggaagggggtggccggggattggagcaaccacatgacgccggagatggggaagatggtggacgaggctgtggaggacggactccgggggtctggttttagcttcgccgacacaagctttgcccaaatgaaaacgacaaggtcttgaggccaacaaacgccgtagtccagcaccggctctttggcgacccttttttt

SEQ ID NO: 105127 - DNA, 287 bp, Triticum aestivum
  Clone ID: PAT_TA_105127
actcggcagccagtaccaacgacgcggcgacgacggcgagcgtgaccgcgaccgcgcccagcccccctacagatccgcgcggcggccggcgaggtgcgctcctcttcctccgtctcagctgctctcttctctcagatcgcatagggaaaaattgctcgcccgaagagttgcagcccatcccgccgcggcctcttctgtcttcctcgtcgtggtatccggcggatccgttcgatttggggcgggatccgtagttgtctacgcggggtcaccaaaggggtgaatgggtg

SEQ ID NO: 105128 - DNA, 344 bp, Triticum aestivum
  Clone ID: PAT_TA_105128
tggacaatgatttgaattcggcagaaacaaatgtggtcattgtgaatgcctgtttggtcgctgcagaagaagctcttgcattatcaatatggactatggctacagtttgtcgtgctttatccctgatgctagcattattcactggagttctgctggagaagcaaattgtggtaatatgcccaaatctgggcgtactgtcagcagttgttttatcaattataccaatgataaggccattccagtggcaaagtttactgcttcctgttctaccaggaaaattgattgatttcattgatgctcccgtccctttcattgctggtatccaacataaaccccctgatatc

SEQ ID NO: 105129 - DNA, 472 bp, Triticum aestivum
  Clone ID: PAT_TA_105129
tcatcgtcttcttccacctccggccgctagaagtacccttcgtcgccccagagaaccgatacagtgtttcgcgactcgccgtttcaaactgctaccgcctagtagttcgccacggctacatggacgaagtcattaccccagacctagcatctttgatctacgagaaagtccgcaaccacatcgtcgcacgggccctggaacgggagggtgagatatctgccaaggctaccggcgcccagccggagaaggccatggttaccgagactgtcgctggaagtggaatatcgactccagcacgcagctcaacgacttctgctcgtctggaagcacttgagcgtgcgtacaaccgtgaggtattgtacattattggtaaggaacagatgaaggttaaggttggtacgaacatcgttcgacgattcttcttgaaggctttcttgttcattcgggataattcgagagcgaagattgcgag

SEQ ID NO: 105130 - DNA, 369 bp, Triticum aestivum
  Clone ID: PAT_TA_105130
tggttgactagcaacagagcaaagtgtcctccaggttctgcatcatcagtgtgtacctctagattctgcatcattagtgagcaacttacctaaggttagttttctttgtacttacagcccactctgctcccatttctctctcatattcgcattaatcaggggctgctatctgtgcaatcatgatggtttctttatgccatcagaccccatcctgtagtgtcattttcctctcatcaggtaggagagttttaatagatatattgatagcaaacaatagcattgataagaacccggtatatggtggttttctttgatgagtatatgtgatacatagaaaatgtatatggtggtttccattctggtttacct

SEQ ID NO: 105131 - DNA, 175 bp, Triticum aestivum
  Clone ID: PAT_TA_105131
ctaccgcctcggcaccttccacgggtaaccgtcggggtgcctcatgtacgagctcgcccacacgctccgcaggaacaccaacgagctcctctggctcgcctgcgtctccctcaccgaccagttcgtccacgagcgcatcaccaacgagcgctaccaggccgccgtcatggagctc

SEQ ID NO: 105132 - DNA, 147 bp, Triticum aestivum
  Clone ID: PAT_TA_105132
caactgccatcgcacttgctgctggagctcgtggactcgtggtgcgccctcatggaagggcccgtcctccccaacctgccaaacacgagggtcgccgtcgtcaccggagggaacaaagggatcggcttcgaggtgtgccgccagctg

SEQ ID NO: 105133 - DNA, 305 bp, Triticum aestivum
  Clone ID: PAT_TA_105133
cgtggtggcggtgaagcggctgtacaagaacagctacaagggcgtggagcagttcgccaacgaggtggacatcctctcacgcctgcgccaccccaacctcgtcgcgctctacggctgcacctcctcctcccgcgacctcctcctcgtctacgagttcgtccccaacggcacgctcgccgaccacctccaccacggcaaggacgggggcggcgacaccctcatgctcgcgtggccgacccggctcggcatcgccgtcgagacggccgccgcgctggcctacctgcacgcgcaccaagtcctgcacc

SEQ ID NO: 105134 - DNA, 141 bp, Triticum aestivum
  Clone ID: PAT_TA_105134
gggtttatcttcaatctggggaagatttgggagaggatggctaatcttgccaacatgtttgctgtccttgacctggatggcgaggacgatcgaaaggaagtggaacaaccgacatccagcaagccagaagctgctgccacc

SEQ ID NO: 105135 - DNA, 485 bp, Triticum aestivum
  Clone ID: PAT_TA_105135
ctggtacctcatttttctcaagctctgaagacatgcacaagaatagatccgtcgatgaagtaaacaacatatttcaagatatgatggttagagtgcagctttcagataattttcttccctcgggatatttgaagactgtttgttacccatcaagttcaggaaaaccaagggtatcatatgaattggattacgtagaagacacagagataaaagttgaaggtgtattttatctactatctccacgatgacactggtgcctgtgcgcacgatgatggcatggtgacgatgaattggattacgtagaaggtcgtcttcccggagcaccacgcgctggccgccgtctccatctgcagccgcgccaacaagacagcattggggcgtggacgacaagaagtgtaggcatgtgcccagcataacggaccatgatggattgctgaggggatgtcatgttgcggctggagccatcatcgaccacgatgtcgcgc

SEQ ID NO: 105136 - DNA, 620 bp, Triticum aestivum
  Clone ID: PAT_TA_105136
gtgaaaattcagacttccagctctttgagaatcatattgctgtctatgagcgtgagaatggtctaccaaaaataactgtatatgacttaccggccagtggagaggcacttgggaaacttcagggtggacgggaaattgattttgttgatccagcatatgcagtggaacccgaggagtcacagttccattcatctattattaggtttcattatagctcactgaagataccaccctctgtgtttgactatgatatggattcaggggtgtctgtattgaagaaaattaatactgttttacgtggatttgattcatcaaattatgtatcagaaagaaaatgggctgccgcttctgatggaacacagatacctatctccattatatatagaaaagatcttgtgcagctcgatggctcagaccccatgctgctatctggctttggctcctatgaggtattgccgtattgggttgctatctttattaatcagaaaaaaatctttctgccatcatgaatatcgtagactattattttagagcagcctgtaattcatgctaatatccttggttcatctcggatgcaaatgagtcatttggaatgttcaagtactttttctttatttata

SEQ ID NO: 105137 - DNA, 219 bp, Triticum aestivum
  Clone ID: PAT_TA_105137
ccaactgtgccggaccaaaaccagtggtcctcatggagagggcagcaccagttgttaagaacaactgatccatacttcaatcctgctcctatgtacgtactaaaaataatcgtcgaactggtgctttactattttgcttatgtacttcaaaaggtgatagcccaaagtcctgcctatatagcagtgtatggctgtcctggtatttataaacctctaagc

SEQ ID NO: 105138 - DNA, 392 bp, Triticum aestivum
  Clone ID: PAT_TA_105138
ggtaaacacactcctacgatgaaggcctcttactgtgtgcgctcgcacttgcgtttgctgtggtgaccaccgacgcccagcgctgcggcaagcagggcgatggcatggagtgccccaacaacctctgctgcaacaaggatgggtactgcggcctgggcgtcacctactgcaatgctggcgccggctgccagagcggcgcctgttatgacaacaagatctgtggcgcgcaagccggtggcgcattgtgccctagcaaccactgttgtagctcaagtggtcgttgcggctacggcagggaatattgcagcaacgactgccagagcggtccttgctgggatctcaagtgtggccacctggccaatggcaggccctgccccaacaacctctgctgc

SEQ ID NO: 105139 - DNA, 132 bp, Triticum aestivum
  Clone ID: PAT_TA_105139
cctgccttctccgtgttcaacgtggaaccctactccgactgcggcggtgacacccctgtgagcatctcccgccgtctcgcctccctcaaatgcaaacacaacatgtctttctttcctttgacattgaaggac

SEQ ID NO: 105140 - DNA, 264 bp, Triticum aestivum
  Clone ID: PAT_TA_105140
cgccgccgcgcagggccccatgccggcgcccagatggccccgctccccgcaccgccggccagatccccgggcaccgcccctgcgccggtagccaccccgcccaccgccgcgtcgccgtctccgatggcatctccccctgccccgaccaccgacgcgccgaccgacgctccctccgcgatgacgccgtccgcggtctctgccacaccctccggcgcccgcatcggcgcccccaccggcacccccgcgagctccgccgagtactca

SEQ ID NO: 105141 - DNA, 549 bp, Triticum aestivum
  Clone ID: PAT_TA_105141
gagcaaggagcgcatcgagctgggcgtcgatgccgtcatcgacgccggcgaggtcgacgacccggccgcctacccgctgccaaagggtaggattaagctcgaccacctccgggacttcctccatctacgaccgcgcaacgacaccatcgcggcggttgcgaggatgaggagcgagctgacgttcgcgacgcactcattcttccgggagatgggcttcctgtgcgtgcacacgccgattatcaccaccgacgactgcgagggcgccggcgagatgttccaggtgaccacactgttcagccaggcccagaaggcggacggggacctccggctgaagctctcggccggagctcctcgccaggacgaggatgatggtcgaactgtcggtttcgagagtgacttcttcaagcgtcaggctttcctcaccgtctccggccagctgcaggccgaggcctacgcctgcgcactcagcggcgcgtacaccttcggccccacgttccgcgccgagaactcgcacacgtcgcggcacctcgccgagttctggatgatcga

SEQ ID NO: 105142 - DNA, 576 bp, Triticum aestivum
  Clone ID: PAT_TA_105142
cggcacgagctcacagtcaggcacttgatgaattagacaacttaagttttcaagggcgactgctacgtgttaaggctgctaaaccacttaataataagacattcgagtctagtcattttgctgttgatgagaaaatgaatctcaaggagagaaggttggaacaaaagaaaacatctgaaattggtggggatacaagagcatggaacagcttttatatgcgtcaagatactgtcgttgaaaacatagcaaggaagaatggtataagtaagagtgagttacttcatagggaagccgatgaccttgctgttcgtattgctcttggtgagacacatgtcattgcggagaccaaaaaatatctatctaggtctggagttaatgttgatgccttggaagaacatacttccaaaagaaacgagaagttgaaacgaagcaaccatgtgatattggtaaaaaacttgccatatagttcttctgaagaagatctcgctgcgatgtttcagaaacatggaagtttggataaaatcattctcccaccgacaagagtatttgccttggtagtcttcgttgaagcaactg

SEQ ID NO: 105143 - DNA, 503 bp, Triticum aestivum
  unsure (1)..(503): unsure at all n locations
  Clone ID: PAT_TA_105143
ggcacgaggggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcactnttgaccagcttgcactccgtgctccaactggggagaacactatcctgt

SEQ ID NO: 105144 - DNA, 424 bp, Triticum aestivum
  Clone ID: PAT_TA_105144
gagttcagctgcgtcaggcgcgacgtgctgctgcaggtcctggcggcggagctgccgacgggcaccatccgctactcctccaagatcgtctccatcgacgagcacggcgacggtgccaagaccctccacctcgccgacggctcgactctccgggcgaaggtgctggtcggatgcgacgggatcaactccatggtgggcagatggctggggctcgccaagccgtcgcactccgggcgctccgccacgcggggcctcgcgcgttaccccgacggccacggcttcccgcccaagttcttgcagctctttggcaacggcttccgcttcggcttcgtcccctgcaacgacaccgacgtctactggttctacacatggtctccctccgaagacgatgatgatggtgccgaggagagcggtaccaagatga

SEQ ID NO: 105145 - DNA, 314 bp, Triticum aestivum
  Clone ID: PAT_TA_105145
tcaacggcgtgtccctccacgtggccgagtcagggccccgccgccggcccggcggtgctcctcctccacggcttcccggagctctggctctcctggcgccaccagatggccgctctcgccgcccgcagcttccgcgccctcgcccccgacctccgcggctactgcgactgcgacgcccccgcggaccccaccgcctacaccatgctccacgtcgcccgcgacgtggtcgcgctcctaagaccacctccgcctccccaaggtggtggtggtgggtcaccactggggtgctcaagcggcgtggcattcctgcctgt

SEQ ID NO: 105146 - DNA, 451 bp, Triticum aestivum
  Clone ID: PAT_TA_105146
ctccaaggatgccgtgttatgatcacaacacggaaggaagatgttgcggctcttgctccagtgaggcaccgcctactattgcagccattgggtagcgttgaatctttcaagctattctgctctagggctttccacaacagcctgggccgcaagtgcccttcagagctcgaggaggtggcggctgctatagttgaccggtgtcgtggcctgccattggccattgtatcgtctggcagcctattgtccacaaagcaaccaacagagcacgcctggaatcaggtgtacaaccatctccggagcgagctgcgggggaataaccatgtccaggctatacttaatctgagctaccatgacttgcctggtgatctcaggaactgcttcctgtactgtagcttgttccgtgaagactatgaaatgtcacgggagaaccttgtgcggttgtgggttgctg

SEQ ID NO: 105147 - DNA, 236 bp, Triticum aestivum
  Clone ID: PAT_TA_105147
tgcgccgctgccgccgccgagttgggtcgcgtgatccgcgctcagcgtaagggtgcgggctccgtcttcaagtcccacacccaccaccgcaagggccccgcccggttcaaggcgctcgacttcggcgagcgcaacgggtacctcaagggcgtcgtcaccgatgtcattcacgaccctgggcgtggtgcaccgatggccaatgtgaccttccgccacccgttcaagtacaagcacca

SEQ ID NO: 105148 - DNA, 228 bp, Triticum aestivum
  Clone ID: PAT_TA_105148
tcgttgggagggctcgtagatctgtgtctggagagagggaattcttgacatcggaatcggaacaagcgggcgcgctcgggatcggggttaccatacaatttttcccacgaacctttagtgaatgtgctaatggagtcaaagggtggcaaaaagtctatcattactagttccctgatgtacgaagcacccctcggctacagcattgaagacgttcgacctgctggaggc

SEQ ID NO: 105149 - DNA, 384 bp, Triticum aestivum
  Clone ID: PAT_TA_105149
ctgcttcctccttccaccagtccacattcacacacgctctccctccctccctcccccaccttcgttccaccgctcgcgttccattcgctggcaggctagcagatctccgatggggtgcttccagtccaagccggcggggaagccgctcccgcccgacgccgacgccgccctcccgcccgacgactccgcagatcccgaggcggcgaacggagcggacggggcgggcgcggacggcgacgacaaggacggggcgaagcgggcggtgccggtcttcagggagttcgggctcgccgagctgcgggccgccaccaagggcttcagcgccgacctcatcgtctccgagagcggcgagaaggcgcccaacgtcgtctaccggggccgcct

SEQ ID NO: 105150 - DNA, 248 bp, Triticum aestivum
  Clone ID: PAT_TA_105150
gccgcggagctgggcactggactaccaagcacgtcgccgtgtggttccataaccgccgcgcccgctacaagagcaaactcatcgaggtagagttctccaagctccgcgcggcccacgacgccgtcgtcgtccacaactgccgcctcgaggccgacctgctgatgctcaacgacatgttggcggagacggaggaggagaaaaacaaggccatggcggcgtcggcggcggcaacgggcggcgggggtggc

SEQ ID NO: 105151 - DNA, 424 bp, Triticum aestivum
  Clone ID: PAT_TA_105151
ttgatgggaaacacattcctccaagtcatgcacttgatttgataaggggaaagaacatactgctattgatggattcctccttagaagggcaatatgctaatgacgatgcttcaaaattagtcgatcttgcatcaaagtgcttgcagtttgaagctagggacagacccaatataaagtatttattgtcttctgttgggcctcttcagaagcaaaaggaggtggcgtcgcatgtgttgatgggcatcacaaaaaccgcgtcggtcttacctactattctttctccacttggaaaggcatgcgccggaatggaccttacagcagtacatgatatattgctcaaaacaggttacaaagacgatgaaggtgcagaaaatgagttgtcctttcaagaatggactcagcaagtgcaagagatgctgaacac

SEQ ID NO: 105152 - DNA, 492 bp, Triticum aestivum
  Clone ID: PAT_TA_105152
cacgaggcgagcctcacactctctgatcacagtaggactagcttcagctagcctgcagcgtctgccactccgggcattttcttgcatcaaccacggcaatggccaccgctgatgtccagaacccgacggccgcgctgacggaggaggcgcccgcggtggagacgcccgtcgccgccgaggaggttgctaagacagaggaggtccccgcgccggtggaggccgaagtcgaggcgcctgcccccgtcgaggttgaggcgaccaaggaggacgcaccggccgccgccgagacgaaggagaccaaggagcccgagccagcagctgctgccgagccggaggccgaggcgccgaaagagccagccgtggtcgagacagagaccaaggaggcggtggcagaggccgagccggcggtggcagaggaggtgaaggaggaggcggcgcctgctgccgagccggaggtggcggccgtcgccgaggaagcacctgctgctgcgg

SEQ ID NO: 105153 - DNA, 476 bp, Triticum aestivum
  Clone ID: PAT_TA_105153
tacgggagctgaaaggtaccacaagcggcaccgggtgtgtctgcgttgcgcccattcttctgccgtcatgatcgacggcgtccagaagcgctactgccagcagtgcggcaaattccatatattattagattttgatgaagacaaaaggagttgtagaagaaagctggagaggcacaacaaaagaagacgaaggaaacctgattcaaaaggcacattggagaaagagatagatgaacaattggatttgtcagctgatggtagcggcagcggtgaaataagagaagagaatatagatggcgctagctgtgacatgcttgagactgttcttagcaacaaagttttagacagagaaacaccgatgggatctgaagatgcccttagttctccaacttgtacacaactcagcttgcaaaatgaccgaagtaaaagcatagtgacttttgcagcttctgctgaagcctgccttggtgcaaaac

SEQ ID NO: 105154 - DNA, 473 bp, Triticum aestivum
  Clone ID: PAT_TA_105154
caacaccaatcaaggcctccatccaatcccaagcaacctcgaagagtcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcggcatggagatggcggccgagaacggcggctgcggctgcacccagtgcaagtgcggcaccagctgcggctgctcctgctgcagctgctagatcatcggtcatgcatgcaccgcgtgcctcatatctatgatctatctatatatccatctaccaccatgtaacgctacctgatcacggtctttgtatgtatgtacgcacctgcctgcatgagcagagcaggtgccatgccatgcatgtaaacccctaaataaaatctcccgtggtttaaccccctatacatgtg

SEQ ID NO: 105155 - DNA, 495 bp, Triticum aestivum
  Clone ID: PAT_TA_105155
ggtgagcaggaaacgacccgtcccgtgaagagagcttcgtgtctttcatttcaacttctcttgggttggttttggagaagaaggttgagcagttggttggtcggttgttggcttgaaagatcttgcgatttctgtctggctgatcgtctccatgggtgtgtgttctggtcctggtggcttcctttcgtcgaccgtccttgtttagattgagcaggagggggtcaaagcagaagaagcgcgatgcagtgcttccggttcgcgagctgggacaaggagcgggacaaggaggagctgcaggtgcctgcacggtctcagtcggcgcgttccaacagcagcatctccacggaccatgacgcacggcggtcgggctcagagtgctgctcgctcaccgtctcgtccgagatcagcgtcgagtcctttggccggtaccggcagctgtcgctgccgcagcggcccaacaatgacctccgcatcttcaccttccaggagctcaag

SEQ ID NO: 105156 - DNA, 509 bp, Triticum aestivum
  unsure (1)..(509): unsure at all n locations
  Clone ID: PAT_TA_105156
gctccgctaaacctcgcaacaacccccgtgggcgaccaacccagcccagccgcccccctctcctcaccaacccccgagccggaagcagagccgcgatggccggcaccgtgcccaagctcgccgcgctcgccttcgccccctccgcccgacgcttccgcgtctccctcgccggccgcgccaggagccccgtcattgcgatggcttccgccaaggaagggaacggtgcggtgacgaagaggaccacgctccatgacctctatgagcaacagggtcagtccccgtggtacgacaacctttgccggcctgtcaccgatttgctgccctacatcgccaacggtgtccgtggagtcaccagcaacccaacgattttccagaaagccatctcttcatcaaacgcctatgacggtcagttcaaggagcttatatcanctgggaaggatgcggagagcgcttactgggaactcgtcataaaggacatccaagacgcgtgcaagctgtttgagcccatc

SEQ ID NO: 105157 - DNA, 700 bp, Triticum aestivum
  Clone ID: PAT_TA_105157
gcggggggcttcccgttggtgcttgatttcgccatcagggacggctcgtgtgagcgcgacggctgcctcagcggcaacagttcttgtgccaaagcagccaatgacgccggaggctatgtctgcaagtgccgggagcattacaatggcaacccctacatcactgatggatgccaagacatcgatgaatgtcggctccgagaacagagtcccgagttccgtgatttatatccgtgtgacgggatctgcacgaacatacccggaggatatgactgccgatgcaaacgcgggatgaaaggcgacgccaaaaagggaaactgcgccgaaatttttcccctgtcagcaaagatcatcgttggtcttgctggattgattgttgtctttgtcatcattgttatggccaagcaacacctgaaacttaagaagttctatgcacaaaatggtggtccaatacttaatggtgtcaagaatattcggatatacacgaggaaacagctgaaacaagtaacaaacaactatgagtgtgtcattggacagggccacttcggtaaggtttataagggcaccttgaaagatacacaacaagtggctgtgaagaagtccatcagagtggacaaggacgtgaagaaggaattacccgatgagggtataatccaatccgagatgaggaacaaaaacatttgaagcctcctagagtgaggct

SEQ ID NO: 105158 - DNA, 705 bp, Triticum aestivum
  Clone ID: PAT_TA_105158
tcggggatcgactaatcgcaggaattcgtttctgtactgtctagaatttgagttttttgacctcatctcgattttccaaaatgggcttcacgaaaccgcccgttcaagcgctcaagtctgccaacaagctcaagcgaaaggagctttatgtccagtataagaagcatcagaacaaagagaaacatgaggaacgacacaatcgcagaagggaagaagcaaaggatcctgagctcaaggcggcccgtttagcgaagcgcaaaccagctacgatagactcgaagcgagtgtgggacgatgtcgatgacgattctctgggagtccaggtggacctcgagagactcaaaaagcgttgtattgaataggccgaggcatcatatcatgccgttcatgaaaccgctatgctcgctgtataggatctggacgaacacgactatgtccattgtgtgctggattttgatgaggagatggatgatgaacgactagctgttctggtcttgaatctcgagcttccttcacagctggacaccctttattgttctcctttcccttctcgtcgcttttgctgcttcgcactagagtacgcctgtgggggccttaattttttacacttgtgtttccgcgccaccagaatgcgtcgttttctttttgtgttatcgataccttttctaatttaacattttcctgtttaaaagcaaataaaaaaaa

SEQ ID NO: 105159 - DNA, 685 bp, Triticum aestivum
  Clone ID: PAT_TA_105159
gcgggggagaattgaatccctcctcttcctccgtctctcggacgctcggcggcggcggctccagtccagggtaactggcgcacgccaccaagggcaaatcaagaagccaaacagcaattctgtggaaggtgcgagccatcagatggattcaagcaacgggaagaggaaacacaggggctaccttacttggacagacaaaatggactgggctctcctcgatgttcttgtcgagcatcacaacaatggcaatcatacagcaaatggatggaagccacatgcatactctgcggcggtgaaaaatgtgcgtgagaagtgcaatgtggagatcacgagggatcacgtgctgtcgagatgcaagacctttgacaagcattgcagtaccatcagcaagttgctcgaccgttctgaatttggatgggatcgaaacaagagcatgattgtgattcacaatgaggatgcttggaaagtgtacattcagaaaaacaaagcagctgcatgctaccgaaacaaagttatcaagaattgggatgcgataagtctaatattctccagagattatgctacaagcgaagatgagagtgcaggcgctgagaatgcccaagaaatggcattgaagggtgccgaggatgtccgggagcttattcaaattcaccttcagcatctgaacctagcagtcaagactcgg

SEQ ID NO: 105160 - DNA, 714 bp, Triticum aestivum
  Clone ID: PAT_TA_105160
acgcgggggatacaaactaagacaagcttggtgccttgctctagctagccgtcctactatatcaactttaagcattagtgttctccccaccactcacccatggccagtttccagattacaccattcgctggactcttggagaacaccgagtttaacttccatagcttgtacttgcacaacatttcttctggaccaaacccaaccagaggagccataataaacgacaatgctatcaatgggtggggccagccattcgttgtcgactggacaatatatgatggcactggccatggcgcgaagctagtcagtcgtgcccaaggccagcatatctatgctaggaaatggaggcatttcgtttcccttgagtgcactaatggtatgtttaaggtctccactctccaattaatggaactctgatggacttttgagcatccaattgagtgtgttatgactgttgtcactggtgatcttgctattttgcttttcatttacaacggtttatgtccgttatgagtaaatatagtgtctgcattagtcttttgaatatgcatcctaataatttctcaccattccctccgtttcgattcctatggctattagttattctgtgtcttgtctgtacccgcccctacatgattgatagtattttaatcatttcttcttactagtatgaaacgtcaggagggagagtgtgagtaatcgtcaatcaatgat

SEQ ID NO: 105161 - DNA, 728 bp, Triticum aestivum
  Clone ID: PAT_TA_105161
gcggggggacaggatgctgtttcaacaggcaggccttgtatggctctgatcctgtattaactgaggctgattaggaacctaacattgtgagttaagagctgctgcgcgcggcggaaagaaaaagagcaagagctatatggataacaagaaccgtatgatgaacagaactgagtcttctgctaccatcttcaacatggaagatataaaagagggtatagaaggttatgaggacgaaaggacaatgcttatctcccaaacaagatagaataaactatatggtcaatctactatatttactacatccacctttatgactacaggaagcataccaccttgaacaaacccagctagtgtactaaaggaatccatccatggaatacactgagtatacaaggaccaaaccaaagtgggaataaaaatggcatgagtctacggaataatttgagaagatattgttactgttgcgatctatgggacacgaaagatacgaatttttctaatgtattttaattctaattgtttcatagtgcatataatataaatattattctctgatcttctcaatctgttctttttttgtccttttctatctgttatagtcatttagacaatataataattaatattttatagtgtcagctccgtcttttttttgcgttgatgtttatatttattatccacgatggcgtattcatattattatattataaggtatcttaatcgatttt

SEQ ID NO: 105162 - DNA, 701 bp, Triticum aestivum
  Clone ID: PAT_TA_105162
gcgggaataatggctgcttgtgctgcactgtccgaggggatcttgtaaagatgcttctgaagctggtgaagcaaaagggtgacaagtttgatcatatcgtcattgagacaacaggtcttgcaaagcctggtcctgttattgagacattttgttctgatgaattggtctcgaaatatgtgaaacttgatggtgttgttactttggttgattgtaagcatgccatgcaacatttgaatgaagtgaaagcaaggtgggttgtgaacgaggcagtagaacaagttgcttatgcagaccggattatattgaacaagactgatttggttgatgacgcagaacttgaggttttgaccaacaagatcaagctcataaatgggatggcgcaaatgaaaaaagcaaaatttggtgatgttgacatggattttgtgctaggaattggcggttatgaccttgataggatcgaggctgcagtccaattgaatgaaaacaaagagacaggagggcattgccacttgggacatgagcatggacaccatcatgaccatgtccatgatgcagctgttactagtgtaagtattgtttcggagggactacttgatcttgatgaggttaatgattggctggagagactggttgatgagaaaggcgaagacctgtacagattaaagggtgtcatatccgtcaacgagtcaactggacgcttc

SEQ ID NO: 105163 - DNA, 703 bp, Triticum aestivum
  Clone ID: PAT_TA_105163
gcggggattaccaaacacttgaaccaaacaaccaagacacattgagtgtataccgagatggcatctcctcaaattggctggattggccttggctcgatgggtcttcccatggcaacaaaccttcagaaacatctcagttcaacagcggctccaaatctgatttacttcaatcgcaccatctgtcgtggtgattctctaaaagatattggtgctcagcccgcatcatcagctacagatcttgtcgataactcggatattatcttcatgtctttaagcgacgactctgccctcgactcaactctaaatgctattctcgactcagaggactccggaaaactcgctggtaagctcatagttgatacatcaactgttcatccagactcttctgcaaaggcagagactaggatccaagagaaagggggacagtttatcgcctcgccagtttttggagcaagtcctgttgcagcacagggaaagctcttgtggattattgcagggccgaatgctgctgttgataaagtcactccatacgttgaaggggttatgggaagagctgttatcagggtcggtgaggatatcagagcgtctggtaaaatgaagacggcaggaaactttatcacagctggtttcatggaaatcattgccgaagcacacgtactagctgaaaagtcgggtctgggcagtgggaacctggaagcgttat

SEQ ID NO: 105164 - DNA, 668 bp, Triticum aestivum
  Clone ID: PAT_TA_105164
gcggggattgcttgcgactttaacaacgccgaattgaattatccacccgaatccgcatccttacatcctcggtcatacctaatcaatcagtcacgatgggctctatctggaacgctttcactggcggcaataagtccggccaccagcagcaacagcaacagcagtctcagtcatactcacagcccacgacacaagaacccgcgcattactcgtcctacgaccccacggaaggccagggcgtcgagtccttcctccagagctctacctttgccgacccctcgcaattacatcccctcgccggcctcaacagagatacgctcgaatatatttctctcgaggactcagccttgtctgagttgcctggtggccaatcagtcctgccctcgcgtggcttcacagacgatttgtgttacggtgccggagttacatacctgggtggtttgggagtcggaggtgcttggggtctgcaggaaggtctcagaaggtcggccggccagcctcctaagctgcgactgaacgctgttctcaactcggttacccgacgaggacctttcctcggcaactttctatgtgtggttgctattatctacaactgcaccaacctcctgaattggaagtcttcgtggaaagcatgatgctggaaacactattctcggtggtgctttgag

SEQ ID NO: 105165 - DNA, 940 bp, Triticum aestivum
  unsure (1)..(940): unsure at all n locations
  Clone ID: PAT_TA_105165
nnnaaaannnnnaaaannaaaaaaaataaacaatttttttaataaatncttttttgnccccccacaacctctggcggctagcgattaatcaagccacgtnctcccctctcgcatgccccacaaaaaccaacacacccacacaccctcacactcgatcatattttccaacataataaagataatttataaaccgcgcacgcgaccccgcgacgcaatccgtcgcgacacacgatcaaaaaangtaaagagaaagacgatcgtaactaaacaaattcaatgcgatgccggaaggaaccgcacagcgccgccacaccccgcggcacaaactgtaccctcagagagtatgcgggcagagtgaagatgcgggggcgacgtctcggcgccgcgccgggcgctggctttgtttttatattgtgcatgctcttttttgtgtgagtgtggaggggtggtgattttgtttgtgttcgagttttataagttagggtagtccggtgaaggagatacaaagacaaactatgaaagatagcggtacttagttcaatgagaagagagtgatgatgtgtgtgttanagatggagtaaggganaatatttgattatgtgataaaatagatatagtaattaatatattcgttaaacatattattttgttgttatgtgagacgtttgtttagttttaaccacgaatatacggcatacaagaaggaagcagtaagtggtctccatgtgtatatagagatagagattcatatcagatttagtagtagagaggagagtagtatgggagcgaaatgacaagatgttgtaattgttataatattaagattgccgcgcgatgtgtttcagttatacttgtagatgggactatatcatggaacagatggacgggtgtcaggcgagcacagtatgtcgaagacactgggagatatttgatccaaggt

SEQ ID NO: 105166 - DNA, 715 bp, Triticum aestivum
  Clone ID: PAT_TA_105166
gcgggaagcttgtcaacaccatggctgttgaccacctcgccgagaagctcggtaaccaggagctcatgaccctcaccaagcagctctactactctaccactcacgtcattggtgtcggtatccgaggcgagcgccctgagcgcatcggtgacaagtgctggttgcacttccctgaggacaactgccccttctaccgtgccaccatcttctccaactactccccctacaaccagcctcagaaggacgccaagcttcctactctctaccttgccaacggtgagaaggctgcttcttccgaggctaaggagggtccttactggtccatcatgctcgaggtttctcagtctaccatgaagcctgtcgatgttgagaacctcctcaaggacagcatccagggtcttatcaacaccgagatgatcaagcccgaggacgagatcgtctccacctaccaccgtgctttcgaccacggttaccccacccccactctcgagcgtgagggcgtcctcaagcaggtcctccccaagctcgagtccatggacatcctctcccgtggccgcttcggcagctggcgatacgaggttggtaaccaggaccactccttcatgctcggtgttgaggctgtcgatgccatccacagcggtgctgtcgagctgaccctcaaactacccgacttcgtcaactccgccagaacactgagcgtcgtctcacccagaac

SEQ ID NO: 105167 - DNA, 711 bp, Triticum aestivum
  Clone ID: PAT_TA_105167
gcggggattgttcgtcggtttctgcatagttatcgctactatcaatatgcctgccagcagccccaagagtcagaagtcggcgcctcgatcgccgactagctcaagaagtgttcccaatgctacgcagacaattgaggtcgacactgtagttggagaagatgaggaggacgaggttgatccaggtcttggagccgatgctgaaagctccactgcttctatcacctcgagcattctccactatcgcaccatcaacggcagaacctaccacagcgaaagaggaaatgcggcttactggggttcaaacgatgaacgccagagcgaggccatggacattgcgcatcacatgttcacccttgcgcaagacggcgagttgcatttagcccccctggacaaagacattcagaaagtcctggatattggctgtggaactggaatttgggccatgtaagcgatacggaaatacctacaatgaccgtatctaactgaatagcgactttgccgacaaattccctggttgcgaggtcatcggaaccgatatctcccctatccagccttcctgggtaccgccaaacttgaagttcgaaatcgaggactgtaaccaagactggactttccctcccgatagcttcgactatgttcacatacgctatctagttggatgtattcctgactggaaccagttacttgaacaagctacaggtcctcagcctg

SEQ ID NO: 105168 - DNA, 631 bp, Triticum aestivum
  Clone ID: PAT_TA_105168
tactattaaacaatttattgtgctattccaaaacattcaattactagaataatatctatacaagaactttcctgaccccattacatcatcaccttcattcccatggcagtctttcctgccataccctttagctcaaagtgttggaccatctttgctgagcctgatccaccagacacatcgagcacggtcacagctgcctcagtagtaccgttgccaggagacagagcgtagataaagttgccagcggcagccaagtcaatcagacctgggtcaccgttgcaggtcaagtcaagctcagatacaacgctagcatcctcaaggctcatctcgacaactcggttacgtcctacatctgtgacgaatgcagtcttggtgacgggagagatggcaacccagcatgtcgcggcctggccctcaactgcgccagtagccacggttgttgcttcgcatgttttggcgtcgacattgaggattgcggcgccgaatgaggcatcggtagcaaacacctttgaagtaccaggaatgacctgtgaaccgaaaagtacagctgttccttcgggtgagctacgggcctcgttcttgctgacgaccatggccccgatggcttgctcaacgttgaatgaggccatga

SEQ ID NO: 105169 - DNA, 523 bp, Triticum aestivum
  unsure (1)..(523): unsure at all n locations
  Clone ID: PAT_TA_105169
gcgggacaagaaagagattgaagatctaggtaatactctagttgatagactgaggaatgggtccaaccattatatcgcacttcatttaagatatgagaaggacatgctctcatttactggctgcagccataatctaacacgtcaggaggcaggggagctgagagaaatgagactcaaggtgcggcactggaaagaaaaggatattaacagcaaggagaggcgacttcaaggaggctgtcctatgactcctcgtgaagcagctctttttcttaaagccatgagctatccttccgcgacgaatatctacattgtagcaggtgaaatatgtggtggacatagtatggacgaanaaaggccgatatcaatggacaccatttagctacaacagaaagatagagccctannnnnnnnnnngnncaagctgtaccaaaacagattagctgcagtggactataatgtcgccctccagagtgatgtttttgtgtatacatatgatggaaatatggccaaagcagtacaggnn

SEQ ID NO: 105170 - DNA, 673 bp, Triticum aestivum
  Clone ID: PAT_TA_105170
gcgggattggaagagaggattgaaaccgagactgctctttctgtgcagcacaaagaaaaatcagatgctgcatgcaatgctaaagaattgttggagacacagctgtattctgcaaatgctgaagtgcaaaaactgcatggcatcatcaaatcactagagaatcaggtagaagaagagaaggcactgcgcgacgaactcatgatacaatcattgctgaagattgaagcagctgttgaggctgttaaagaaccattggaggcacagctgtgttccgcaaacaccgaagtagagaaactgcgtggcattatcgaagcattagagagtgagatagaaaaggagaggacagtgcatgaagaactgacatcacagctagacatgaagattgaagcagagagaactcattctgaggctgttaaggaatcattggagggacagctatgttcagcaaatagcgaggtagcgaaactgcgtgatatcattaaagcgctagaaaatgaggtagttgaaaaagagaaggcgtcgcatgaaaaattggcagaaaaagcagagaaatctatttctgcggagtctgttaaagaatcattggaggcagaactccagttagtcaactctgaagttgtgaaactgcgtgatatggtgacggcgcttgagcatgaagtggtaaaggaaaagg

SEQ ID NO: 105171 - DNA, 541 bp, Triticum aestivum
  Clone ID: PAT_TA_105171
gcgggggggccctaggattggacccaccgccggagtggtggccggcagatcgcaccatgcggtcgccgtcggcggcactgctcgcgcgcgggacgacttcctccgacgatgtagcttcccctctctgaactctgaagccgcgtagggaggtgctccaggagggccacctgcgcacaactcagcgcgagctagcaatcgaggatggaggtcgtgacgggggccatgagcaccctcctgcccaagctgggaaacatgctcaaggatgagtacaacctgcacaggaaggtcaggggcgagatcctgttcctcacggccgagctggagagaatggaggctgctctcatagaggtttcggaggccccgattgaccacccacctagtaaacttgtaaagctttgggccaaggatgtcaaggaccttgtcctacgaaattgaggacagtcgttaacaaattcatggtgcatatcttctgccgtgcataggataaggcacatagctttatgggttttatacacaggatcatttacctgtgtacgagggc

SEQ ID NO: 105172 - DNA, 659 bp, Triticum aestivum
  unsure (1)..(659): unsure at all n locations
  Clone ID: PAT_TA_105172
gcgggggggacggtgggaggtctctgccactttccaaaccgtctccgtcagacggactgttcaccgccgctacccccgacctgctccgcgccagccatggcggttccttttcctcggaggccagcggagcatgtcactgtatccctgcggcggcgaactagctgcggtggctttgcagaaggagaataggtagtcatgccagcgggatccgggcgggatccaattcagcggaagcggcagcgccaagtctgacctcgacctcaacgccagggcggcgctcgatcgtgtcgacgcactccgcgagctcaggactgtgtttctctcctctcccaccctcgtctccttggttgaaaggatccagagatctcgccggcccccgttgagtcatcatgatgcagcagctgcaaggaccgcgagaaagcacatggtgctgtattgcggtaatgccgggatgctcatgtcacttatgagaatgagcacaaccacaagcacgttcagctgctcaacctgttgatgatcgccgcgaattcagaagcccaactgaagctaccagttccataagaagttgaagaactctaaatttttatgccatggattgaacatgtcattcagctgttctttggttatttagtctgacaaaaagcaaaatttctaacaan

SEQ ID NO: 105173 - DNA, 681 bp, Triticum aestivum
  Clone ID: PAT_TA_105173
gcgggggggtgcgatggctagggtttgtctcactcctctctctcccacgctcccttgcgtcgccgccgccaccccctcccattcccagcccgtgctctcctctcttcctcacctcccttacgccaccatccgtcgggaagcaccacggtcgttgttgctccgcgccgctgctcctgagccgagcttgtgcatcggcatcaccgtgaggggcatggcctgctgagacggccgtccatgtcgctgttgccgtcgttcttcgcgccatcggatagtatggccgccaccgcatgcccctgtcgagcgcgtgccatcaccgtcgtcatccatcggggaagtacaagccactgtacggactcaccataccggccatgccagccaaatctcctctgcacctcctaacaggcttgtctagcactaaaggggacacatttttacactcccgctaatttttaatcatctcaattatgacttgttagtaggatgttgtttgtagaatttagtttttttttgttgcaatccattatgaagcatacaggtgcttagattttgatattttttagtttggtcagctcagatgttgataacttttcagtttgtttcaagctgtttagttcagattctgatactttgtgtaccatttatagaagatgctatgtaagatgatggcaaggtttagttatc

SEQ ID NO: 105174 - DNA, 681 bp, Triticum aestivum
  Clone ID: PAT_TA_105174
gcggggagctactagccaatacaaattatagatacctactagttacgactcaaatcatatttcaaattcaactcagctctcatttacaataacgaacctcatcatggcgccctcacttcttctactaccttcaccacctcatccttcatcaccatccactctctcggcagcctacagcgcccctctgacatctgtcctacaaaagctcaagtcggcgtcttctccccaaactctagttgttggccttgctctccctattcttaccggcccatcagccaactcgaagcaaatcgcatggccaatcgctcaatctctccttgccagtctttacactctcacatcagtcgtctgcgcaaaggaagatattcctgttgatgttggcgctggaaagggaagcgtggatgtgagagttgttctcatagaccatgagaaggggcgacgctatgagcccaattttgagggccagtttgaagcgaactgcacggctgtgttagacttggctgcgtttgcaaccaaggttagaacatgggatatggtttatcatcccagctgtgaagaggggtacgagctgctatccacgtttcttcagcttgcggagaagaaacagacgtttatgcagaaccagctcgtcgctatcgagggtgggatcagcttgacaacagaggaaaagcttaataccga

SEQ ID NO: 105175 - DNA, 695 bp, Triticum aestivum
  unsure (1)..(695): unsure at all n locations
  Clone ID: PAT_TA_105175
gcggggacccccatcctcaatctcctcccgccgccgcctcccctcccttcgttcttcttcttcgagttgggtagtttacctctacccaccagccatgggtaaggagaagactcacatcaacatcgtggtcattggccatgtcgactctggcaagtcgacgaccactggccacctgatatacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgcttgcacaagatggacgccaccaactcccagtactctaaggcgcgttatgaaaaaattgtcaaggaggtctctttctacctgaagaaggtcggttacaccctgacaagggtcccttcgtccccattttgggtttgagggtgacacatgn

SEQ ID NO: 105176 - DNA, 671 bp, Triticum aestivum
  Clone ID: PAT_TA_105176
gcgggattgctgcttaatttaagatgcaacatatctaaatatgaaaatccagcgtatttgcttagaggaacaacatttttatgtagctcctccatgacaattgttgctggtacaatgtttgttttatctggaaggtgtcatcaggggctgatttgaaactaaacccaccctgatgcactactttcccatggcttaaaagtttcattccacaatatgaagatttgctaaacaaatagtgtattttgggacaatgcttgatataacgatgaaacaaaggacacaaatacatggtaacaaccgagtgccttttgaaaatataccaagtaaccaatgcctatgattttggaatatacaccatcaacttaaaattggcaaatggcatttaaaatagtcaaatgaaatttttaacaagctaaatatattcatattagctcctagaacattccatcttttatggacatgaaatatgcaaccacttgagaggaataattgactaactgaatgcagattgtatatagtcgcttaaagagcaatacaatgagtcaatgccaattacttagaccactattgaattaggagttggtaaaatcctaaaccattataaagttggcaaactttggtcttgtacccacatatcatggatggaaacaatatttatcaccaaggcattg

SEQ ID NO: 105177 - DNA, 633 bp, Triticum aestivum
  Clone ID: PAT_TA_105177
cagaataataagagtgtgatgttttgttataccaagatagatgacaaaacgattccgcttaatggaccctgacttagctgtggcgcaaacacattaaccaaaatagtatagtagtttgcttcgtttaaaaataatcatcatgagctgaaatctactgcttaggcaaagcatcgtatattggagtctcgtttcaagcctccggcttctgtccatacacactgaatacatatccaagagtttgagtcttgagatccatgatcgactgcctcatctcaaccgcaaacatctgcatctcttctggactccactgaagaatcccacagagtggcaacttgataaacccatctagcgcttgactgaacgccaaccccacgaaagtcccaagctctttcttcttcttatccttgggccaccggccgaccggaatcttgtgtgattggtacgttacatttgtgaaattggctgctttggcgagcttttccagcttctgattggaaaagtccaaggtacggttcgttttttcgccgacctttttgaaaacgtttgcccagcgagtgtagatatgcttgtcgtaacattgacctctgggttttgtgcatacatctgcagatcaggctccatgtgctgaaacca

SEQ ID NO: 105178 - DNA, 694 bp, Triticum aestivum
  Clone ID: PAT_TA_105178
acgggttatgttgaaaaaattggtcgaagttacaatgcattagctggcataaatatagcacaactagcatgcctaaatgcacacaacgttgatggtaagatatgcttgacaactacctaacaggatcagattattcattttgtaaatgtaaaaaaaatattattgtcttcacaacgtccaccactgaatatctctatgtatttctagaccttgattggatattaaaaagacaatccaatttatcttctcgcttatgtcctagaaggtttcaggatctgtatctatattcgtgattgctactgcatgtgttctgactcggcttgtaccttcattaaaatgaagtaatactaaagctatgtatgagtctgattcgtgcaagccttgttcctactgctgccaccttgtataaatatatactggttcgtgcaatacttgctcctacttcaaatttttagtctgaacgcctatatatacttgcatcagactaaatttgtagtgtgattcgtgaagtaggagcaagggttgttcctactgctgccaccatgtataaatatatactggttaatttcatttaactatttttttctgtcacaaataatagtactatgctggtcaagtgggcagcgtatagaatcgtcttgcacagaagtaacacggataatataatcaatggatttatgatagaaaatcattt

SEQ ID NO: 105179 - DNA, 682 bp, Triticum aestivum
  unsure (1)..(682): unsure at all n locations
  Clone ID: PAT_TA_105179
gcggggaagcaaaacagcaaaccattttcatggagctaaacggagccaccctctcgctcctttctctcatctcactggtgattctagtttccatgcttagccgcaagttagcaccacgttcaaagaagcagcagcctcctggcccatgctgtctgcccttgatcggaaacgtccatcacatcctcacgtcgaaactgccggtcgtcctccgggacctggccaagaagcacgggcccgtgatgtacctaaggctgggccaggttgacgccgtcgtggtctcctcacggtcggcggcagaggaggtactccgggaaaaggacatctgcatggcgtcccggccgatccttatggtctccgagatcttactctacgggaacctcgacataaccttctcgccgtatggcgcattctggcggacgctgcgcaagatctgcacagtggagctcctcagcgagaggaaggtgaggcagttttcgccggtgagggacaacgagaccatgtccctcgttaagaacgttcgcgtggccggccgaggtggcaacctgttcaaccttggcaggctacttgtgtcgtgctccaactcgataactgggaagacggcgttcggggagatgtgcagctctgagnctcaggaggagttcctgtncgccatggatgtngggctgaaacttgacgccggact

SEQ ID NO: 105180 - DNA, 716 bp, Triticum aestivum
  Clone ID: PAT_TA_105180
gggggggcacacgcgccatggacctgcctccaggatcctcctcctggctacacacgacccccaccaaccaatctcccgtcccggccgccgatttccacccggatccccactggtttccccattggcgccgcccaccttctacatcaccgtccacgccagccacccgggccacaacgccgacagccgccctccacggcctccctcgctgccagatcgggtcgggcctggcctttgactaccggatccgtaggaccacggcctccctcgccgccagatcgggtcgggcccggcctttgactgccggatccaagggccacggcctcccccacctgcctccctccaccttccgccggcgctgctaccggccaccctccaacccactggcaatgctggcgccacctaccaattcggcggcgtggtcgtgcagtccgcggcatgtcgcgtcatggtctgtgggcgtgggcgtgcagtgtggtgcgtcagtgcgtgcagtatgcgatgatggctgtggaaaaccaaacgccaagcagcacctccccgcgactgctgttgatggccagagtcagaggaagccctcgcctggtcgccactctcctctactgcacgtagccacgagtggctcaccggatatcctcaatccgctcaacagaaaacgacgggtgcgcgtgcatgggagcggcgagcagaggaaaaaggatggagccagggacgaagta

SEQ ID NO: 105181 - DNA, 508 bp, Triticum aestivum
  Clone ID: PAT_TA_105181
ggagctctaagcccaaccaaccatcaggatacatccaataaaaggtttttagctgacataattccatacaaaaatttattctcagaagaaaggctttgaacactcctctggggcaaaccactctccccagtaacttcatgcctcttatttacttggagctgtgcatgtgacggatgaggtcgaccacacgggtgctgtatccccactcgttgtcgtaccaggagacaagcttgacaaagttgtcgttcagagcaatcccggccttggcatcaaagatgctggacctgttgtcaccctggaagtcagtggaaacaaggtcctcatccacgtaacccaaaatgcccttgaggtttccctcagactcctccttgatagcagccttaatctgatcataggttgctggcttcacaagtctaacagtcagatcaacaacagaaacatgggcagggtgaacacggaaggccatgccagtcaactttggcatgagctctgggagcaccttgccaac

SEQ ID NO: 105182 - DNA, 684 bp, Triticum aestivum
  unsure (1)..(684): unsure at all n locations
  Clone ID: PAT_TA_105182
tcacgagaaaagtatctgatagtattaaacataaatttagctgcaaacgaagatcaaaacagcatgccatccggttggtactttggtccaagaaatttatctgagaatatgaacagaaactacacattgcctgcacaaagggctaagctacaggctgcctgcaaatcaaactctaccctagactggatagccacaagtgccacagcttgaattggctaataaaataacatcaaatcaaagctctacacacaatttggatagtcaatagtacgcactgacacaaactggttctgcagtatcgtcacaccacgttctgtaccagcaatgggacaatcttcacacagaaatacaagaccacgaaaggcatgtattcctgtaacacatcacatggtgttgcattttctcaccatgtttgcccacttaccgtgatgaagtgcatgtgaaacatcggtaggaggcaatgtaaatcagctagcaagcttgaaagcatcaatgaagaggccatatgtgaaacccatcttgaaattgttgaggagcgcgacggcgaaggtaaccttaggccggctgtagtagaactttgtcacgtactcggtcaggaggacacacacaactgctgctataacatcgttcacggccaaagcaccgaacgacagggatattgtctgcgcacatanaagccacccc

SEQ ID NO: 105183 - DNA, 659 bp, Triticum aestivum
  Clone ID: PAT_TA_105183
gcggggatgtcagagacacctcgatagtcaagctaccattgtgtgtcatcaagctgcagaagttgcaatacattcgtgctggcaccatcatatcatcagatgaaggtgatgaatctgttgcaagtgtaccaacaacaaacgtagaacaaacatcattgccaccggagggcagtgatgacatggtcacaacactaccgaaaacaacagaggaggttcagatatcaacaccacctgaaggtagtgatggcgtggtcacaactctaccggaaactacagaggagattcagacatcaacactaccagaaacgagaagagaggttcagacatcagcatcacctgagggcagtgatgacatggtcacagcactaacggaaacacggttgttatggagctgccggccatgtagtttggtgtctagctggttatccaagttgcgcagacaccgacttgataatgatggtgttgaggttcctgaagggattgggagcatgacggccttgcatactattggtgttgacaatgtcaatattcctaatggaaaggcaatcctaaaggagcttatgaaggttacacaactacgcaagctcagtgtgtctggcataaacggtcatacatacaagatttgttttatgtgatattcggttacaatcatgttgtgt

SEQ ID NO: 105184 - DNA, 722 bp, Triticum aestivum
  unsure (1)..(722): unsure at all n locations
  Clone ID: PAT_TA_105184
gcggggatccctgtgagcggtcaagcgagcgacaatatccaacatcttaggatggttttcttgttggacgccgatgccgagagaagaaccgggcaaggcggcgatccagatccagatccagcagcggtaaaagtagagagatggaccagacgcagcggctgcccgaagacgtgctcgcggacgtcctccgctgtcttccaccgcgcagtcttgctgcagcccgctgcgtgtgccgctcctggcacgccatcgtcgacgctcatcgtctcctggaccgggacctcctcccgctctccttggccggcttcctcatcaacttctgtgagcttgacttcacggagttcttcttccacccctcagcaatccgccgctatgccgacctccacttcatgcccacggacgacatctctgtggaggacgtatgcaacggcctagttttgctagatcattatgtggtcaatcccgccacacgacgttgggcaagcctgccaccacgcccatctcctcccttggggtttgagctcttttattatgaacgaaactacatcgtgtttgatcccacggtgtcgccgcactaccaagtgcttaggttcctacatgtacccncccgtgggcgtggactggatgcagagacgaagcaacagcaatggcctccgtctccatacatgatgcatgttttctcttcagaaacaacaaggtgggaagagagatcgttcatccgn

SEQ ID NO: 105185 - DNA, 493 bp, Triticum aestivum
  Clone ID: PAT_TA_105185
gcggggttctttttcttttttgaactaaactagaagtaggaattcattttattgggttagtgttgtaaattgtcgatgtttcctttttgttattggcttattgcttgcttcatttggacagctacaactgaaattattatgatgccatattttttatattactccatgctcaccaagttattgagttgaagttgtcgttgtttgctgtcaagatttgcttagcctgaatacatggttatgtttttgtgtactactgtcctgttgtctctgttggatggacagcatcccagtacaagtacttgctaggttttacctgttcatgcaaatcttgttgggtgttgcaacacttggattatttattaatataaccaagcagcgatgcttgcattttaacacatgtattagtgtgctaaaactactaaagtacctgcttgttcttacccagagtaggacatgaggcttgtgttaacttgtatgaactgagttaactggt

SEQ ID NO: 105186 - DNA, 715 bp, Triticum aestivum
  Clone ID: PAT_TA_105186
gcggggtcttcacccccatcatggaccgacccgaccgaatccctccaagtcggttcgacctgcatctcctggacatcgacagccacaccatgtggatggtcgaactgcttgattgccgccacggccgcgtccttctcatggacacactgtgggatgaggtcatcatgtgctaacctatcaccggcgagcagcgccgcttgaccgttccgccagagttcgtaaggaatcgcttcaccggggctgtgctctgtgctgccatcgaccatgaccacgtgcacggaagctgccacttgagcccattcaacgtggtgttgatctccgctctcggagggaataatcaacctatcgcgtgtgtttactcctcggagactggtgaatggggtgatatcattccatcatccgtttcatttgagcttttttatgaccatacccctgggttgcttgttggtaatgccctttactggttgttggattctataggccatgatatacttaagtttgatttggataagcagagcctaactgtgattagggggcctactcttacaaatgattttcgccatggtagtcattgcatcatccaggctggggattgcgccattgggttcgccatattgacttaccctcacttgcaaatgtggcataggaatatcaattttgatgctgttgccacatgggtgctatggaagacaattgacatgcgtatgattattgt

SEQ ID NO: 105187 - DNA, 694 bp, Triticum aestivum
  Clone ID: PAT_TA_105187
gcgggggaaaatggaatgggcttccatatgatggatgtacatgggagaaataagtctgatatcttggtgttccaatctcagattgaattcttcatcaagatttagtccaggagcaagtctactgagaagagcaagggtgtcgatcatgaatttttgttttagttgactgtaggtttcatgtggaaatgtatttttgatctcagcttctaatgatgaaaagaagcagtcaagaataaaatttgatgtccttttgcaccttacgagatgataaacatcaacactgatgttctgataactacaaaataggaatgcatgcatcaatgggcatgaaggccatgggttgaagaccaaagattttacattgttcggtctatttaaaggctgtaattgttgccagcctgagcttggtaaattttccttgcttagtcctaatattgaaacttgctcggaggatccaaccaaggccacatttttgataaagaagatgcacaattctattctatcaacaggctttgatgtgtcatcagcagctctattacaagtctctagcgtcggcttaccccagttcaggtcactgctctttattctttagttaaaaccatcattgtggcacccccgcttttaacatttgtgtagttagaagcaggattttagaagtgtgtgtaccattttgctggaagttataatggattac

SEQ ID NO: 105188 - DNA, 675 bp, Triticum aestivum
  Clone ID: PAT_TA_105188
gcggggactggtatccccgtcacagccggcggcggtggcggtggggcgattggcggatccgccaccgcgactcagtcgttcggcggcggcggcgcgattgccagaggaggttcggttggttcctcgatcgggttccaagaaagaagatgagtgcggcgggtgtgaatggatccgacaacaaaagaagcaggtccagccgagacgatcccttggccttgccggagaagaagaagaaggtgattgtgtggagagatccagacgcgtgggttatcagcgatgccgacctggccaagatgaaacgggacgaggaatcagctcccccgcctgtgaaaatccctacgctcgattacttcaaacccccgaccaggtttcacaccgccgagctcttccccgtcagtgaatctggaagcaaggcggtgctctctgctgccaaattccttctaggggtttcatcctctcttgacggtgaaccgctgagacggtgctccggcttctgggtcgattgggatgaggacaagaaaaccggtcttgttttgacaactgcgtggctgattcgcacaaaggatgctcctttcaacgtctggtcaggcggctaagagtatgcccctcatgctgatgacactgtgcatttgctaaatggcaccagtgcatagggtacgctggtctactatgatg

SEQ ID NO: 105189 - DNA, 706 bp, Triticum aestivum
  Clone ID: PAT_TA_105189
gcggggactttgagcagcagcagtcattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccagtgcgagcttgtcttcgccaagatgggcatcaacccaatcatgatgagtgccggagagctggagagtggcaacgccggagagccagccaagctcatcaggcagcggtaccgtgaggctgca

SEQ ID NO: 105190 - DNA, 714 bp, Triticum aestivum
  Clone ID: PAT_TA_105190
gcgggaacctgcagacgctgcaggcattggaagtacaagaggagtctcttagacatttaggggagttgagacaaatgagaagcttgaggttatgtaatgtgaaaggaatttattgtgggcgcatcagtgagtctctagttcagatgccgtatttgtccttcctagatgtgattgcaagtgatgagaacgaggttctaaagttgaatgtccgcgtgccaagcctgcaaaagctaacttagagagggcgactagcggaaggggcgttggacgagactcctccctttcaagctggtagggggcagaacttgtatgaattgcatctattttggtcccagctgagagaagaccccctgccacccctttctcggttatcaaacttgacgcgtctagatctcaccacagcatacagcggagtcactggttggtttcccaagctaaaggttctctgcctaagagacctgcctgatctgagtcggctagagatacatcaaggtgccatagagatcctggaggaattaatcttaatcaacctcagcagcatgacggacgtcccacctggcattgagttcctcacgtccctcaagaacctaggtttctacaagatcagcagagatttcttgacatccctgcgccagtgtgctgcaattcgagggaagtggcgatatagtctgcgagattgacctgctactctggtctggagacaatgcatgtacg

SEQ ID NO: 105191 - DNA, 695 bp, Triticum aestivum
  Clone ID: PAT_TA_105191
gcgggagtcgtggtcctgtttacacggctttttctgattttgtttcagtcaagtttatgtgaaatataatctcattttatctgatactttggtttgaatatttacattttaattaccatgtacgtactagtgcagtatccagatattttgttggtgttatcttccaaaataatagtaaatgcagtcctcagatagaagtaaaagtagcatgtccgcaaacagagttgtacatgtaaacttactacaagtgttgtagatgattgattggaatcataaagatctcaaataaacatacaaaaacagattcttgacacaaattaatatagactcatcaaatatatactttgtccgtggtcaacttgtgatgccaaataatgttcagtataatagcaacctacaaacaacagtctacagttctatgatcatttccctcctgcagttctaaatatcatgcgaacatacattgctttatgcaagagaaagaagtatgtgtactttagaaagcaaaatgttgaagaaacatataaaaaagatgttgcatggctgatgtttaggtcacttctttataggctataatctctgaaaatccacaaattatacggagtggttcataactgctatttaggtcacttgtttataggttaatacttgcttcatgcattactgaatgtgcaggaaagactgtataacatgaa

SEQ ID NO: 105192 - DNA, 714 bp, Triticum aestivum
  Clone ID: PAT_TA_105192
ggggaaataacataattgtatgcttgtctgagcactgcaacaatgcacacctgctggttattattgtacagccacctcactgttctgttactatgctgtgttcttttatatcctactatatatgtaatgactgaagcttctcagggagttgtcttagctgtgttcttttatatcctgctattgatcagtattctgtatgtactatttgtaatggtatgattttcaactgtgaataattgagtcgctgattctttcaggcatttaagaagctgcttgagaaagtaatgagatggaagaagatggaatcaactagcagttgccgttaagaggaacttctcaagttcttcagcacgtatgataagacgctagacatttttgctttcctcagattactagtagctatccagatatgctcgcacagcgaggagtatgtaccgcatataccagtggtcgctagtggagactgcagtctggaagtttggtgctttcggcgtgtcactccagctggtgtggagtcggagtatcttatgatgagggccttggccagcgcgcttgaggtaatcctcatagtggaaacattccaagaacgatatactcaagatatctacactgatcctggagttccccgtacggctgtgaccctgctgtacaatggtgatcactactacatcatgtacccatgcgcaacatcttgtgagagtacaagtcatgagg

SEQ ID NO: 105193 - DNA, 704 bp, Triticum aestivum
  unsure (1)..(704): unsure at all n locations
  Clone ID: PAT_TA_105193
gcggggtctgaaatcaccaaaggattgcaacctacgaaattgatggaagtcatatgccccgtacgtgggttggcactagagcatgccgtctccctccataatggtaatcatttatggacaatagtgtcttccagaaatttcataggttgcagtcctcagagactacaaagatgatccatcatctagattaggcattttttagggtagcactcgcatatggcagacttaagtcttttatggtgattgcggcattggccatcaccctatcttccatgttagacatgacttcttgcaaatttgttattggcccaaaatgtgtggctatagtcgtgcccaaaatttgttattagctcacatataacacatacatacctcagggaaacatagttcgaggagcacaaaagccacttggaacaaacagggcctatgtcagacgcgcatgagaaatagagtaggcttgctagacatgatggcatgtgccacatgcgatggtgggggaaacctccgcacagtctccatgcaaagcattgctagattgggagccaaaaatcctccccaacattcgacaactccaaaacttgccaaatattaaatctatgtcctgtatagtgcatcgtcaagaagaaaacaagagaaacttcctggaggttttgatggaggaacatcatcaacgaaaggaattgaaccatatgtactagaaaatn

SEQ ID NO: 105194 - DNA, 680 bp, Triticum aestivum
  Clone ID: PAT_TA_105194
tttttttttttttttttttaggaaatgtcattcagctagctttattgatttgaaaaagtagttacattgttcacaagcgattcaaggataaaactaggggatcatcatcccagatgcaagaattatgagtaacaaaagcatttcttgctagcttgtgtgctacgacaatggcctcccgattacgatattctacaagaaccctatcaaaacctgtcaaagatgttgttgcaatctccatataccgctgatgattctgttgccaagaagccaccatcttgcattgtttcaaccacttgcatgtagtccgtttgaactgcaaaaacatttataccaatatgctgcgctagcagcaatccctctgaatgcatatgcttctgccattgctgcgtgtactacatgcataagatatctgtgagaacttgcaatatagtttccatgacaatctctaatcaccacccctgttcttccatagcctgaattcctatcataagtagcatgaacgttgatcagtaatattcctaaagttggtttcctccatccctctatcggcttcaaaatcaatatgttattcagttcagtgatattgatctgtaatattccgtcagtttgagtaatattgtcactaaccgttcttcaggtatatattatctttttgtcatcatttgatgtacaactgatac

SEQ ID NO: 105195 - DNA, 704 bp, Triticum aestivum
  Clone ID: PAT_TA_105195
gcggggatgcaacaagaaggcgaggttttattattcagcataatccttttggtttagtgtttgctggtacttttcctagctggatagttcgtgaagatggagactttgttctgacactaaatgacgcacatacatacatgcgtttaaatggctctggatttgttgaatttgctaagcaagaggcacgcagttctgttttgtggtctgctccagaaagtttctgcgactttgagtcgtactgtggaccttatggaatctgcaaaaggtcaggcctctgcatatgccctgccggttttgatccattaagcacaacatcaaggagttctcttggctgttcaagggaggttcctatgaattgtgaaggagacaattcaactcatcgaaaaggggtgtttaacccaatagatggcgtctacaagttacccaagaattcttggccctctaatgccagaaatctgaaagagtgtgaagcctcctgcttaaaggactgtacctgtactgcctttgcttacaatgtgacatgcctgttatggttttgggagttacggaacacggtagtgcttgactctggttcaaatggcaatcgtttgtacatacgtgttgccaccaaacaacaagatggacatttgggtttcagagctgctcctctgtttctaacggcaatggccacgttaaccatcattgttattgtcattggtctgact

SEQ ID NO: 105196 - DNA, 695 bp, Triticum aestivum
  unsure (1)..(695): unsure at all n locations
  Clone ID: PAT_TA_105196
gcggggggtcgccagtgagtgtcctccacttcccgccgccgcgtccctcgccgacgtcgatcgatcgagcgccgccgacgccggagacgccgtcctgcctcccagctgcgtactactagccctttgacaaaatgtctgcaccggcatccagttccaagaggtcgcacggaccagcagcgcacagtgctgacagactcagcagccttcctgacccgctgctccatctcgtgatgtccttcctgccgatgcgagaagtcgtgcgcacaagcttgctctcgccaaggtggcgcgatctctgggcctccgtgcccttcatccacctagatttcaaggaatttgtggatgctactgctgattcttttgttattggtgttgatgatcatgattggttgaagctggatgagaataggctgcagaagtttggggaccacttgctactcttgcgtgatggcgcggtgcccttggatgaggctcggatctttattggaggtgctgatttgtctgacanatatgatttgtggattcatcatgccatcaagcataaagctcggctgcttcatgtttatgctcatcgcttnctccgagtagaattcaatgatagatcgatgatttcggctcagcaccttgaaataatcaggctccaagaagtcactttgactgacacatgccttaggtcactgaaattttattaccct

SEQ ID NO: 105197 - DNA, 713 bp, Triticum aestivum
  unsure (1)..(713): unsure at all n locations
  Clone ID: PAT_TA_105197
gcgggatcaaagactctcccgaattgagtggaatggcctcagaaagtaagtcatagacatttttgctatgtctctatccccaaattcaatcaactagctaacaaattgaccactagattcttacatgagacttgagagtatatgcacaggtggtatttcaggaaccatctgcagaggtatggtgcgactccaaagagcgcgttgaaggcttacttcttagcttcagcaaatatcttcgaacccggccgagcagcagagcgtctagcatgggctcgcatggcggtgcttgctgaggcggttacaactcacttccgacacattgggtatgtatgcagcctcatagtttcccctctctggaatctggttttagtgatgatcgatgcaaaatgtttgtgcaattcattgcaggggtccatgctattcaacagagaatcttgaagagcttatcgaccttgtttcgtttgatgatgtttccggcggccttcgtgaagcggtaaaattcaacaaaccactacacttgagatgatattgaacttttaccagatatgaaatggccgaacctctattttctttggtaactacagtggaagcagtggcttatggcatggactgcanaggagagccatggatccgttgatggagatacagcactgttgttcgtccgcaccatcgagatctgctccggaaggattggttcatccgagcagaaactg

SEQ ID NO: 105198 - DNA, 692 bp, Triticum aestivum
  unsure (1)..(692): unsure at all n locations
  Clone ID: PAT_TA_105198
gcgggtgtttatctcaagcttcaaccatatgcacaaatgtctgttgctcgtcgtgcaaatcacaagttgtccttcaaattttatggtccctatgaggtgctcgctcgcgtgggaaagtcagcctacaaattgaagcttccaacaaatagtcgtattcatccggtggtgcacgtctcccagctgaagccctctctaccggcaaatcaggtgccttctgatgcttctttgcatctgcttacggatgttccagtttctattcagccggggcagattcttgattctcgtttggtgcgagctggtaatggcgctcgtgcacaagtgctcgttcattgggctggcctctcatctaatctgaactcctgggaagacaagaacgcactccagcaccggtttccttctacagcagcatgggggcatgctgtgtctcaaggaggagggcatgctacgcaccttccatgtgggccagccaagaccaaggcctctcctagaagctgactcggtcaagcccagcaggtaaccggcgctcgcgttaccggcttggcccatctaccggacgtgcccctcttaagcanaaactaaggctaacctgaggggataaggagggtaaaagaatattttgtccgtctatcttcttcctatccgctactctgtatctccgcttttccctcttctcatctacagaactatgtgtt

SEQ ID NO: 105199 - DNA, 684 bp, Triticum aestivum
  unsure (1)..(684): unsure at all n locations
  Clone ID: PAT_TA_105199
gcggggggaaccaaaaacgacattgctctctcacttggatggggaaagaagaacccagctactgaccaacaggcagtgaaatcgctccttgaacaagtaaaaggagcaagagaaatgtgtattgatagttggcatgtcatggtgaggctgcgacttcgcgaggaaggtccatgtgatcctattcgtcccttagagttgcctgattcgctgcatgtattccaccgtgcaaactgtagccatttccaaaaaagccacttgaatgtgacgggttaccacacatttcatggaggattttggagttccttcagtatggggttggatgcacaagtgtcttataactttcactctgcaaggaagttgcatccagagaagttcatagataagggtacatatgataagcttggacttaaacaaggagggtttgctgcttctccatctcaaccatcttcacggaacattggtcatattgcaaaggtgaaggtcatgaaaagacctggtggccgctgggaggagcttatgattccttacagcactcgatcagttgtctgtctacatttgccaagcttttcgggaggagtggatccttggggagttcctggcacgaggaaaaaacaagatagggctcttactgcgccttatattgatgatggccttatcgaggttgttggctttagcanaacttgg

SEQ ID NO: 105200 - DNA, 696 bp, Triticum aestivum
  unsure (1)..(696): unsure at all n locations
  Clone ID: PAT_TA_105200
gcgggggctgcacaaacttcttctccccgaagctcgttgcgccatgctacctggatccgcccttcttttatcgaggacaaaaggaatcgacatggacatcatgtggtgtattgttgacgcctttgctcaacaaaacaagcacgcccaattttcagttggccccgacattctccctacaactttgaattcattgttacgggtgaaaaggcgtaggagcgtgcgccggaagcctctgcaaaagctgctgtccatgaagagttcagggactgaaggtgtgaattgcagcatcaccgatagttcactgcagaaaggagatgtcagcggcaggacacgatgccctgaaatcgatacaagcttttgttctcctccatgtgaacttgacttacaccgtgtttgcccgacggatggcttcaatctccttcttgtcctacaccatattgatcctatttctgtagccaatggacagagcatcttggctttactcacacttttatcaatggtgggtgattgcagcaaggccgcagttaacacacaacactaccgcattaggaagagtagacacaacaagggctgcagggtgctatcgaggcaatgctcggctcagaagactcgagatcataaacggngtgacacaagggatgctgcatttcagaagaatcgacgtctcacctncagatctgaacctatgtctgcggn

SEQ ID NO: 105201 - DNA, 685 bp, Triticum aestivum
  Clone ID: PAT_TA_105201
gcggggacagatagtggctcctagttccgtcttatttccatggctaccttgggacgagaaaatcaatccatctgaggttagctcggccgccgagccaagatgccggcaggaggattctcggcgtcttcggcgctgccgtccggcatggagtttgagcccaagatcacgcctacggtggtcacctcctgcgtcacggcggccaccggcgggctcgtgttcggctacgacatcggcatctctggcggggtgacatccatggaggatttccaacgtgagttcttcccgacggtgctccgcaagagccgcgagaacaaggggagcaactactgccgatacgacaatcaaggcctgcagctctttacctcgtccctctacctcgccggcctcgtctccaccctcttcgcgtcctacaccacccgccggctcggccgccgcgccactatgcgcatagccggcgcctttttcatcgccggcgtcattttcaatggcgctgcgcggagcctcggtatgctcatcgtcggcaggatcctgcttggctgcggtgttggcttcgccaaccaggctattcctctgttcttgtcagagatcgcaccgattacaatccgcggtggcctccctgttccagataaacatcactgtcggcattttgttcgccaacctcgtcaactatggcactaacaggatc

SEQ ID NO: 105202 - DNA, 402 bp, Triticum aestivum
  Clone ID: PAT_TA_105202
gcggggactttgagcagcagcagtcattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggacttgcgtacgatatctccgacgaccagcaggacatcaccagagggaagggcattggggactggctctttcaggcgcccacaggcgacggttcccacgatgccgaactaagctactacta

SEQ ID NO: 105203 - DNA, 569 bp, Triticum aestivum
  Clone ID: PAT_TA_105203
gcggggatcgtccccacttctcacatccgccgcctcccccgtccgatgcggcctctctccgactccaccgtccgccgccgccgcctcgtccagcgctgacttcttccggtcgcagccgcctccctcccccgtccgtggctgagctccgacttcctccactgtcctgcggcccacgggtgaatcgaattcgggagaagactggcaaacatcagccggagcagcagcagcagcaggaagttgtgaaaacatagtggatttgaaccggaatcgtctcaaaaagaccaaatacgaggctggcacagctaatggcaacttcacgaggtcatccaccaaagcctggcaagagtgttggtcaggagtttgttgatcatcggctcctcagtcgaataggacattatcctgattcaaaagatttgccaagacagttggacatggtggcatactttagcgactagcctgcttgacagacaactcactgcactaatgtggcggttgagcagttcaacgcacaacagcacagtgatgataataagataatgcgggcactcgggagttgacagcaatcatgt

SEQ ID NO: 105204 - DNA, 693 bp, Triticum aestivum
  Clone ID: PAT_TA_105204
gcgggggaggttgtttatgcaaggcgtttcccccgaccttcgtctcgaaaccctctctgccggctgcttctccggtctaccgacaagcacgccgcctctcagtcgaaggagtattctaggttgaaatggcatatgcgtacaggtggcggagaaacctctgcacactcatgaggttcttaccgcaggtggagcgccccgaccagcctgtttctctccatgacaagtacttttacacggctgcttcggttttcatcttcatggctgccagccagctccctctatatggcttcaaaccaggcatggggattgatccattttactgggtcggcatggcttttgcatcaaactggggaactctcaccacttttgggatcctccctgtttttgtacctgagtttttagtgccagtctgtatctcgaggattctaaaagtgagcagcaggactcctgagggtcgaatgcttctggatggagctcacaaggtggttgggatatgcactaacattgtgatggttattatctttatgctagtgtatgccattcttgtcaaagttgacacgtgcactgctgttgtaatgatgctccaacttttcttctctggtgttgttgacctctatctcgatgaggtgctgaagaaggatatggattgttgccaagtatctcgttattcactgccaccaatatttgtgtaag

SEQ ID NO: 105205 - DNA, 685 bp, Triticum aestivum
  Clone ID: PAT_TA_105205
gcgggaggaatattaaaaatacatatatagtacaactcacaataaaatagttgtcgggttcagttttcactgctgatagataccttcttcatgacccctctttgcattatttctagaccagtatattctcttaaccgtccttgtagctctggtagatgacatatggagaactgctctcaattgtgagactcattcttgctatcttccgagtgtgtggttcatcgaccagactgctgctttgctgtagggaaaactgttttgaaaccaagtctgaattacaatggattttccgggctacgaaagaaaaatagttgctatgattcttcatgattttaaatataaaaaattctttcctgggttagtgccatcttgcagcatgtttgtgcttatacgatgatacctttgctccacttatatcttgcaatgtgtacttcctttctaaatgccgccataagttgcaaggggcaggggggataggtgccgaggacagggagcaacgggttggtcgcggtgggcttgagctgctggggagatggaggaggccgtcgtgattcgtgatggaagcggcgccgccagcaagctggttgagctttaagaagagattttaatagaaaccaaatctgcacgatgcctcctcaccctctcaggttatttgttcaccccttttgatagttttttaacacag

SEQ ID NO: 105206 - DNA, 665 bp, Triticum aestivum
  unsure (1)..(665): unsure at all n locations
  Clone ID: PAT_TA_105206
gcggggagaagcgttctatcaatcttagcagtcgataaaggccagagcttgctcatcgactcgtctcgtcttcgacctcacctcatttgtttttgattcctcttttatagttgccaatcatgtctgcctcagtgctcgactacaccaaggcccttgaggttctcaaggagtacaagcaaagggatggcctcgacatccacgagcttatggacacaaccaagcatggaggtctgacttacaacgacttcctgcttctccctggctacattggcttcgctgcctctgaggtcactcttgattcgcccatcaccaagcgcatcaccctccgaacacccttcgtctcgtctcctatggacactgtcacggagcacgagatggccatccacatggctctccagggtggtctcggtgttattcaccacaactgctcccctgaggcccaggccgacatggtccgcaaggtcaagcgatacgagaacggtttcattaacgaccctatcgtcatcgaccagaacaccactgttggtgaggccaaggctctgaaggagaagtggggcttcggtggtttcccagtcactgaggatggcaagcttggatccaagcttgttggtattgttaccaaccgagaccttcagtttgaggaggatcttgaccaggctgtctcn

SEQ ID NO: 105207 - DNA, 345 bp, Triticum aestivum
  Clone ID: PAT_TA_105207
gatgttaaatactctcttcgtccataatataagacattattacattcaatatgctaatataagacgttattacatacaatatgcaagcatattgaatgtaataacgtcttgttttatggaactgagggagtacaacaaaataagttgcttgggtttaaggacaacaaactgaatattcaggttagcaaaacagagcactggcacttgttttagcaacgtaatgggtgtactgcagttgcaagatcagacactaaaatcttattctaaccagctgcaagttttagcaacagcatgaggttggaaggtaaaaatacagctttaaggcggtatgtcaatttatcttaa

SEQ ID NO: 105208 - DNA, 715 bp, Triticum aestivum
  Clone ID: PAT_TA_105208
gcgggctccatgtttgccgctaaggccggtgctaagcatgttatcggtgtcgatatgtccaccatcattttcaaggcccgtgagatcgtcaagatcaacggcctttctgacaagatcacccttctccagggcaagatggaggaggttgagcttcccttccccaaggtcgacattatcatctccgagtggatgggatacttccttctctacgagtccatgcttgacaccgttctctacgctcgtgacacctacctccagaaggatggtttgatcttccctgacaaggccaccatcttctttgccggtattgaggatggcgactacaaggaggacaagattgagttctggaacgatgtttacggtttcgactacacccccctcaaggccactgctctctctgagccccttgtcgacactgtcgaggtcaaggctgctgtcaccgaccccgctcctgtccttaccctcgatctctacacctgcaccgtcgccgacctggctttccaagtgcccttcaagttgtctgctaagcgcgacgacttcatccacgcccttgtgtcatggttcgatatcgacttcaccgcctgccacaagcctatccgcttctcaacaggtccccacaccaagtacacccactggaagcagaccgtcttctactttgaggacgtcctcaccgtccagcagggtgaggagatcacgctcaaccttgatgtccgac

SEQ ID NO: 105209 - DNA, 587 bp, Triticum aestivum
  Clone ID: PAT_TA_105209
gcgggaggagagataataataacccgtcaaaaggaagatatcgagaattataccgagtactgtaaccagattttgaggttatcaaaattctgacagagttgctacatatatagactagatactggcatgtatgagatagaactaaatcacagaaggttgctcgatggaatgctggagatctgtggcatgccttccgagaagttcagaacggtttgctcgagtatcggcaagctcgacaaactgacaatcgaagacgtgaaaaaaaaaacaaccgttagatggaagagaaagttgtaccagatgaaacactgaaaagattggaagtctagtgaagaccagaggactggcactggaagttctgctggaactgataatgaaggtagcaagttcatggagaatgctgggtctgttgttgtctggcctggaatactctgctcggtttatccccggatcctgctacagtttctcccaccagatgaaacacaggacttgcgtttgcaactcattaatagcgcaccttcataagcctactgtgcaacgctcaggtgcaagagctatccgcgtaagatctgttgctgacctactgc

SEQ ID NO: 105210 - DNA, 417 bp, Triticum aestivum
  Clone ID: PAT_TA_105210
ctataaccaaaacactatacttccattttgctagcctattaaaacaccagtataagaacaaatggtccgccagatcatcgcttaatggccgaatttccaccacgatgtcttcttctgaggagtctcgagctcctcgcccttgggacgcttcagggggtgtgcctcggtattaagcacccaatcatccaggttgataacattgggatcctcaaaggtgaggtagaagtacttaattgtttcggacatccaaaaggtctccatgttatcgcgcttatcgctaccctttctgttgacatcagtgattgtagcaaaggcctcctgagtctcaaactgcttgacaatgttatcccacatgcgccaagcaatggtgcgccagacattattatctgtgatacgccacatgtagaagacactgtg

SEQ ID NO: 105211 - DNA, 513 bp, Triticum aestivum
  Clone ID: PAT_TA_105211
gcataacactgaaggcaaatgattttataactctgaggatacacagcaacattgctgttgaataaccacaatgcattacatttgattaatactcattgtccagcacatctggaatgcaagagatacacaaattatccttgtggaattaacataaccagaagtctaattatgtattcatcctgatactacctagaaacttatccaagtcagaaagcaacacagctttcacattagcatctaataatcatatcatgcatgctgatactacttggaaactaagcagaaggctgtagcaaaataataccaccatcagccattacttagacatgagttgtgcatagccaaaagctaggcattgactacttagaaactagtggtttgcaaccaaaaggatccaacaatatgggataccaccaatcaatcttactcacaaagggctagagttaacaggtggatcattttcaaggttactagcaggatctttgtttgcaaggttgccaacatgagcatttg

SEQ ID NO: 105212 - DNA, 670 bp, Triticum aestivum
  unsure (1)..(670): unsure at all n locations
  Clone ID: PAT_TA_105212
gcgggctgctcagagtctctcctgcagttgaagctcaaggatctagatggcctgcagcagctcactgtcgtggcgccgacactcaaagagctaagtgtgatcctttgctttgctccgaatcaacctattgctagcgtctcagcgcctgagctggtgtcgctccagtggaatgatgcttatgatccatgctctgtccaacttggcgagatggcacatctacaatgtctgcacgctggcatttttctcgtatatggaccagttgattttacacccaatcgcgattgcctgaggatcttgcaggacttcaaggtcatgcacagtctaaccctcctactgctctataatccggatataggtaacaatcgatacttgatggaagacatgacaaggctccctgacgttacatgcttgtccctgactgtgatgtcaaacggacattgctttggtgccagctcattccacattctcggactgtgtactggtgtaagaaagatggcactcaactactttgaggcgcagactccatgcccatcgaggtgcatttgtgatcaggcgacacactgganaaccgagaaactggtgcttgatcgtctgcgagaagtggaaatgagtgaactatggtgaactgaacatgtaccggtttttgttgcatcggttatttatttggtta

SEQ ID NO: 105213 - DNA, 682 bp, Triticum aestivum
  Clone ID: PAT_TA_105213
gcgggggagcagcagcggtcattcatcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctgcaagaacttgatgaccctgcccaacatcaagatcccactcatcttgggtatctggggaggcaagggtcaaggaaaattcttacagtgtgagcttgtcttacccaagatgggcatcaacccaatcatgatgagtgcccgagagctgaagagtggctactcctgagagccagtcaagctcatcaggca

SEQ ID NO: 105214 - DNA, 685 bp, Triticum aestivum
  Clone ID: PAT_TA_105214
gcggggaaaatgctttcaacacttcatttgcagaagaagttggtgtggacattgacaaactcctaatagctcaacctgattctgctgaaaattcattaagcatagtgaacactcttgttggtggatccattgatgttgttgttgtggatagtgtggcagcactgattcccaaatgtgaacttgaaggtgaaatatacatgaaatttaaagacgcacaatctcgtttaatgactcgggcacttcgaaaaattcaatacacattaagtcgctctgaaacacttattatttttgtgaatcaggttagaacaaagcgtagctcagatccatcttctgggctctacaaggaggtaacctgtggtggcaacgcgttagggttctattcagcaatcagaatgaggacatcgagaaggaaattgcactattgcaaagaagaggccactggcatcagtatagcagtgcagatcatcaagaacaaattagtaccagcagccctgaaggaagctgggctcaacattgggtttggtaagggaatctgccatgaatcagagattctggagatggcttctacgcatggagttatcgtgaaggaaggatctgggtattggatcaacggcgacttcctgcctgtcaaggaggaagccgagtagttcctacttgagaacgaagctgtggcatacgacatctg

SEQ ID NO: 105215 - DNA, 694 bp, Triticum aestivum
  unsure (1)..(694): unsure at all n locations
  Clone ID: PAT_TA_105215
tgcgggatagacttacatctgcagttggtggacctttcatggatagctcaaagccagaatattttgatttggaaaaatttgtcaagtggctcatggatgaaatcaatataagtaaaccatttcctgccaaaacacgatgttcttttggagaagtatctatccttattttcatgtttttcacactcatgttccgtaactggcatcagcctgggagtgatggctctcattcgaagtctggtggaagctctgatttgacggagaaaggtcatgttcaggttccagtgtcaacgacaggcccctcgtcctccagtgatgacaaggataaaaatgaatttgcttctcagttaattcgtgcttgctctgccctcaggcaacaatcatttctgaattatttaatggacatactgcaacagcttgttcatattttcaagtcatcatccacaaatggagaaggtggttctggttcaggatgtggatccctattgacagtgcggagagagctaccagctggaaacttctctccctttttttctgattcatatgccaaatctcatccgactgatctattcatggactacaacaaattgttgttggagaatactttccggctagtatatagcatggttcggccggagaaggagaaatcggctganaaggatagaagctacaaggttcccaacgctaaggatctcaa

SEQ ID NO: 105216 - DNA, 500 bp, Triticum aestivum
  Clone ID: PAT_TA_105216
gcgggggctgcaaggagatcagaccagagaccaccattcactcagctcgtttctctcgtcatcgatctatcaacgtctccctctctctccctcaagtcttgtcacctgcgctggccggagaggaatttggcttctctctttctctgcatatccagatccagggtcgctgccgtcggcatgagcattgtcttctcgatgcaaccttacgcggccggacagcagtaaagcgtgtcgctcagatctgactgagggttttgttacatcagtggacaatttgtatcagttccggtttgtgctaaatatttgttggcgcttcagtgatttactggagacaactttcttgtacaagtaccatatgctgctatagaaagagcagatacatggatcttgaggcccttgggcgtatacttgatggaagagagaagccgacaaatctatcattctagcttttgaagagtgtcacactatattgctgacatgttcgttaaatggtccatggt

SEQ ID NO: 105217 - DNA, 314 bp, Triticum aestivum
  Clone ID: PAT_TA_105217
gaacaaagtttgaattaaatttaaattcaaaccaggtcaaacatatttgcctttggagtatacattacatgatcaacaagtatttgatacaggttttcagacgcaaaaagaatcaattgaataggatatacggttctcctgatatgatcaaatgaaggtatgagttcaaatccgaattgatcaaatttgaaatgttcaaaagttaaaacttatgagtgaagtgaaaatagggctccggaatgaaaccaacggaattggatttgtcaaaaacggagctgcagtttaaaaagttctgatgaatggaattccagggc

SEQ ID NO: 105218 - DNA, 554 bp, Triticum aestivum
  Clone ID: PAT_TA_105218
ggaggcgaattctggaaagagacatggatctcctgcgcagcgcagagaaagcgaatggaatcgctggatcagatggcgatggtcgggatgatgaagcccttatctggagaaggggaattttgcggccacctacgacagagaaggctgctgatatattgctagaggtactgctggactgagattacgaagctatgctcagagttgcagccttcaagttcttgattcggatgctgcacaaagactgatccctgggttacgtgttccgctcaaccttgcgatttatatgccactagcactgaacatcaaccctaagaaatatttgcaggcattgttccttgcgtgccaaaatatggccaaggaaacatctgtatcacccagtgaactgaaagagttcagtttgtacaacaaacatatcgataatctacaacaactttcaggagattatgatgcagtgatcatctgccttgggggcaaagctagctcacttccagaacttacaaataagttgcctcttagaacctgtagaggagttattgctgaattcaaactgccat

SEQ ID NO: 105219 - DNA, 594 bp, Triticum aestivum
  Clone ID: PAT_TA_105219
aatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactcgttctgttcagcgtgtgac

SEQ ID NO: 105220 - DNA, 568 bp, Triticum aestivum
  Clone ID: PAT_TA_105220
acaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcaaaccatcccggcaatgtgcgacgtgcatgttc

SEQ ID NO: 105221 - DNA, 198 bp, Triticum aestivum
  Clone ID: PAT_TA_105221
ttgttgttgttgttgttgttgttgatgatgatgcagaataatagcatgaacaacattgtgtatggccgactagtgtttcatatgactatttgtgagtgagtgtgagagaattctgtatactattcagtactatttctgatctgtaataatgtgggcagtaccgtttaatttgattggtgaatgctaaagaaaaaaaaa

SEQ ID NO: 105222 - DNA, 351 bp, Triticum aestivum
  Clone ID: PAT_TA_105222
cgggcccttccgcgtggtcttcctggccaccgatgaccgcgaagaggtcgtcaaggcaaccgtgtactcgtcggcgacaggcgcgtggagcccgccggtgtctcttgacgacagctgtgagtgctatgcccggcacaagcgagacgcaactgcagaaatgatgttcttctcctcctacgtaccctatgtccagtccaggcgagtggccgccattggggatgcggtctacttcacaatttcgcggtccgctgccattgccaagtacgattgggccgagaatcacctgtctgtgattgacccaccaccaccagatacagaattgtacggtggtttcgtctccctcatggtcat

SEQ ID NO: 105223 - DNA, 332 bp, Triticum aestivum
  Clone ID: PAT_TA_105223
acaagcatcaaatccaagtacgtagtagttaacgcaaatccactatgaagaccttactcatcctaacaatccttgcgatggcaataaccatcggcaccgccaatatgcaggtcgaccctagcagccaagtacaatggccacaacaacaaccagtcccacagcctcaccaaccattctcccagcaaccacaacaaacatttccccaaccgcaacaaacattcccccatcaaccacaacaacaatttccccagcctcagcaaccacaacaacaatttctccagccccaacaaccattcccccaacaaccacaacaaccatatccccagcaacca

SEQ ID NO: 105224 - DNA, 202 bp, Triticum aestivum
  Clone ID: PAT_TA_105224
ttcctggatatcggggcgagtgctgagacagtgcacgggaaatccgaaggtggtgtttgggctgagggatgcctttgttaagctcgaaaaggattggagctgtctggggttaagatctctgagccagagtttcacggcactcaggtgccaatggtggcaatggtcgaaaatggcatggatttggatgacgcaaaggtggaaa

SEQ ID NO: 105225 - DNA, 464 bp, Triticum aestivum
  Clone ID: PAT_TA_105225
gcgccgtgttcaattgcgctagcatacaatcagttcacattttcaagtgtacacacaggtatgccagtccatgcaaccatcatcaccagtacaattgtcgtagtatttttcacaaccctggtagtaccattaaccggatcccgcatttttcgttacatgatgttctatcggcgaaagacatacacggcacattgaagctgatacattctgatcacttgaggtgtttggcttcttgacaaggccaatgataagcgccatgctcccgcagcatcggcaccgggagccgacgggaggccgcagcacgggaagcaactcgccgaaggacgagttcatcctgccgtttctcggcgacgaagacgcgtcggggagtggaagcggcttcgtccaagccaagagaagcatatcaatgatgctggagagacccatccacacggtgcacatctactggaggaagttcgacgaca

SEQ ID NO: 105226 - DNA, 480 bp, Triticum aestivum
  Clone ID: PAT_TA_105226
gtttttttttttctttttttttttttttttaattcaaaatcatttattttatttacaactcattcaagggactttttttcgtattcctcatattgaaaaggaacaagaaaaacatatcatgtaattccaaaaaaccaagagaggagcatatagtgttacataaatatttcagtttttcaaggagatcctttttggtcagctatccaaacatgatgttgcatttcacagccgcaaaaatgtgctactttgaattcgtcttcccatacacagtaattgtttgtgaatggatgatcagggccaataagaccaacaatgagtcctttctttgctttgctgattctattttcaacttgccatagagatcatatcctgctctcccgctccagcagcatgtcgccgacgacctcgttgaaccggatccacgcagcatcggccggccatgaaaacaaatgcagcctcattactgtattctgaaaaagt

SEQ ID NO: 105227 - DNA, 625 bp, Triticum aestivum
  Clone ID: PAT_TA_105227
acaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcaaaccatcccggcaatgtgcgacgtgcatgttccaccatactgctacaccaccatatcaccatccagtgacgtcactaccgacatgggcg

SEQ ID NO: 105228 - DNA, 613 bp, Triticum aestivum
  Clone ID: PAT_TA_105228
acaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtt

SEQ ID NO: 105229 - DNA, 454 bp, Triticum aestivum
  Clone ID: PAT_TA_105229
acaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccggccccaacaaccccaact

SEQ ID NO: 105230 - DNA, 372 bp, Triticum aestivum
  Clone ID: PAT_TA_105230
ggcgagcctcacactctctgatcacagtaggactagcttcagctagcctgcagcgtctgccactccgggcattttcttgcatcaaccacggcaatggccaccgctgatgtccagaacccgacggccgcgctgacggaggaggcgcccgcggtggagacgcccgtcgccgccgaggaggttgctaagacagaggaggtccccgcgccggtggaggccgaagtcgaggcgcctgcccccgtcgaggttgaggcgaccaaggaggacgcaccggccgccgccgagacgaaggagaccaaggagcccgagccagcagctgctgccgagccggaggccgaggcgccgaaagagccagccgtggtcgagacagagacc

SEQ ID NO: 105231 - DNA, 476 bp, Triticum aestivum
  Clone ID: PAT_TA_105231
gcactcttgaaagctttttcagtttcctctaatcaagtggcagcacgttgatgcttcattttaagtgggtcatgctagctgaacaaaaaacttaaattttgtgttccttatacctaattgagcctcgacagttcttgtaatggttgcctgtgagtgtttgtttgataatctctgtataggatttgaaattgatgtaagatatgtgctgctacagttttctgaagtaactatgcaacttcagggtgaggtgctttttttgtttagaacttgatatatttgtaataaacttgctgctattggtatgtttgaacttattgcaacttgaaatcatttcaataaactagtattgacattatctcctactgccgatcaggccattatttctgctgcatgcccaagtatttccacatcttgttctgatgatataggctacttattgttggttcattgtaggtctcttgaagctttatataaat

SEQ ID NO: 105232 - DNA, 373 bp, Triticum aestivum
  Clone ID: PAT_TA_105232
ggaagatcacaagttctgcaacaagagtacttaccagctgttacaagaattgtgtggtgagcacctatggcagatccctgagcagtcgcagtgccaggccatccacaatgtcgttaatgctattattctgcatcaacaacaaaaaccacaacaacgaccatcgagccaggtctccttccaacagcctctgcaacaatatccattacgccagggctgcttccggccatctcagcaaaacccacaggcccggggctctgtccagcctcaacaactgccccagttcgaggaaataaggaacctagcgctacagacgctacccgcaatgtgcaatgtctacatccctccatattgcaccatcgcgccatttggcatc

SEQ ID NO: 105233 - DNA, 570 bp, Triticum aestivum
  Clone ID: PAT_TA_105233
tacttacttggttgcgccatggcgaagcttcaaggcacaaggctgggcgccttaagggcctatgtctttggcttcttcatctgtacatcaggcttcttgtttggatatgacactggcatcgtcggtggtgtccttaccttgcaatcataccaggatgactttcgctacaccgacaagaccaccgtcagcgccgtcatggtcagcgtacagaacgtcggcgcatttctagcagctctgagcatcttcttcatctccgctcggttcggtcgacgacggacaatcatggcagcttgcgcggtcttctgcatcggcgtcgttctccaagtgatcccgtcccactctctcgtgtgcttttacattggccggttcgtcgctggaatcggcttgggtgctgcgacagccgtgacaccttcgtacaacgtggagatggcgccgaaggagatcagagcaaggctgggatctggacagcagcttctattcgcattgggcgtaatgatatcttactggatagattatggcgtcgccatatctgagtccttgaaaaggaagtctgcgcagtggcagataccg

SEQ ID NO: 105234 - DNA, 611 bp, Triticum aestivum
  Clone ID: PAT_TA_105234
gtctgcaggaatccggtgcttcagccagacgtccaaacacagggatttgcaagaccaggctgacatcaacaaacaaaccatatctaacggatttcctccaatggcatcagataaatccaagggcaaacagccagcggttccgagaccaagcgcatcggtgctactggtttcgcctcaaaaccagatcttgctgcttcaaagggtgaagcagtcatcttcttttgcatcggctcacgttttccctggtggcaatgtgagcgagttccatgatgggaaaatgccaggacctgaatcagacgacagacacatcgagtccgagatttaccgactggctgctatcagggaaacctttgaagagtcgggaatccttctcgcccgaaatgctggctttggacgcttgattgaagtgccggaggtggaaagagaggaaggccgaagaaaggttcactcgaatgagacttcttttctgcagtggcttgcacagaaaggtggaaaggcagacacggatggcttgataccattcactcgatgggtgacacccacgaatgtcccgaaaagatttacaacgcagatgtacatatactttctaccaacattgtctggtacacctc

SEQ ID NO: 105235 - DNA, 508 bp, Triticum aestivum
  Clone ID: PAT_TA_105235
aaaaaggaaggttaacaagcccgagcctgaagttgttacggctgaagaaaaggagctgcaaagagtgcttcgaagtgaacaaatcatgaagaaccttttcaatgctttatggactgtttcaaaacaaaagatttcagagtctgaggttgctactaaaagcatgcgagagttgctcaaagataaagacactgaaattctagagctgaaaaaagagttggatgacctgaagtttcgttgttcacacgttaagcaaaatgatgctgcatcaattgctataagctcggttgttcaaactgaccttgccagtgacgctgcattaaacaatttccatataatgggacaagtgggcaacaaggaatctgatggttctgagagttgttctgaacaaacatcggcacctgacggtggtgtaacacatgcacccagtcatttggatgatccatctgagacaagctttacagaacttcatatagttccatgtaatctgtccgcacagtttactgatata

SEQ ID NO: 105236 - DNA, 490 bp, Triticum aestivum
  Clone ID: PAT_TA_105236
tacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattccc

SEQ ID NO: 105237 - DNA, 378 bp, Triticum aestivum
  Clone ID: PAT_TA_105237
cgagcacaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccgcagccccaacaaccacaacaacc

SEQ ID NO: 105238 - DNA, 383 bp, Triticum aestivum
  Clone ID: PAT_TA_105238
cgcgctctcattcgattttgatgatgatgatgatgatgatgatgatgatgatgatgatgatgatgatgatgatgattggaaccaagaggaggaagcaagtaagtgtcatttgattttctattcatgaggttacagtaacaagatatgtaaagtctggattggtctacttatcacttgtatgtcccatacttgcatttttttagtgctttcgtcttgttgcctctcagtgtatcactaaataatcagtgtgtttgggtacttgcttgttgctgcctttcagtgtatcactaaataatcattcgaccggtgttggcaatgttgcatcgatcctatttatttctggttctgtatgcctcccaagctacaacttatacccaaaatta

SEQ ID NO: 105239 - DNA, 556 bp, Triticum aestivum
  Clone ID: PAT_TA_105239
ctctcctcctcctcctgccaccgatcccgaaccaggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcact

SEQ ID NO: 105240 - DNA, 515 bp, Triticum aestivum
  Clone ID: PAT_TA_105240
aaacattacaaaaaaattctgaacataaccttaacttattttaattggtagttattgtaattagaagcatttccctgcaaaaataaaataaaagcatcaaatatggcctaaatatatctgaatcatattgtgaatttagatgggaaatgtaacagaatggagtctaagtattttggtagattattttggactatgaaaaatgactataacagaaatatcgtgactttggaccagccgggcaagcaaacaggcaattgtgccaaaaaggcaagcaaaaagactgagagaagtgagaaggccctttctacacaacaaaaagacaagtgtcaaaaaggtaatgaaaagataaagagaagtgagaaaaggtcatttctatacaaaaaatgcacttgtgccaatgccagaagaaacccgacacatcatatatagaaaaaggcacttatgccaaagcatgtgcagctatcacagtgcgtgcgtagctaccaccacgcataggaaatcgtctctattgtgaa

SEQ ID NO: 105241 - DNA, 227 bp, Triticum aestivum
  Clone ID: PAT_TA_105241
ctcctgtggcaatgccacatcatattgctaggtatgaaatgtcgcaacggaccagttgccatgtgatgcaacaacaatgttgacatcagttgccgcaaatgccccagcaatcccgttatgaggcaatccgtgctatcatctactccatcattctgcaagaacaacaacaggttcacggttccatccaatctcagaagcagcaaccccaacagttgggccaatgtgtt

SEQ ID NO: 105242 - DNA, 616 bp, Triticum aestivum
  Clone ID: PAT_TA_105242
acaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggca

SEQ ID NO: 105243 - DNA, 667 bp, Triticum aestivum
  Clone ID: PAT_TA_105243
cgacgatggtcggcgtcagctgccacttcctccccccgccggcgccgcgaggccgccgagcccgcgcccgagcttcccgtccgtgagcggtcactctgcccaccggccgtccctcgtctgtgtgcttcttctcgggatgctgacgccatggagctcatcaagctccctctctgctgcaggaggattggatcggattggtttctacatgctctattatctgtttgagaactgagttgcggccctccaaatcttcagccccagaaggaggatttgagagtggagaagggtcaactgaatgtgatttggaggaaggagttgtccaggaatcaaaatgttattattctactattctgcaggggagaatctaaagattatttgtttctttttatgcctgcagatcgcgtttagtgtttgggattcacaccctacattgataaggtctgaatttaacatccacttttaacactgggatcctcaagtgtttcagttcgtactttgccgacgtacaatctattggccacattttctagcacacttattccaactgaagtcagctcctgcttgcacttctccactgagtgaatactaatagttctaaaaagataaaccacccatagaattggttctaattagatcctctgaaagatgcaagcagctagagtacctt

SEQ ID NO: 105244 - DNA, 612 bp, Triticum aestivum
  Clone ID: PAT_TA_105244
aacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggc

SEQ ID NO: 105245 - DNA, 540 bp, Triticum aestivum
  Clone ID: PAT_TA_105245
tatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccttatctacaacaacagatgaacccttgcaagaattacctcttacagcaatgcaaccctgtgtcattg

SEQ ID NO: 105246 - DNA, 477 bp, Triticum aestivum
  Clone ID: PAT_TA_105246
acaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccgcaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagc

SEQ ID NO: 105247 - DNA, 412 bp, Triticum aestivum
  Clone ID: PAT_TA_105247
gccaccatgttcacagcaacaacaaccaccattatcgcagcaacaacaaccaccattttcacaacaacaaccaccattttcgcagcaacaacaacccattctaccgcaacaaccaccattttcgcagcaacaacaacaaccaattctactgcaacaaccaccattttcacaacaccaacaaccagttctaccgcaacaacaaataccatctgttcagccatctatcttgcagcagctaaacccatgcaaggtattcctccagcagcaatgcagccctgtggcaatgccacaaagtcttgctaggtcgcaaatgttgtggcagagtagttgccatgtgatgcagcaacaatgttgccggcagctgccgcaaatccccgaacaatcacgctacgatgcaatccgtgccatcatc

SEQ ID NO: 105248 - DNA, 577 bp, Triticum aestivum
  Clone ID: PAT_TA_105248
taagccaagcaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtc

SEQ ID NO: 105249 - DNA, 530 bp, Triticum aestivum
  Clone ID: PAT_TA_105249
cctgtggagaagacccccgcgggcaagaagcccaagcggagaagaagtgccggcgtccaaggagggcggcgacaagaaggggaagaagaaggccaagaagagcgtcgagacgtacaagatctacatcttcaaggtgctcaagcaggtgcacccggacatcggcatctcctccaaggccatgtccatcatgaactccttcatcaacgacatcttcgagaagcttgccggcgagtctgccaagctcgccaggtacaacaagaagcccaccatcacgtcccgggagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataatagtcatgttgctgcttgaaaaaaaaaaaaaaaaaaa

SEQ ID NO: 105250 - DNA, 600 bp, Triticum aestivum
  Clone ID: PAT_TA_105250
tactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccagatagctcagcttgaggtgatgacttccattgcgctccgtaccctgccaacgatgtgccgtgtcaatgtgccgttgtatagaaccaccactagtgtgccattcggtgttg

SEQ ID NO: 105251 - DNA, 526 bp, Triticum aestivum
  Clone ID: PAT_TA_105251
cttcctcgtctttgcccttctagccgttgtggcgacatctgccattgcacagatggagactagctgcatccctggtttggagagaccatggcagcaacaaccattacaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcagctaaacccgtgcaaggtattcctccagcagcagtgtagccctgtggcaatgccacaacatcttgctaggtcgcagatgtggcagcagagcagttgcaatgtgatgcagcaacaatgttgccaacaattgccacgaatacccgaacaatcccgc

SEQ ID NO: 105252 - DNA, 233 bp, Triticum aestivum
  Clone ID: PAT_TA_105252
ctttcattgacttgcaaatatgaagttcactcccgcgctcattgccctggtcagtggccttggtgccactgctgctcccatggaggagactgcgcagccagtcgcgctggagaagcgtgcgggtggattggactatgtccaggactacaacggagatgctgctggtttccaaagcgataagggtgctggcaccttctctctcaagtgggggggcgacaccgacgttgttgctg

SEQ ID NO: 105253 - DNA, 427 bp, Triticum aestivum
  Clone ID: PAT_TA_105253
ggtgtattgttgattaataattggattttttgtcaccccacactgaacaagtgtcagttaactgtcgaacaaattcggttgtttgttctgacaacacatcacacaatttgtcgataaaattcagtattttattctgacaaaattattgggtttgacaaaattcagtatggctctgatcaacattttcgttttggttccatattgtaggttaccttagcatttggatgcaacactgtattacccttatcttagtcaacaccgtattcgtctcttagtcaacagaagatgtagcgagacaccatttgatggcatatgactgtgcttgctcattttctatatacctttgtacttctccaacaaacttactgatgatgcatgccatttgatcatttggaacaccatgtatgttttggtctgttatgatact

SEQ ID NO: 105254 - DNA, 568 bp, Triticum aestivum
  Clone ID: PAT_TA_105254
gcaacaacaaccacttttacctccacaacaatcaccttttccacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgcca

SEQ ID NO: 105255 - DNA, 307 bp, Triticum aestivum
  unsure (1)..(307): unsure at all n locations
  Clone ID: PAT_TA_105255
cgcgcccccggcccgcgcaaggacgaggtggtgacccgcgagtacaccgtcaacctccacaagcgcctccatggatgcaccttcaagaagaaagcaccaaatgccatcaaggagatcaggaagtttgcacagaaggccatgggaaccaacgatgtccgcattgacgtgaagctcaacaagcacatctggagcagcggcatcaggagtgtccctangagagtccgtgtcaggattgcccgcaagaggaacgacgaggaggatgctaaggaggagctgtactctctggtcacagttgctgaagtccccc

SEQ ID NO: 105256 - DNA, 553 bp, Triticum aestivum
  Clone ID: PAT_TA_105256
cggcacgaggtgttaactgggctcttacgttcaattttgtcaatattttcacagttgagatcattcctttgctagcgtttctctccttttctccttctcttttcacctctcagtcatcaccatatcatcatccttatcaccatttgcaacaattttttccaactctcctttcatttagcctttattgctgaacattaacacagcaacagtttagtcaacagttgaaaaactctttgtttcaatttggttgcatttttaatgtgttcaaatcaaatcaatttcaacggttttactcatagttgaattgccaaaaattgttcttttttctacgccatctttatctcagttgttcagcgatattttgctattgccgtttttttggtttccagaattaaattgccctcatcgacaatactttccatcattattaccgtcatcataacattctccaacaacgataaaacctcaacaaattcacagaaatcatgacagtcgaagtagaggtatatgatgaaccaatggagtctgcaagtagtggatctcaacagagctt

SEQ ID NO: 105257 - DNA, 484 bp, Triticum aestivum
  Clone ID: PAT_TA_105257
gactcaaacaattaaccatcatttgattaacaaaagttggtaccttgtggatttgcctggttacgggtttgcagctgcgtccaagacagctcgaacggattggtcttcatttaccaaggggtatttcttgaacagggacactttggtcggtgtactgctccttgttgatgctagtgttccaactcaacaaattgaccttgactgtgctaactggcttggtcgtaacaatgtcgggctaacctttgtgttcaccaagtgtgacaaagtaaagaaaggcaaagggggtcggcctgatgagaacatcaaagtgttcctggagaacattggctcgctctatccaaagcctcctccatggatcatgacgagcagcaccacaggactaggccgtgacggactgctcctccatatgtcgcagttgaggaactactgggacaatgaggcaacctaagtccggggttcttctacaggctcgagacagctgaag

SEQ ID NO: 105258 - DNA, 586 bp, Triticum aestivum
  Clone ID: PAT_TA_105258
caccaaatgcttctggaacatttcatagcatgttcatgaaatgcatgaaagattgcgagtcagaagcagagtttgaggaaacatgggcaatgatgcgtcaggagcataatttgcaggatgaccagtggctcactgatctatttgagcagaggcataaatggtgcacagctcttcacaaggttgcatttgattgtggtattagatcactggataggaattttagttcacacaatgtgctgggcagcattgctgatgaatcaacttcacccactaattttgctcttgagtttgataaactggttgggagttggcgtacaaatgaatctgtagacgatattcagtgcaagcaaatttccccagagtgttcagttaagcagaatagtattttgcaacacgctgctgaagtttacacacataaagtctacaagtctcttgaaacagagtttctagacggatgcactggaacttcataccaggaaatgcaatgcagtgaaacactgtatagatttgagttcattatgcaaagtagtccaaaagtttggatagttttccttgacacctctaccatggaattgagctgtagttg

SEQ ID NO: 105259 - DNA, 386 bp, Triticum aestivum
  unsure (1)..(386): unsure at all n locations
  Clone ID: PAT_TA_105259
aaaccaccgtcggcgacggcggctgcagcgacgacgagagggccggcggcggcgccgccgccgagagcagcgcgttctgggcggagcagctctcccatttgcatgaggtgctgggcaagatgagctcggcggagagccggatccgggcggacacggaggaggccgtcaggcatgcgcggtccggcaccgccaccgcggcagctggcgtctgctcctcctgcgcgacccgcgcgacggccggcggtgggtgccggggctgcacgctccggtccgtcgcggcgcggctgcgcgacgccgggtacgacagcgccgtgtgccggtccangtgggcgcgctcggcggagttccccgcgggggagcacagctacgtggacgtggtggtgccg

SEQ ID NO: 105260 - DNA, 483 bp, Triticum aestivum
  Clone ID: PAT_TA_105260
ttcggcacgaggttaggctttaggagcatatcatctaatatgtgtcatgaatatgcaaacactatgaacaagtaagcaaaagttataggagacgtatcacatttcctatgctggtagttcatcaccttgggatgcagccaaaaaaacatatttatgaacactgtcgatcatcgtcgtgcctcatggacaaaccacaaaacttggcaaacacttgatagggatgatatgcctcttttctatgtgagaactggtaaacctgctcttcattagaattagaatatcgatccttcatatcatatcagtatttttgcttcacttgacaattttttattcagtataacaagagagtgttcgctctaacttcatgagttcaataagcacgtttcttttgcttctcaacataagaattatcatacatatacagtaggtatgagaggaaaactgcttccagttcagatccatgtggtgttgctatacatatat

SEQ ID NO: 105261 - DNA, 633 bp, Triticum aestivum
  Clone ID: PAT_TA_105261
caattacgcatttgaactcttctgcagaaggtcttttatagcaaaaaggacagcagtgtcctgattatcttttggaaactgctaaatctatagttcataggtgtcggggactgccactagcaattttatcgattggcggcctcttgtcttcgaggccacagacacaatatgattgggagcaattatacaatcagcttccaactgagctgtcgaacaatgatcatgtcaaggcagttttgaatctgagctaccatgacctatctggagacctcagaaactgcttcttgtactgtagcttattctcggaagactacccaatgtcacgtgagacccttgcgaggctctgggttgcagaaggctttgtgttgagaaaaggaaatagcaccccagaggaggtggccgaggaaaacctaaggaaactgatccaccgcaatatgcttgaagtcatggatagagatgaactgggaagggtgagcacctgtacgatgcatgatattgtgcgagagctggctctttgtattgcaagggagtagcggtttgtatccacaagcgactatggcacaatgcaacagatggatatggatgctcgtcgtctgtcatcatgtggatggaaagagaatactgcacggaaaa

SEQ ID NO: 105262 - DNA, 490 bp, Triticum aestivum
  unsure (1)..(490): unsure at all n locations
  Clone ID: PAT_TA_105262
ctcactaccagcgcctctccgcgatccaaatcctcctcgaccgcctcccaggttcttggtgcagcttttgccagtctcagcaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcanacttccttgtccaggccggcattgtgaagaaggaacacatcaagattcatggtttctgagcaactgccagctccatatcagagtctacatgcaaagcagctatatattgg

SEQ ID NO: 105263 - DNA, 508 bp, Triticum aestivum
  Clone ID: PAT_TA_105263
atgagcaacaagcgaacactatccgcgttgttgggacatgtggttacatgtctcctgaatatgcaatggaaggttcctcttctgtcaagtctgacacatatagctttggcgttctattgttggagattgtaagcgggtcaaagatcagttcatcccatttcatgacggactttacaaaccttatagcttacgcctggagcttatggaaagatggaaatgcaagagaattggtggactcgtccattgtggagaactgtccacttcatgaagttctacgatgtattcatataggtctcttgtgtgttcaagacaatccaagtgccaggccgctcatgtcatccactgtgttcatgctagaaaatgaaacggccccgcttcctactccgaaggagcctctatactttaggcaacgatatgatgaggttgaagaccaaagagataccatgggaataaccctgaataagatgactatcactgtgcaagaggggcgttagatgtttaattcatt

SEQ ID NO: 105264 - DNA, 573 bp, Triticum aestivum
  unsure (1)..(573): unsure at all n locations
  Clone ID: PAT_TA_105264
ttcaccccattagaaaaattcatgttatgctcattacttcggcaactggaggacgcatgccgactgctcacccttccagcgattgtcggtttacgcggacgacgtcattttgttcatcaaacccacagtcgcagatctaagctttaccacaatggctttgcaaatgtttggtgaagcgtctggattacatgtcaacttccccaagtcttcggcgatcatgattcatgccgatgagacagacactgagagggtctctcatgctctgccgtggcgtatggactcttccccgtgcaagtatctgggcttgatgctctccatcaagcagctcacccgctcggattggcagccagtggtggatgacgtgctcaacttcttaccangatggcagaggggcatggtgacaagaccgggcaggctgactttggtcaatacggtgattcgggcccggcccactcatcacctgcttgtcgccgatgcaccaaaatgggatctggagcgtgtagacaagagctgccgtgctttcttttgggctggaactgagcatattcatggcggcaaatgcttggtcgcttg

SEQ ID NO: 105265 - DNA, 529 bp, Triticum aestivum
  unsure (1)..(529): unsure at all n locations
  Clone ID: PAT_TA_105265
gtggtttagctggtgtttcattggcgtatccacgatactagccctctggtttctcaagttcttaggcggcaagagcaaccccaagaagaagcaactgcctcctgggccatggactcttcctatcatcggcagcctccaccacgttgttagtgtcctcccacaccgcaggatgagtaagatgtctcgccggcatgggccattgatgcacctcaggctaggcgaggtcccagcagtgatcgtctccagcgccgaggcggcggcacaggtgatgaagactaacgacctcgccttcgcaagtcggccgcaaggcccgttgcaggatatcgtcggttgtggcggcaggggcatcgtcttcggctcctacggggaccggtggcgccagatgcgcaagatctgcgtcgtggaactcctcagctctaagcaggtgaggcgcatggagggcatcaaggccaatgaggtanaaaacctcctccgttccatcaccgccgcgggtgctaccgtcaacgtcagcaccaagatggcggcgctc

SEQ ID NO: 105266 - DNA, 420 bp, Triticum aestivum
  Clone ID: PAT_TA_105266
ctgccaccttctctcctccaacaccatggcgccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacctgccacccctctccacggaggccctcctgaagcaggtcgactacttgatccgctccaagtgggtgccctgcctcgagttcagcaaggttggtttcgtcttccgtgagcacaatagctcccccggatactatgacggtcgatactggacaatgtggaagctgcctatgttcgggtgcaccgacgccacacaggtgctcaacg

SEQ ID NO: 105267 - DNA, 505 bp, Triticum aestivum
  Clone ID: PAT_TA_105267
ataccgctgggtctgtgccttacttcttgcattgctatttcaagaaagagaggtcaatcgatctaattcagcatcccattcaattcctgtgctctcaaacttgttaaggtcagacgagccagcatacaggtactttgctgcacaagctttggcaagtctggttagtaacggtagcagaggaactcttctggccgttgctaattctggagcagccaccggacttatatctttgcttggatgtgctaatgttgatatagctgatctcttagagttatcagaggaattcatgttggtgcctaatcctgatgaaactacgctggaaaggctattcagagttgatgatatcagggttggttcaacttccagaaaatccattcctcttcttgttgatctacttaaacccattccagaaagacctggtgctcctttcttggcattgggtcttttgacacaattggctgttgattgtgttccaaacatgctgctgatggctgaagttggaatc

SEQ ID NO: 105268 - DNA, 414 bp, Triticum aestivum
  Clone ID: PAT_TA_105268
ctccgcctcctgccggcgtgccgccacgccttccactccggctgcgtcgacccgtggctccgcgccaacccgtcctgcccgctctgccgcgcctccatcgcgctcccgtacccgccgctccccgagctcctccgcgtcgagctcggcagcgtcagcagccgccgctccacgtcgtcctcctcctccgcggccgtcgccgcggcgccgccagagggagtccgggcgtacccgctccccaactccaacaccaacacagagtacctcgtggaggaggacctccaggtcgtcctcaagccgcccagcgccgccaacccggcgccgccgccgccccccacggctcgaattaccggcgagccgagccagcagctggcagccgcggcggagcgcgggctgtacgtcatcgtgacgccgaca

SEQ ID NO: 105269 - DNA, 493 bp, Triticum aestivum
  Clone ID: PAT_TA_105269
cccccgtccaccacccacggcatcggccgctgctgcttcaggagctaccagtaccgcgagcggtgcaccaccgatgccgccacgcccaccaggtgcacctcctccaccaccacctccagggagacccggtggccctccgccgccaccgccgcctcccggctctctatccaagagccttgctggtggtgacaaggtgcaccgtgctccggaggtcgtggagttctatcagagtctcatgaaacgtgaagccaagaaggacaccacctctttgggatcaaaaacatcgaatgtttctgacaacagaagcaacatgatcggagagattgagaacagatcaacattcctattagctgtcaaagctgatgtggagacacaaggagaatttgttgagtccctggcgagtgaggtccgagcagcaagattcgcgaatatcgatgatgtcgttgcatttgtacactggctggatgaggagttgtcattcttggttgatgag

SEQ ID NO: 105270 - DNA, 508 bp, Triticum aestivum
  Clone ID: PAT_TA_105270
ccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaagtatgttctaatctttcggtctactcatccaaatgcatgcattttcatcttctcgcgcagccgtgtagtc

SEQ ID NO: 105271 - DNA, 532 bp, Triticum aestivum
  unsure (1)..(532): unsure at all n locations
  Clone ID: PAT_TA_105271
ccaagccgtcttcccccagagccacacacccttccgctgaagaagctgcagcagcttgcgagcgatggcgctggcccgtcggttcatcttcctcttccccgccgccgtcctggccggactcgcctccgcctccgcgtcgcccttcctgtctgacagagtttcccaggccagcaccggactgacggggaggaggagcttgctgcggaccaagaacgactgccctatggactttgagttccagaactacacaatcatcacaagcaggtgcaaagggctgcaacatcctactatggaatgttgtgctgctttcaaggaattttcgtgcccatttgcggcgtataacaacatgcagagcactaactgtgcggccacaatgttaacctacatcaacctccatggcacgtacccagcaggtctattcgacgagtgcctantaggcatggaaggggtttcttgcgaagccattccagcaatagaaaccggtatgtcaaatggtgggcaacgagttcaaggacacaaatcacggaactca

SEQ ID NO: 105272 - DNA, 458 bp, Triticum aestivum
  unsure (1)..(458): unsure at all n locations
  Clone ID: PAT_TA_105272
atcaccaccagtctttccctcactttcgcatctgcgaccgtctgtccctactaacaacctgacactccttcacttngaaaatccaacactctctcgaagatcacgaatcaatttctaggacaacactccttcaaaatgttcttctcaatcgccactttcgcagcccttgcggccagcacttctgctcttgcgattcctgccaagcgtgagaccatctcgatcactcctcacgacgcctactcgtcgtcggttggtgtgcttggttgcaagatcaacactgatcgcgtcgcctactggcccagcgccgttagctgcgacaagatgtgcgttcgcgtctccgccaacggccgcagcgtcaaccttctcaagattgacacttccggtggcgcatacgacattgcctacgatgcttacaactacctcgtcactggcaagtccgccaccgaggaccccatcat

SEQ ID NO: 105273 - DNA, 616 bp, Triticum aestivum
  unsure (1)..(616): unsure at all n locations
  Clone ID: PAT_TA_105273
cagtgtctctgttaaaaattattcataattactaggagcattccataatttgtatcgggctgtttatttatttattgaggaaaggcttgtatcaggctgtcctggtgggagtcttctcggtcctggtgtggcgacctangaaggacaaacagggttggtcggcaccaaagatgaaaacattgtcgagccttactttttgcaagttgcctcacttctactacttttagaggaaagatagcaatttcagtcatgttgcacgaacacttgtagatcgcggtgcatcaagatcataattgctacactcaaaggttacattgaccttatttctgacatttgcaaaaaatgtattaaaaatgctgcataatggcacatggagcaatttatacttaatatttcgcccggtgcaacgcacgggcatttgtactagtaaaaataaaacacggatatgagggcatcatgatcattctgagaacaacaacttatataatttttgtcatatgatctcttatgctagagtaacaattcaatcataattttaagtatgaatcataaacttcattgagaactaacaaactataatctcagccattggagtaattgcaatttatcataatat

SEQ ID NO: 105274 - DNA, 504 bp, Triticum aestivum
  Clone ID: PAT_TA_105274
tgtcatcctcacccatgaatcagttttgtcgcatgcctagaatatctgtggttatttagttgtggaagtttaccatctgttctaaatcttcctccgtccttagagaccatatatattggttgttgtagtagtattcaagtcctatcatgtcgcttggatgggctccagaaaccacaagtcactacttccataaattctccagagctatcaacagtagcagcagcaggagagcattcacttcctcctcatctcaaatatctgaatatatggtcctgtgatagcatgttgggggggatcctccgtctgcccacatcccttgagatgctttacattatggacaatagtcggttgacgtcgctggagtcgctgtcagcagagcaccccccatcgttggaaaccttttcactttctcactgtattaccctggcatccctgccgaatgagccgcaaacatacgggtctctcaaagagctttcaatacatggctgtccagctataaagaac

SEQ ID NO: 105275 - DNA, 491 bp, Triticum aestivum
  Clone ID: PAT_TA_105275
tttcatctcagaacatagaagctacacttgccctttcatctctgaacatagaagcttcacctggactcccatcccacggcactacgcagctgtctccccgaagttagggatggaggggcatcacctattccgcgagaccgcgaccaggcaccgggggaggccgcccctactcgcccctccgcctcgcaggcgatgggggaggaggccgctgctaaagttggtgagccgccgcagccctgttcgtttctatatctctctcgatccaggattcctggttggtgagctgcacccctgttcgtttttctctttctattcctgcttacaaatttgtgtttctctgttgccaccccctgacgtctgcttctgagtttgaggccactaattactctgcagtcctgcaaaaacaagtatgcatctgtgttttcttctttcaaaattatcaaaaaagagttgtctcccatgcaattcaaaggatttacacaagccatgtc

SEQ ID NO: 105276 - DNA, 448 bp, Triticum aestivum
  Clone ID: PAT_TA_105276
ggtgtacggcagcgtgctgaacctcgtgtccagcgccttcttctctgtcgacgtggcggacgtgggcggcgagtccgccagtgggctgcgggaggtcgtggaggacatcatcgcggcgttcgccaaacccaacatctccgacatcttccctttccttcggccgctcgacctgcagggctggtgtcgctgggcatgcgcccgctaccagaaggtgtggggcatacttgacggcataatcgaccgccgtcttgcagatgcccagacgtccacgggcgagcacgcgcatggcaacttcctggactcgctgctggagctcgtttctgcgggcaagattggtcgcgacaaggtgacggtcatactgttcgacgtgttcgcggccgggaccgacatgatggccatcacggtggagtgggcgatggccgagctacttcggcacccgcgcgccatg

SEQ ID NO: 105277 - DNA, 413 bp, Triticum aestivum
  Clone ID: PAT_TA_105277
caaatcgatgctggatgagatccgtgaattggaggtgccatgtttagatgaagaccctgtactggaggttaaggcaatcatcggtggcatcgtgtatttgtctgcctacgaggcatcgagtcccagtgcttgctggttgctatccttctgcactgaaacagagaagctgaacaaggtctgccctatcaccaactctgattttttctatccctatttgatggcgtggcctcctcttctgtatgcaacaaggtgaactctcttggctagaagcctagaagtggcttgactagtcagaggagtaaaaaaactagaactcaggtaattttatcggcactacggatattacgttttgttatctgactgacgatgatatctttgctacgtgtaagtcaagaattcaagatgtccaggtc

SEQ ID NO: 105278 - DNA, 225 bp, Triticum aestivum
  Clone ID: PAT_TA_105278
tcaatgtccaactgacttttcctgtacgctattgtctgctgatttgcaaagaccttataaccattatacatccctgaaagtgtttaatactcaaacatgcaagtagggtattagtcaatgcttaggctcatgcaggcactccctgattggttctgctttatgtctgtacaaatgggataaattgagcatgatgccgggctgtagcacgtcttgcttatatatacc

SEQ ID NO: 105279 - DNA, 195 bp, Triticum aestivum
  Clone ID: PAT_TA_105279
ctctctctctctctgtcacttatgcacattatattgccttctgctcacctatagccttggtctgcaggaacaaccaagatgatgcagcttcattcatgggtgcaataacttatgtaaaactagacttctacaacttctgcggttatagtataagttgctagttgtcaaaaggatctgcaccgtttcaaaaaaaaa

SEQ ID NO: 105280 - DNA, 373 bp, Triticum aestivum
  Clone ID: PAT_TA_105280
caatagtatactggctagatctgccgaatgaaaagaacatgcatgatcaggacatttcttctaaaccacttcccaatggaggaggcactttaggacaacatcggcataggaaaaagattaagaagtcattgacagcttgccctccttgccacgtggttgcaagtacctcttctgggcctgatactgctcctctgggatctgattctgatattttgcatgacgatgataagcctcctaaaaggagttctaagaagaaagtcaacaagtggaaacagtgcaggcgagcaaccggggaaaagcttaatttgttgccggaactcccctgtgaagagcatattgatgccgcctctcctgttgaggtataactgcctga

SEQ ID NO: 105281 - DNA, 420 bp, Triticum aestivum
  Clone ID: PAT_TA_105281
tcggcacgagggcgtccttctcatccagagaaaggagagacagggcgtgagggagataggaaagagaggaagaaaggagaaggagaggggggcgcaaggtgagggagatggtcgccggcggtggcgcctccggtgaccggccggcggcaggaccgatggtgtctggagttttggacacctgagcgagctaccctgctgctgctaattcttctctccccacgcctctggtgctgctccttctactcctcagatgcccatgcttgctctcaaacaatcattgttgaaggactgaagggcatgatttctggaccacagatgatgcattttattggcaggcacaatcaagggcccatcatctttctgctatagagaaggacggggttcaagttgttgggccggtggcatgggcaccatgatgtt

SEQ ID NO: 105282 - DNA, 312 bp, Triticum aestivum
  Clone ID: PAT_TA_105282
gatgatgtgggcttcagcagggataattatcttcgacgcggacctcaaatagagtctggtcatgtttctaattttgaaccttttaggatgcgagggttgggtccagagagaaggatgtctgaagacatatatgaacaacacagaagtagccctaccgttagggttgaaacaccatggcacagtattccttttgagcgacctcgaagacccttcccattggaagattcttgggatgcagatgatcattcatacccattgtcaaagaagctgaggactggtgaattgcatgatgctgaacttccccgaatatcc

SEQ ID NO: 105283 - DNA, 314 bp, Triticum aestivum
  Clone ID: PAT_TA_105283
gctagctcctcgctgccggccgcccgcaacatcgccgggtaggcacaagaagtggagaagcagatcgacaagcagcgagcagaagaagatattgcaagaaggttcttcctagaaaatccatagcattccatggctactgcttgggacgttgcctctgttggttggtccatggtcgtgttgggctggttggtgtcgcctgtcatcaccttgatcctgcccaagatcctttcccgcctgggtttcgatgcggcacagaagctccaggggctagtgatcagcatcatgcccgagatggagaacacgctgcgggccgt

SEQ ID NO: 105284 - DNA, 448 bp, Triticum aestivum
  Clone ID: PAT_TA_105284
tcggcacgagggcgaacgctcatagctagagctcctcacactcttcgtcctcgcgctacaccagaaggaaaaaagtgactgacacgagagtttagcaaaaccccccaaaaaagcatcgacatatgttctccccagtggaaccatctacatacggtacagctccacgccatcacgctcatgtgacacctgtcatttctccatggcactacttcctttgaattctctgtttatgaccctgtgacgtgagaggagaggacacaagcttcgtcgctgctcgccgcaaaacaacgtcgtcaatagctctacccccttggcaattggtacgcactcgctagctctaggctgccgtcggtttctatagcaagagttttttgcacgccgaagcaatcgtaacccatttttcttattcttgcaagcttgacacttatttgaatgaacacgactgtat

SEQ ID NO: 105285 - DNA, 677 bp, Triticum aestivum
  Clone ID: PAT_TA_105285
gggctgcagcattcggcacgaggcgccgacaagcatcctcggacgcgacgcccgccgcttccctgtgccccccctcggcgtcgccgcaggtatcttctgccctacccctctccagtttctccggcgcactcaaggaaacgcggaagctcgtaggattcccattcttgttcctctgctgttggggaatttttttttggatggattagttttactgctcgaatcaatcggtgctgttactgtgcgctcgtcgcctttccgatgtgacttgcgctgcagtgaatcgagtgctgactgctgattgaacttgatgctaccagtttcagactggcagagtacggacgcgattagtgcacgccattgatattctcacactacttcaacagtcagttgagcttttcttgcttcagagttactgtgccaagcttgttcgtatcataactaattcatatggtgtttttttatatttcaggctttactttcagtcagatctgaaagtgattgtcttgcatacattcagattcaggcgtgtcccgccttggaatggaggtaagaaaaaccaaagcccgtcatcttctccctcactcaccaccagcgaccacctcagtacattttcctcacctctgtccgcaagcaacaacttatataaaagtagatcggatttctttatttactctact

SEQ ID NO: 105286 - DNA, 484 bp, Triticum aestivum
  Clone ID: PAT_TA_105286
gggcatcttcatcggcaacctgaggaagcccatcgaggaggtgaggccgaagctggagaagaagatcgccgaggcggcagggacagaggtcaccctgtggttcatggaggagaggaacgacgacatcaccaagcaggtctgcatggtgcagccgaaagcagagattgagctgcagctggaggtgaccaagctgagcacgccgtggggctacctgagcgccgtggccttggccgtcacgaccttcgggaccatagctctcatgagcggcttcttcctcaagcctggcgcgtccttcgacgactacgtctccgacgtcctccccctcttcggaggcttcctctccatcctcggcgtgtcagagatcgcgacgaggttgacggcggcgaggtacggggtgaagctgagcccatcgttcctggtgccgtcgaactggacggggtgcctgggtgtgatgaacaactacgagtcgctgctgccgagcaag

SEQ ID NO: 105287 - DNA, 405 bp, Triticum aestivum
  unsure (1)..(405): unsure at all n locations
  Clone ID: PAT_TA_105287
tcggcacgaggcgctgatttgatgagaaatggagaagttcctggcctccacggcgttctgctgtaagatttggcgtattgccgtgtgagcccttgcgtgcgctcactggtttgctccggtggcttgttgatctctcggcggtgatgctctctgcagccgccgtgatggcgccagtcccggccgctcccaagagctccctcgaggtcttgctcgagaccataaagaagcgcgacgagcggcccaaggatgagccgccggcattgccggcccgcccgacgtgccgtggccggctgcccagggcaagacggtcgccgacgcctcctanggttcatcttgaggatggagtggcaaagggtgctgtggcggatactgacaagaagccggaagctgtaacggatactgaca

SEQ ID NO: 105288 - DNA, 283 bp, Triticum aestivum
  Clone ID: PAT_TA_105288
cctcccaaccgccccgccctatcgcctccacgcgagcccatcgccgccgcactctcgtgactcccccatgcgagcccaactccgctgccctcctgtgccgccccgacacttgccaccgatggggcggctgcgcgcgtgccgccaccatctccgccgcctccgcgagacgaggccgccaccataagctccagtccggcgcacttccccgcccgtgtaggtactctttcatcggccgtggtggtcgctgccgccgcgctccatctactgccctggatccgggcgg

SEQ ID NO: 105289 - DNA, 345 bp, Triticum aestivum
  Clone ID: PAT_TA_105289
cgacttcggcctcgcgcgcgtcaactccgaccccgacccggacgacaagctggagagcggcgcgattgcggagggcactgatgcgaatgagaacgctctcgatggggggtgcgacgatgacgtctctgttgtggcggagagcacggtcaccacgacggtagatggggaagtgaacgtcgcccccaagtcgccggaggttgacgacggcggcggcggattcacgctgccgtcgccggacgaggctgcatccacttccgggtttgaccagaccagtctcgacagtggtctgaacagccgcagctgcaatggtgtcggttcacgcaccggcggcgcgtcggggaccgg

SEQ ID NO: 105290 - DNA, 487 bp, Triticum aestivum
  Clone ID: PAT_TA_105290
ggcattcggcacgaggatcacaggtgaacatttgactaatatactcatgttctactagatcgttgatttgtccatttgtaagggaaaactatagtgcaaatgcatgacccattcccgtagtaactgaggatctttaaattttgtgaatttaattaggcgggtagcccatgtgcaaactttcaaacccttgcagactgctatcttctttctttggtgttccttaacttcttaaaagtatggaacaagcactcatatcgtttgctaacatgttagagctgatgtatggggccatttctttaagagtgacactagggactagtggtactagttttgaataaataataatgccatctttgttatcagcattgacaccatttaccaccctttgaaatgttcacttttcgagcacttactgatatgaacaacaggatattattgtctacatatgcctcccggctttttgtataatccttaaccagtacttact

SEQ ID NO: 105291 - DNA, 415 bp, Triticum aestivum
  Clone ID: PAT_TA_105291
cattcggcacgaggggctccgtatgtagtccatattgaaatctctaaaaagacttatatttagaaacaaagggagtatcgataccgctctaggggaaaccctaggtccttgagccggacgatggcgtcacatgtgtcgtgctaccctcttgtgggcatcgttttggagttggtgccggctggtgggaccagtggttgttggtgaggcatgcactgcagttggcctctctagggacctcacttgggtggctgaggcgcgaaggcggtgtgtggtggcggattttggtgatccatcatggtggcgtggcgagccgaaggaggtggtggtggcagtgccggtgtggttgaccgggacattccaaggtggcagtaggtcgccgccatggcgcgcagtgacaatacatggtgttttgtct

SEQ ID NO: 105292 - DNA, 523 bp, Triticum aestivum
  Clone ID: PAT_TA_105292
aaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattaaagtgtctggggttcgtggtcgttgattctgtgtctgattcgtgataaaatcgttcgattgcgttacctgtctaccattctaccccaaatccctgtacgaatcacatcgatcttattcaagttccaaatccgtcgagttataacttcaggcgtcgacattggcgcatctgcgttgc

SEQ ID NO: 105293 - DNA, 460 bp, Triticum aestivum
  Clone ID: PAT_TA_105293
gtaattaacttgtttatatgcccctaaactaatatcaacacccatataataatcacaaatacactacgagtaaaaactgtattaccgcctaggccgcgcctagggcgcttaggcaccgcctaggcactaggcgaaggccaaccgccccgcttacgcctaccgccttttccccaactgatatatgtcatatatatatactaggaaataagttttttttcctttatattattcttgtgttatgaaggtataagaacggatgaatggccagaaagatcaaatagtgataattaattgcaaaaaaatagcttcaggacaacactagatattgtcatgtttccaaaccataatatgatttattcttgcattctcaaggttcagaaaagaggcgggctaattcgaatctgattcatgcttgtataactccctgccttgcagatttatactaagttgtactcgatgc

SEQ ID NO: 105294 - DNA, 182 bp, Triticum aestivum
  Clone ID: PAT_TA_105294
gtgctccgactgctgccggtgtgggcgtgcggcatcatcttcgcggccgcctacacgcagatgaccaccaccttcatcctccagggtgacacgctggacccgcgcgtcggcagcttacgcgtgccccccgccgtgctcaccgtcttcaacaccctcagcgtaatgctctgggtgccgttcta

SEQ ID NO: 105295 - DNA, 355 bp, Triticum aestivum
  Clone ID: PAT_TA_105295
cggcacgaggcgccggccggccggccggccgaactcctcttccccgctgccgtcgccgccctcctcgcttccccccagcctgccatcccgtgcccgcctgaccgcgaacacgaccgccgctctccctcccgcgcgacaagcggctagggtttcgcccgcgtcgccgccccgcccaggccgccatgttccagctaggctccgcccccgggaagggcttctgggcgcggcgccggtggaagatgctgctctcgctgggcgtcgccggcgccggctacgcggcctaccgcttctacgacgcgcaccaaaagcagctcgtacgggtggagcagcgcgccaaggaggagcgcgccgccga

SEQ ID NO: 105296 - DNA, 379 bp, Triticum aestivum
  Clone ID: PAT_TA_105296
cattcggcacgaggggaagaacaattctagttaacccagtggggagagaccgcgagaggatgaaagaaaactggaggtcgatccattacaggccaaaggatgtgtgatttcccgacatttagttgatgcttccctagttctcgatctacttgaggcaaaaatttcagatcaggaccatgtacggtttatgcgctgcattggtgataaggagatttcggatgcgttatttcagatcggtcctttaaaggcacctggtcccgatggtctgtcagcgcggttttttcagcgtaattgggtaactttgaaggacagtgtcataaatgcagtcaaagaatttttcagaacatgactcatgccgacaggggataaatatttactg

SEQ ID NO: 105297 - DNA, 305 bp, Triticum aestivum
  Clone ID: PAT_TA_105297
cacgaggtatgatcgagcatgttgcatttcttgggagtaaaaagcgtgagaaactcttggggacaggtgcaaggtctaatgcatatacagacttccaccatacagtcttccatatccattctccaactaaaacaaaggaatatggtgaatctttactcccttctgtgttggatgctttaaatgagatagcttttcatcctaagttttcatcgtctcgcgtggagaaagagagaagagcaattctttcagagctccagatgatgaacacaatcgaataccgtgttgattgccagttgttgcaacat

SEQ ID NO: 105298 - DNA, 380 bp, Triticum aestivum
  Clone ID: PAT_TA_105298
cattcggcacgaggctgtagtgtaggtgaaacctccttcctatagctttctcggtagcttagaaattggcaactgcatcatggggctcgccacgagctcaccgaagcgcgcacatagtagtgcccctcgcgccggtgcgcgccatggagaaggccgctctggatcgcgtgacgatgcaagaatctctccccgcgatgctcctccacgccatagaagcccctctgatggtggcggcgcagaattctctagcaccgccgcctatcacgacggtcatcgtgtatcttctcgtggcggatcccaccacgtcagcttgcgcgagcaaccacgcccctctgattctggcggcgcagaattctctagcaccgccgcccaccacaacg

SEQ ID NO: 105299 - DNA, 488 bp, Triticum aestivum
  Clone ID: PAT_TA_105299
cggcacgaggcgcacctccttccgcgtcctaccctccgccgtctccgagataatctcacagcaccctggccctgcccgccggttttacttgcgttgccccggcgccggagacccaggcgccgacgacctctgcgcccaggcggagagctggcttcactccccggcactcgccaacctcgaggagctcgatatcagctacgccaacccccagctgctgccatctgcgcggcgctctgcatccaccctcctcgttgccaagatgagccattgtggtttccccaacgagatcgggccgtccatgaacttccccctcctcaagcagctctccttgatggacgtttacatctcggaggatgtcttccacgatttgctctctggttgccatgccttggagagtctttacgtgtccaaagtttttggtgtgagatgcctccgtattagctcgccgaaaatcaggagcatcggcttctatttccatagctccaaac

SEQ ID NO: 105300 - DNA, 335 bp, Triticum aestivum
  unsure (1)..(335): unsure at all n locations
  Clone ID: PAT_TA_105300
cagcaaccagcaaccagagaggccatagccaagttcttgcaagagaggaaagaaatcgaagaggcagagaaacagagggaggcagagatgggaagaagaagaagcccggctctgccgctgctggtgatcttcggcatcctcgccgtcgtcctcgcagctcttcctcccctcgccgaatccagcagcagccaccaccaccaccggcgccaaggccacggccaccactcccgtgtccaaagcanagggcacggaggagagggagagcantcgtcctcggcggcggcggcgaaggcgagggggagagcgtggccgtgctgcgacagctgcggcgggtg

SEQ ID NO: 105301 - DNA, 366 bp, Triticum aestivum
  Clone ID: PAT_TA_105301
ttcggcacgaggaaaaaggttcgagtgcgttccagagtgaggagtgagaagagatggctccggtgaagctgtacggcgcgaccctgtcgtggaacgtcaccaggtgcgtggcggcgctggaggaggccggcgtcgagtacgagatcgtacccatcaacttcggcaccggcgagcacaagagccccgaccacctcgccaggaaccccttcggccaggtgccagctgggggggatggtgacttatacgtcttcgaatcacgtgctatttgcaagtacgcgtgccgcaagaacaagccagagctgttgaaggagggcgacatcaaggagtcagcaatggtggatgtgtggctcgaggtggaggcccatc

SEQ ID NO: 105302 - DNA, 463 bp, Triticum aestivum
  Clone ID: PAT_TA_105302
tcggcacgaggttttcctttgcaccaaaagctagtaaggagagtgatatggaaaggaaatttttgttaagtgtgatgaaaatgtggtcctgatattttaatgatggcttgggaaatccacatttacaaatggaatggtttaaaactgaaagctgcttttaagtgagataaagacagttatacatcatcttctatttttgtttgtcaatagtcactcaaaagcaacttggacataatttgttctacttggattgaagtgcatcatcatcattgggaatctgagataatggttgtggtcactgtctgaagaatgcaaagctagcaaaaagacactgacttaagttactcagctgtctactggaaatgtttgcatgctaatatgagttttataggtaccatcagtctggttcatatctactataaacctcaactgcaagtcttgactttttttttttaactttaac

SEQ ID NO: 105303 - DNA, 167 bp, Triticum aestivum
  Clone ID: PAT_TA_105303
aactccatcccgtcagcacgtgtggattccatttgctgaagatttgtgcctgatattgatctggagagtagagagatgtggattacaccgccaaagggtcttcttgaggtcaatacacgtcgctgagaaatcaaagaaagaaaggcgtgcgatggattggaaggaaa

SEQ ID NO: 105304 - DNA, 414 bp, Triticum aestivum
  unsure (1)..(414): unsure at all n locations
  Clone ID: PAT_TA_105304
cagcaagtcaagtcaaagggcagcaggtaagctggcagaagcttagccatggcgaacacgaggctcgcggtcgtggccatgcttgtgatcttactgcagctgtccacgttatccgtggcccggcaccacgccaagccggacccctgcgtcggcgaggacgactccgtgccaggcatggtccacaagcacaagaaaccccactgcccgtcnccgggcggcagcggtggcggcggcggcggcggcggcacgcctggcgtgatgacggtgaacgggttccaaaaaggcgaggacggcggcgcaccgtcngagtgcgacggcaaataccacagcgacaaggacatgatcgtggcgctgtcgacgaggtggtacgcgggcggacgccggtgcggcaagatgatcaacatcaccagcaag

SEQ ID NO: 105305 - DNA, 434 bp, Triticum aestivum
  unsure (1)..(434): unsure at all n locations
  Clone ID: PAT_TA_105305
tcggcacgagggggacgcgcaggtgcagcagctgaacgcgaagctcctcaagcgagggcccagatggaggccgtcacggccgccgacgagaggtccaaggccatcgtgtcgaacctcacggcggcgatgcagcagctgcatgccgagaccgaggcggcgagcaaggaagaggagctgaccatgctggagaagcggtgcgtgctancagaggcggacaacgtcgccgcggagatggccacggccgaggagcggatcaggcagtctgtgaaggagctggaggcggcgaaggcgtccgagacgtcggcaatgaagaagctcaaggccgccgtggagagcacgatgcaggccangtcgaccgcggcgccacggcggcaggggactataaccgtctcgcggttcgagtacgagtacctgagcgggcgggcggcgctggt

SEQ ID NO: 105306 - DNA, 291 bp, Triticum aestivum
  Clone ID: PAT_TA_105306
gccgctgccgggcatggcgtacgcgtcgccgtacgtgctgtcgttcctgctgctgctgtccatgccggcggtgtactacctggcgccgcgcctgctgatgcccaagacgctcccggccatcccggacgccgacgagacggaggacctcgcgctcttccgccgcgccgtgctcctctcggccgcgcccgccgccggctccggctccggctccggcgcggcgcggtggggcttcggcgtcttcggccgccgcccgcaggcgcggcccaaggtggccttcctcttcctcaccaa

SEQ ID NO: 105307 - DNA, 498 bp, Triticum aestivum
  unsure (1)..(498): unsure at all n locations
  Clone ID: PAT_TA_105307
ccaccatcccttactatgaacagatataaagacactgatgctgtcagtggcactggtggcctatcaaagctgcctggtttgggccgtgctgcaaggagacagttagcagcaatcctcgatgagttctgggggcgtctttttgattatcacggtaagccgacactanaagctgatgctgaaaggatccaccttttgcttggactggacttgataagagatggttcagctgggagaacggataaccaaaacactcgagcttccaagaaacccttaacgagagatacagtgccaggatcaggcatctctactccagacttgtcttttgggcttcagatgggtaccatggggtcatcaacctggtcacagagcatgtatttaccaaacagagacaccctgagttcaagcagcatctttcttaaccaaaatgcaaaagaaatcacaaagcatgatgtggcaccttattgtgataaccagttctatcaacctactaccattcat

SEQ ID NO: 105308 - DNA, 368 bp, Triticum aestivum
  Clone ID: PAT_TA_105308
ttcggcacgaggctattcacgcctcgtcgctgtccgcgcggtcgcttgccatgctgctccggccagagcaccgcctccgctcgccgccagcgaccgcgcccgccccttcccgagcctccatttccgtctccgcgccggcgcgccctgccgtctcccgcctccctcgcggcgcgctccggctcccccgcgcggcttctccgctcaggggcaaagcgtcgagcgccgtgcgcgcgtcggccggaccggcgggcatgccgtccgtggcgcaccgggaggtggcgcgggccgtggcgggagaggcggaggcgcggctgggcgaccggctgctgccctcggccgtccccgccgacgtcgccgagttccgcaac

SEQ ID NO: 105309 - DNA, 440 bp, Triticum aestivum
  Clone ID: PAT_TA_105309
tcggcacgaggggccttgcatgcatagccgtgttgtatgtacagtcaattttgttatcctttgattttgttttgtatgtagctctcctcgcctggcaaagattgaaccagcacgcaccgtcacgggcaagggcatactggccccgaaagtggccgccttctcctcgcgaggcccatcaattgattaccccgccttcatcaagcctgacatagctgcgcctggatccaacatcttggcagcagtcagaaactcctacgaaactatgtctgggacgtccatggcagcaccacatgtaacaggtgttgccgcgctgctcaaagctatgcacccagactggtcttctgctgcaatcaaatcagccatcgtcaccactgcctgtgtaactgatcaacgcggcatgtcaatactggcggaaggactgccaccgaaggtggccgacc

SEQ ID NO: 105310 - DNA, 337 bp, Triticum aestivum
  Clone ID: PAT_TA_105310
gaggccccttcaaggccggcaagtacgagatgaagaagttctgcctggagcccacctccttcaccgtcaaggccgagggcatccagaagaacgagccgccggccttccagaaaaccaagctcatgacccgtctcacctacacccttgacgagatggaaggcccgctcgaggtcggcgccgacggcaccctcaagttcgaggagaaggacggcatcgactacgcggccgtcaccgtgcagctccccggaggcgagcgagtgcccttcctcttcaccgtcaagcagctcgtcgctaccggcaagcccgagagcttcagcgggcccttactcgtgcccaa

SEQ ID NO: 105311 - DNA, 332 bp, Triticum aestivum
  Clone ID: PAT_TA_105311
tcggcacgaggctagttccatatccacggccttttgatccgtccgacgcaccacccacacgccccaaacaaaacagcagcagccaagaaggaccctcgccggctgcagtcaggcgagcgatcagccagccgagtcctccggcggcgacggcggcgaccatggcgttagcagctaacgcccatggaagagtctgcaccttctcctccaggccgcccacgcctttcgggggggggagcatggtcaccatgcctggacaccatgttgagtcgccgcgagcacggttcgtggtccgggccgccgcggagcgcgcgacatggctgcccgggctggac

SEQ ID NO: 105312 - DNA, 181 bp, Triticum aestivum
  Clone ID: PAT_TA_105312
cacgaggcaacaacatgacagggaagcataccatgggtctttgtcaaacctgaaggcaatgatgacaatggtgtcacaggacacgggtgattatatttatgaggagagcatcccagtaatcacaaaggatcaaaagcgtgactacacctttgcaatctaccaactattggttgttcttgat

SEQ ID NO: 105313 - DNA, 448 bp, Triticum aestivum
  Clone ID: PAT_TA_105313
gggagagggtcctcctcttcaccggccatggccatgacttgtggctgtgccctttgcacatgcaagaagatgcagagcctgccatggctctctgctccgcccctttggtaaggtaaggtctcttctttttcttgttgtttagccacaagtttcctgatgcaatttcaagttcaagttgaagatccgcgacctctcgcacaaggacaagggcgacccgatgaagagaatgcttcttgggccaatattaggacggcccgtttgctcggagggctcacaagcgcaacaccactcccaaccctgccggcccattatgtttcccaggccagtggagtcgcgacggccagcccagcccattatgcctcccaggccagtggagtcgcgacggccgacccattatgcctctcaggccagtggagtcgcgatgatcggcccattatgcctcccgcgc

SEQ ID NO: 105314 - DNA, 299 bp, Triticum aestivum
  Clone ID: PAT_TA_105314
gaggcacacacgcacacacaccagattcatcaagaaaacctcgagaggatcatggccggcgtgaacaccagtgtggtcggcctcaagcccgccgcggcggtgccgcagtccgcctcgccggcggcggcaaagcgcgtgcaggtcgccccggccaaggaccggcggtcggcgcttctcggcctggcggccgtcttcgccgtcacggccgcctccgccggggcggccagggcaagcgtcttcgacgagtacctcgagaagagcaagctcaacaaggagctgaacgacaagaagagggcggc

SEQ ID NO: 105315 - DNA, 426 bp, Triticum aestivum
  Clone ID: PAT_TA_105315
actactatggtgatctgtgtggagacttgggtcattcggtccggtctcagcgtcgaggagagagcacttggcgtagaacagcacagaggtcaatgaagatggggttgaaaatggtttgaatcaacaatgtcacccttgggtcactgtcatgtaaccttgagtgcccaaacaaaaatactgtgtttgagccttgccacgatcagctgataggtaacgatacctcctcgtgcctctgcacaaactcgcttctgctgtaagcttgtcgcttaaggcgaggttggtgcgatggtgcactcgcctccacccggtccccccgctgctaagcccaggcactatgcggattctttttggtgcacctatatcgtgtcggtggttgcagcaagcatagcaaaagtcttgacctacccattaaatctgacaaaaact

SEQ ID NO: 105316 - DNA, 459 bp, Triticum aestivum
  Clone ID: PAT_TA_105316
tttttttttttttttttacaacagcgaaggtggatcctccttcatctgggatgatgaaaataaacgttgacggagcagtccaagatacaaccaaaaccgggcgattagtgcagtttgtcacaacattgatggacaacaccagcaaatgaatgactaatctgcatacaaaaaaccactaattgtaaaccagtgaagagagaaatctcaaatccagtgcaaattcctcctctatcaatcaggattgtgagctcattaaacacagttaatccttgatacatttttttgatgccagttattctaaaaaaaaccgatggcagtcctgttgctggctgagacagtaagattgatgatatgattttatgagactatggcagtgggttcacacagtcacagaagataactgtaatatccagttgactatccagaataagtacggcatcaacagtatacttatctatg

SEQ ID NO: 105317 - DNA, 616 bp, Triticum aestivum
  Clone ID: PAT_TA_105317
ttcggcacgaggcgccttagctttcttctggaggttgcggcaaggtccaccgcgagcgtcagtctgctgtatcccgtcgcagtcgccgaccggtgcgtcttactgtcgctgaaaaaattgcttggtgctgctgtgtcttcatcaagctgtctctatccaagaagtaagctagctagctggatgtccgactgatgcaaggttaggctgttccatgcgatttggcccaggtgtgcactacaagttcggttcatcctctgttttgctatccgtataagtgtgttgtgtttttctagaacctgagtgtttggtgaactagtgatctggtcgtgacctgattgtatgggagataaaattaaagataagatgggagatgccagtgtagacaaattatgtgagagtatgcaaaagttatttgcccagcttgttgagcaatcccagcaaaaatctaaaggaaccataactttggagcctaacccggtcaggctttctggacctggaaattatttcagttggtcacggcatgctactctgattctaggatctcatggcctcaaacattttttggacggcacttctgtgaaaccagatgataaattggaattggagcaatgggaac

SEQ ID NO: 105318 - DNA, 295 bp, Triticum aestivum
  Clone ID: PAT_TA_105318
acctgcctaatcctcaagtatattcttctgttccagattcagctctaatcctgctgcatgcccacgaaaatccaattgggttgctccccattcctcagaatgttgtatatttgcataaaagtggtgagatgtatatttatctgttcaatgtccacgtttgatcccgttgcgtgtccacaaaacacatgtttggtcgctgcctatcttttttaagatgtgctttgtgtgctgatgcatgctccacgaatattatatccgcataaggccggtaggatagataatttaacagctatta

SEQ ID NO: 105319 - DNA, 341 bp, Triticum aestivum
  Clone ID: PAT_TA_105319
caacaagcagtactgatgttgtgcagtgcagtgttgctgattcaaagaagaaagagaagccaaagaagtatggcagggttctcggtccagatgaacccttcaggttgttcctacgagaccgcgagacgacagagttcttgacggcaaaggaagagagacacctgttcagtcaaatacagggccttatgaaactagaggaggctcagcgtaggctagaagcacagtgtggccgcgagccgacgcttccggagtgggctcaggccgtaggaatgagctgcaaggaactgcagtcgtccatacacatgggaaggcgctgcagggagaagatggcccgctccaac

SEQ ID NO: 105320 - DNA, 261 bp, Triticum aestivum
  Clone ID: PAT_TA_105320
gaggcaaagggcgtcgcggccgttaccaagcggccggggagaagtggcgcagcatgtcggatgaggagaaggcaaagtatggcggcaagaaggcagatgccccagcaagcaaggtggtgaacaagaaggagagcaccagctccaagaaggccaagactgacgctgacgaagaaggttctgacgttgaggatgatgccgaggaggaggaggagtaaatagtagatgagggaacagcagcggtgcaaatcaacgtttgctgct

SEQ ID NO: 105321 - DNA, 482 bp, Triticum aestivum
  Clone ID: PAT_TA_105321
ttcattgctttccttttgtcaccgcttgcgaaatgtctcacaaacagctcctcgacatcgtccattaacctgattgcctattaagaggaagttttcagtcagaactcggaacctttggagttttggtagagtgaaatgcttcagatcttctcaagtgtgctgtatgattggaaaataccttgtcggagctattaaagtaggagctctccactactttcaggcaatgcgataaggagagaggcattggcaggaaccttgtcaaatttcttcaaaatcttcacaaaagccagcatgttcaagctcctgcaacaagagtgctttccctgtcagtacccactcggtgcacaaagcagaacaacataccaagttatcagctacacctaccgatatgtcttgaggtaccccaagcccttgtacagctcaaccagggctcctctgatcatcttctctgcctggtgcacctttttcttgttgatgctcaa

SEQ ID NO: 105322 - DNA, 201 bp, Triticum aestivum
  Clone ID: PAT_TA_105322
ttgagggtagatttagtcctactacttatctagcttgggagcttaaagtagaacaagtttttagtcaccatgacttttctgaacttgagcgagtgcgagcagccactagagcatttactaattttgcttctgtttggtggagtgtacattgtaagaaaaacattgatgaccaacccacaacttggaaagttttaaaagctg

SEQ ID NO: 105323 - DNA, 250 bp, Triticum aestivum
  Clone ID: PAT_TA_105323
gcgttcgcgaggaacagggcgctggaggtgatccacgggcggtgggcgatgcttggcgctcttgggtgcgtcttccccgaagtgctccagaagtgggtgggcgtcgagttcaaggagcccgtctggttcaaggccggctcgcagatcttctccgagggtggcctcgattaccttgggaaccccaacctcgtccacgcgcagagcatgcttgccgtgctcggcttccaggtccttctcatgggtctcgttg

SEQ ID NO: 105324 - DNA, 573 bp, Triticum aestivum
  Clone ID: PAT_TA_105324
cttgctccagactggttgtttgattcgccctatgaattgggcatcataagcatcatgggccgtgtaaattcctttggagttaaaaacccagacaaggctatccctgtcctgagacagctgcacttcctggatcagctcccacaagttgacaaattgcagaacttgttcttcgttgctcatcctttggagaaccttcatccatttgttttcggtcaaagcatctgccaccttgagatttttcctccaggccagctttgcaacctctggagccacttcaatgggtgcaaccccatgcagccactttgtctttccagaaatttgccttttgtccgttccccaaaatgatcttggtgcaggaggagaaaaggtctctgtctattgcagcgcacggaatttgggaacctctccaaggtctgtcagtgtcatcccattcaaaccaacaccatctgagtctcaaagctctgctataacaggttagctctttgattccgaggccactgagacttttcagggagcaacattgtttccaatttaccaagcatttacttccgcttgcctcctcatccccagccc

SEQ ID NO: 105325 - DNA, 228 bp, Triticum aestivum
  Clone ID: PAT_TA_105325
gcttaactatgttttgaatcatagcagagacgatcccatcattgtacagcagtgttctcttattcaaatgactggtcctaagagaggcattgaaatgtactccccagtttttattgagtttgatctaagggtcaagaatggagggcaagaggaagacgatctgcaactaattgatggcgcaatagcatgctatgatcagaaaccatggagaccaatcaaacatcgcat

SEQ ID NO: 105326 - DNA, 439 bp, Triticum aestivum
  Clone ID: PAT_TA_105326
cttgactggtacaaggggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgtgtgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccaccctggtcatatcggcaacggctacaccccagtgctggactgacacac

SEQ ID NO: 105327 - DNA, 464 bp, Triticum aestivum
  unsure (1)..(464): unsure at all n locations
  Clone ID: PAT_TA_105327
aaaaaggaggatgctgggatggagttacttctcgacgccgtcgacaggttcccactgctgtaggagttcgcggacagcgttgagcagccagatgtggctcctctggtgttgatgtggccaagcgaggccgcctgcggtgggactgtgaactcaaagggtgcttctggatgcagccagcaggtcancgatgacgagctaatcgggaggcatggtggagctcgctgccgtgcggatgcatctccgactaggtcggcgcagtccactgacagagtgaatccggaagttcctggatggacaaaaagattatggctaaggagtgcgccaccagacaggacaccatgtctgtcacggatgagcgcgctcgaggagtcgatccgcaagtttggcgagtactgagttcagattgtgtatgagcttatgggttttaaaatatgactgacttactttctgcaattcttgggaga

SEQ ID NO: 105328 - DNA, 163 bp, Triticum aestivum
  Clone ID: PAT_TA_105328
agccccctgcttgcttcgaaactttactttgtaatttcccttggtatgagacagttttcacatttggtcggaaaaatcaagagtatgagcaacctgtgtgtacgaagctctaggaacttcagaaataaagaagcagaagcttttacacacaagacacttcttt

SEQ ID NO: 105329 - DNA, 474 bp, Triticum aestivum
  Clone ID: PAT_TA_105329
gccaatccaaaaaatctccttcccaagtttctttgcaaatgaaaaatcttctcaagttgatttggaaccaaaagttgatgatccccaaagttcaaactttcgcttggagactccttcggaaagctcttcccacaggtttgagggttgggcgcttttccgtacatatttctcaatattgttgcaaatgtggtcagcaagaggatgaggttcacatgttttttctttgtgacttcgctagagctgcttggttttctcatccttggttcatcagaacaaatgctttagttcaaatctataccaatatccatagtattattcttgctttacttaatatgaaccatccgcatgcttctgttgccaacattctaaattttatgtggtgtctttggaaagcgaggaatgattatatttttaatagaaagaaagctacccctcaccaagtaaatattgctgctacttctctatctaatgatt

SEQ ID NO: 105330 - DNA, 269 bp, Triticum aestivum
  Clone ID: PAT_TA_105330
atcccacagacttgtgtgcatttcctgcatttttgttgttgttcgctctaccacccctaaatctgtgaggtgtattccattagtttttcccttttggcaatcaaatttacgtgacaaaaatgaaaaaagccctgagagcgcagaatcttgctcatgaaatggcgataagctctaaagcctttaagaccaagaagccatacaggtggggctgaaaaaatgtcaggtcaagctggtgcaatggatgaagaacaatttatgcgtacttttga

SEQ ID NO: 105331 - DNA, 201 bp, Triticum aestivum
  Clone ID: PAT_TA_105331
tccttccttgttatccccatcgggccaactacctctcccacctcggggatccatccccatccaatcaatgtgagtgtcctagatccaaaattcctctcgatctctccccaccaaccaccggccccctctgcttcacttcgattctccaacaaccgagccccttgcgcaccaccttgctcgagcagatgagccctgccgctg

SEQ ID NO: 105332 - DNA, 464 bp, Triticum aestivum
  Clone ID: PAT_TA_105332
ttgttcactctggattttttgggcacaaccatcaagcaagctaggacgtattgtttaactgaagcaaagggcaggtaagctatgaatgcttcattcttcgttctgaacaaatgcagctactatttgtatttgatctgagcaaaggtgcaaccaattgaagttattttgaagaacctgcacctgagtctatatgttctgattttatagcctgcagagtctgtagagtaaagtttgtacattttgtgaatcgctttgttccggtttcccctggtggtctatactgtatcaggttatttactatgtgcagatttgtttgtgccattgccgatcatgtacttctttctgtgcttggaagcatagtctcatcgtatcccctagatctgtataagtatatttagctcacatacacttggcatttgttcttcaaaaggcgccactccgtgtcctctcgccctgcacgatct

SEQ ID NO: 105333 - DNA, 374 bp, Triticum aestivum
  Clone ID: PAT_TA_105333
acggcacgctcagggaccacctgcagggcggcggctttgcgtcgccggtgacgtcgtcctggaaggcgcgtgtcatggcgctgctgggcgcgtccagggccatcgaccacctgcaccgcgtggccactccgcggatcatccaccgcaacgtcagctcgtccagcatccttctggacgagagctgggcggcccgcgtgtgcgggttcggcgcggcggttttgcaagagccgacggccgacggccagctcgtcggggaggttgccggtacgttggggtacatcgacccggagtaccaccgcacgcggcgtgtgagtccggcgagcgacgtgtacagcttcggcgtcgtcatgctggagttgctgaccggtaggccg

SEQ ID NO: 105334 - DNA, 209 bp, Triticum aestivum
  Clone ID: PAT_TA_105334
tcagcgaccatgccgatgatcagctgctgccaccagctcaagcctccgtctccgccccttcacctccagccggccgcccatctccctgcgctacgccgggcgtgcttcgcggcggcggcgtgcgtggtggccgtcagcgcgatgggcgcggtcgacggcgcggccatggcgcggggacctgccgacgacggcgcggcgctcggggcagc

SEQ ID NO: 105335 - DNA, 377 bp, Triticum aestivum
  Clone ID: PAT_TA_105335
caagcaggcagttcaggatcagccttgcacaagctacggtgtttccagaaagcggttgacaggcggagtgactggtggggtcataaacgaagagacactgaagtcactggactacaaaagagactatctattccctctgtcgttgctcttgcaaaattgcaggcctattggctatgcggaaacattgcagttgcttatctgtgttgtacttgtgggggggggtaccatcaccttgcttatgcttgtacaatactactggatatctgttggagctttcctcgctgtactgcttattccaccccttgctttgctttccccttttcttgctggcctcaatgcacttttcagccgaggaccaaaaagatcttctggcaccc

SEQ ID NO: 105336 - DNA, 260 bp, Triticum aestivum
  Clone ID: PAT_TA_105336
ccagtgcttgccaaaaaccgctcagctgcttgctgacaagtgataagcttctcggtccattaatcggtcgacccgcgtctggtgaagatggggagggcgaactgctcggttcctctcctggtgttgctggccttcctctcctgcttcttcctcgcacacgcggcggtggccggggccggcggcaaccgcaagatgttcctgcgcgggggagggagcggcagccgccgccgtgtccgacgatggtgggcaggcgatgccga

SEQ ID NO: 105337 - DNA, 472 bp, Triticum aestivum
  Clone ID: PAT_TA_105337
gacgcgcggtactggacgacaagggcgacgacttggagatagacggccccctcgccgcacctgccaatatatgcctccttggtccttccagcaagcctgcatgttttcttcccactgcttccctaattaattaattccttgctagcccaaaggacaggattggacgcgcacgcgccctagctgcagcctgcaggacggagacgaagcgcggccgctacgaagaaaatgaatacaaccatggaagcacaagtatgcaaaaactacacagagcgttgggtcaacaaatatgtggaaccaaggaagagcatagaccgtgtggaaggttttgtcatcgtcgcggctgtgtttatgatcgcccttgccattctctcgcccaggaggcgtcaatctcggagcatcattataagatatggagtgggcggagtgtttatattgtccttcccacttctctcctacactgtgggactgatgc

SEQ ID NO: 105338 - DNA, 520 bp, Triticum aestivum
  Clone ID: PAT_TA_105338
gctgggcgtggagccttcggcgcccgtctccacatctgatggcgctacctcgaccaaccgctaccgtgttacctctacaagaggccccgacgcaggctcctccacgcaccacctccatctcccgctcctgcgccacgtcgagaagggagtagcgacgaagcagagagagacgtggtaggagcccaagagggaacggggaaaggcggacgaaagatccgtgaagccaaagaagagaaagtatgcaagctcgtccaccgcagactatatcttcggaatcggcggtgtcagtcgccgccagtgccaccatgttcgcctccgcctggcctggctgcaacaaaagtacggctgcagaattcatagattcatgcttaaatgaagtgcaatgtattttctcggtgggggcatttgtgcacgcggacagaggcgatcaagggaagcagtcatgagcgaggtgttcgagcgctacgagctccagtaatgcgagttctccgacgcctccgctcttgatggacgtacgttc

SEQ ID NO: 105339 - DNA, 331 bp, Triticum aestivum
  Clone ID: PAT_TA_105339
tagtcgtcagtgcgggcgacgacggctctatggtgaccttgcatgcaggtatcagcagatgatgcagaggggacattgtcgagcaagcgtcaaatgtggcaatgcagagtgaggatgcaataaagtattggactgacgcttcagaaagcgtgacacgttccactggactaggtgccggaatatgatccagtcaacctggcggctgttgatgttgttagggagggctaaggtgattatgatccagtaatgaatcatggagatgagtcgaacaaattgttcggtgtcgacaatggatccgtcatccgttgctggaaatgggtgtgttattccg

SEQ ID NO: 105340 - DNA, 644 bp, Triticum aestivum
  Clone ID: PAT_TA_105340
cgttcattgctagcagcaccatggatcctgcccctcgccctagtagtttcagttatcaagtgagtttcagtccaacttgagctccttgagatgataatataattaacttccaaattattacatggtccatgcattttacagcaagtccatgtagtactacatgggaagtacaaaaattacttctagtgagagttcatttaaatctacagggtccagtcccatatatcttttaaccaggttcatggtgaagcccagggtgctcgtcggcgatcacaataagcaggccgtcgagaaggagctgggcaacatggtgcagcggtgtggccagttcaactacctgaattgtttgacagcaagtccatgtattactacataagaagtataaaaaatactgcttgtgagagttcatttaaatcctggtcagttcatctcctcaaaacatatttacttcttctctacccgttctatctcctgaactgttcatgttgcatcctttctctcatgatgtgatgttattgctctgtcgtaggtacaacatggtcatagaaacatcatatagctgaccactgtgtttgattttggtctgagcgaccatgctatgctacctacaaaaccatatagtttgagtttccatgcatgctctt

SEQ ID NO: 105341 - DNA, 457 bp, Triticum aestivum
  Clone ID: PAT_TA_105341
cttccgaaactaggacgacgtgcgtttcaaaagctctggtttgtttgaatggtcaactccgccgactcgttgaaatagactattgatggaagagagaggttaagagattctgcctgcttcaccatgagtcaagtaaatgttaccgcagtgcctcaaaagtatcattctctcctcctattaacgcgaaacttctcttcaacaacttattcaaagcaacgcagagttgttgtgacaggttatggagctcttagtcccatcggccactcagcaacagagtcatggaataatcttcttgctgggaaatgtggagttgtgaggctgaaaggtgaaggatatgataagctcccatgccaagttgccgctagaataaccccacctattgaccttaccaaacattttcccaaatccgaacttcggacaatggcgccagcaacagcatatagtctgattgctgcac

SEQ ID NO: 105342 - DNA, 611 bp, Triticum aestivum
  Clone ID: PAT_TA_105342
taaggacacaattggcttgaatagagtgcgtgtggagagaattttgaccacaagattaaccgcattctcaggaaccactctggctgcttgaaaacattcaacattgactactatggcacgagcgggttcactggcactagttattttgaccgttggcttcagattgctcttaaaccagggatcgaagaactcacccttgtgctatctgaaacgaagggaaaatacaacttcccatgctcgcttttatctgacggggttcgaaactcacttcggtaccttagactccgattttgcgccctccatcccccagttgaacttggccccttgagaagcctgaaaagcctgtatctgtggcgtgtgaacattacatggaatgagttagagtgccttatttccaactctcttactttggagctactggatcttattagttgccctgagattgaatgcctgaagctaccttgtgctctgcagcagctcagcgcgcttagtgttttagcatgcgagagactgaaagtgatagagagcaaagctccaaatctctccagtttatacctttgcggaaactggttagacttctcacttgtggaaacgttgccgataaaggaact

SEQ ID NO: 105343 - DNA, 442 bp, Triticum aestivum
  Clone ID: PAT_TA_105343
accttccgtcagcgcaactcggctgccatttccagtatccacccgcgccggcgccgcgctcctccccgtctttgaagaacacctgctctcccgctcgaactgctcgtctactggcgccgccgccctctcgctcccggacacgacgacctccggcggcaccggaagaatacggaagactccgaggggagtggacgccaggggcagggcctggctgcgggagccgggagactacggccggccgccggtgctgacttgcgccggagatcagtgcgcgcctgctcctggattccaggttcgagctcagggcacgtcacctgttcgacggaatgctcaacaataccgcggcgagcggcaagggtcaattctgtgacctcaccgacgacctactccggcacgtgctgtcctttctgcctgcggctgatgctctgcagacttgcgtgct

SEQ ID NO: 105344 - DNA, 168 bp, Triticum aestivum
  Clone ID: PAT_TA_105344
gagtggcctacaaacatgaatccaacagtctgacaggggaggatacacctctcatgatgttgtgttcttcagttttgcaggaactgcacacatatcaaattccaattattcattcatctattgttgttctcacgttgcctcatacgtgtctttcaaggccaatgcaat

SEQ ID NO: 105345 - DNA, 264 bp, Triticum aestivum
  Clone ID: PAT_TA_105345
gctattttgtatctacttggatcaaaggtgtacaattaatttgctcttacgaaaggaatgagtaggcagctagcagaatgagaggacaatcatgacaagcgaaccaacacataaatagtgatcccacaatttttacaacttcattctactttactttggtatggatatgcatttttatccttggagtactttggattttaagtgggaatcattggggggggggttcttaatattttacttcttataattacaaataccaatttt

SEQ ID NO: 105346 - DNA, 212 bp, Triticum aestivum
  Clone ID: PAT_TA_105346
ttaatttgctactctatgtctgaagtaaactgttcttcaccaatatgttgcacatagcacagatagtgtgtaacagttcatccgcaccaaggaaatactcatgaagaagttggttctaactgttaatgcttgaatttccctttttcactttccttgatttaaacaccttaatctggtttcgtgcttaggtgaccttctcgattccttgagcg

SEQ ID NO: 105347 - DNA, 608 bp, Triticum aestivum
  Clone ID: PAT_TA_105347
atccatttctctcctcctcctcctgccaccgatcccgaaccaggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcgggctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacat

SEQ ID NO: 105348 - DNA, 381 bp, Triticum aestivum
  unsure (1)..(381): unsure at all n locations
  Clone ID: PAT_TA_105348
cactccaatggctgatggtggttccagtcttctcagcttcaaaaagaaggatattgtttgggtatgccagcaaggtgcagactatgttgagctttttatataccttggagaaccttgtcatgtttctcagcttcttcttactgtttcccatggggttgaagattcttcatatccagctactgtagatgtcagaggggggggcagcatanatgcccttaagcttgttgttgagggcgcttgcataccccagtgctcgaatgggacaaatttgttgatccctctcactggaagaattcatccagaggacttggctgttacaggcaatagtgctcgaccggacgttcaagagagcacttatcttccgttgttatacgacttcaa

SEQ ID NO: 105349 - DNA, 442 bp, Triticum aestivum
  Clone ID: PAT_TA_105349
aaccggtcgagcaaagcgcaccgcgtcacatcatctcgagcgcgctctctagctagctacataagcagcgcggcggcacttccttgtccaggaggagagagcgccgatcgccggaccacaggcggccacacgacaccagcacgagcgagccacggcgcggtcgaccgaggcgcgatggaagcgctcgctgtcgctggtggcaagccgctgtcgggggcgcgggcgcggcggatcgccaggagccgggaggagatgctgggcctccttgctgacttcgacggcggcgacggctccgaccgcgagctctccttctccgacctcgtcgacgccgtcaggccgccgcccaacgccggccacgcctcggtgtcgctgccggcaccagtcggggtcgaagcagaggcggccgagcagaggcgggaggatgccccgccgtccaagaagc

SEQ ID NO: 105350 - DNA, 419 bp, Triticum aestivum
  Clone ID: PAT_TA_105350
ccgacgatccaagaaatacctttcgttgtcgatcgagtacatagtgcttctagacctccatccacctggtcacattccagcagcttccactccagatccggctccagctacagctcgacacgtagcatgcagcagtttactacctttattccattgattctttccatccatccatctatctaaattataaacgcttatgatgacatgaatgatcgatgcaggccgcggcgctgtgcagggagcagatgcacgtcatcctcgcggaggagctggccggcgcggcggccgacttgcaccagacagcggcggcgtcgtcgtcgtcgtcttcttcttcttcttcttcttcttattcttattgggagaagaaggagaagagcagcaacagcacgaccaagactcgtcggagcaacaacagcacg

SEQ ID NO: 105351 - DNA, 433 bp, Triticum aestivum
  Clone ID: PAT_TA_105351
ctgcctcctcctccccggcgagctcgccaggcacgccgtctccgagggcaggccattaccaagttcgcctcctcgtaggctagctgctcttgtgtcttctcataatgtgttgatttctcctggctgtttgaagaatccattgtatgctctagttagatatttggactgcatcaacctgtatattgtgggggaaatcactcttgatgctttgatctgtgtcatgcctgcttaattatcaagctcagtcgttgccatgtaacctcttgctccgatctgtcagtccatggtcatctgtaaatgtctgcagacctgaacttggcagatgtcctggtggatgagtacaggtacacgatggcaacaggttgagctctatccactgaaattgaatccaaccatcaagtgcgtgcgtgtgacaatagcagcacgtcgacga

SEQ ID NO: 105352 - DNA, 535 bp, Triticum aestivum
  Clone ID: PAT_TA_105352
gatctcgtcccccctcttcccgacccctcgctcccgatctcgtctctttcctgccaaataccgtcgccgccggtgagaggaaggagcgcagcggaggcaccgaggaggagggggtcgcctcgctcgcttctgctgacgatgatcatgcccactgcggcgggcgcggcgaggcgagccccaagccgcaggacaccgggcacggccacccccgctgccgccgccgccgcagggacatgaagagcagggccgcgggagttggcgagggctccgaggagggatccggccccgatcctgacccgcagccccaggtggaggtggagtacgtgccggagaagcccgacctcggcgccgaccatccccgcctccgcgcgtgtgtcttcgttgccatccggtgcagacgcccatcccgtgctacctgcaatgacagattgatgccttattcccggattgggtcttgtgacaacaaacctggagacatacaagatcgatgagtttaacagattggtgatcatgccgtggtggtatgccaactgct

SEQ ID NO: 105353 - DNA, 490 bp, Triticum aestivum
  Clone ID: PAT_TA_105353
gaacaccttttctgcctcgctaggccattcatcctcttatggcggcagctgggtttgcgacagatcgccatggatgggttggagttcttcgaggaagccgaatcaggacaagctccatctgatctttcaatttagactagtttgttctagagtatatgtcctacggtagctatcgttttttggttccactgccccatcgtgtcagatctgaaaaggatgatttcctgtggttcgttgcagattggttcccagggtggatgtcggttatcttttagggggagatatcgctgctgtggaatcggtcgttgcttcaatccatgaagcttgcccggaccacgccgatttcatttcctcagagcccacagctggcgtcagggatgcagagcactcccgcaagcggcggcgccttgaggatgcagcgctggatggagacgagattgactcatacaatgatgctagtgaggttcgttgccaattcaaacgatatgcc

SEQ ID NO: 105354 - DNA, 173 bp, Triticum aestivum
  Clone ID: PAT_TA_105354
gcggcgttctgcagcctggagtgccggcagcagcacataacccacgaggagtggaaggacaagcgcacgtcaaggtccatgagcgaggcggcggcgccggcgaccagccgcggccgctccggcaagaccgacaccggcggcacggtggcggcggcctgacctgacagcgcacg

SEQ ID NO: 105355 - DNA, 154 bp, Triticum aestivum
  Clone ID: PAT_TA_105355
ccggcacccccgtcacgcaggtggtgtacacggtgctcctctcctgggtcgccgacgtcgcgcgcgcgcacggcgtccccgccgcgctctactggatccagccggccaccgtgctcgccgcctacttccacttcttccgcggcacggacggcct

SEQ ID NO: 105356 - DNA, 491 bp, Triticum aestivum
  Clone ID: PAT_TA_105356
tggtgtggagatggccgaattagtcgtggctgccaacctggctgccagtgtggccggcaggaatgcccctaagctctgggattacttggtacaagatcgcaagctgcgggcggagctgaagcatggcatcagttacatcagaagcgagtccttgatgatttctgctgccattcaacaagatggtgatcgtccaccgtggagcgacaaccccgtgcataaggtctggatcactatggtgcgtgacttggcgtacgatatcgaagactgcatcgaccgcttcacacatcgcgtgacactcaaacctgatgtgtcatggatcgataagaaatttcaccggatgaagacgaggagtgcccgtaacaagtttgctgcagcgatccgtcgtctcaggaagaaatccgaggacgcatccaagctgagagcaagctacagcaccagtgagtatggcggcggatccagcactttggagtcagaggcaccatctgatgaaa

SEQ ID NO: 105357 - DNA, 518 bp, Triticum aestivum
  Clone ID: PAT_TA_105357
aattcaggcaacacctaatcatgcatgctgcaataatagattttcagagagtattgcacgcaagggtcactgatcctctttctgttccaggtacctgcctccatacaccacatggtttccatttgaggagagctcgggcgtgaaggaccatcccacggaggagaccccgggggtcaggttgctcaagagcacggctctgtcacaactctcctacctcgccatcttcatcatcgccatctgcgtcaccgagagggaaaacctcgaggaagaccccctcaacttcagcttgctcagcatcgtcgtcgaagtcgtcagtgcgtatggaaatgtgggcttctccatgggctacagttgcagtagacagatcagcccggacgcgctgtgcaccgacaggtggaccggcttcgtcgggaggtggagcgattctggcaagctcatcctcattcttgtgatgctcttcgggaggctcaagaagttcagcataaaaggtggcaaagcctggaagcttggttagatgc

SEQ ID NO: 105358 - DNA, 311 bp, Triticum aestivum
  Clone ID: PAT_TA_105358
tgagatgtggtctgccgtctaaggccatcgccgtcggcaaggcgagagctattgcgggtagcaccgcttgcgtccggcacgccaaataagttgtggcagctgctccatgccgttgttccccgctgaacagcatcgcgtgcagaggcgatcagctggtaccccaagatacagcacaagctcgtgaagactcacttgaagtttagagctcgatgcaacctcacagggagaggagcgccatggatttctgcccaggagccaccatggagccgaccgggaagcacgctccagccttcctccgcgtcaccggcacc

SEQ ID NO: 105359 - DNA, 463 bp, Triticum aestivum
  Clone ID: PAT_TA_105359
cacgactgctctcctcttctcgggcgaaccgaatcccccactctcgccccccagttctccgagcgcagttgctcgctcgcgtgggcgcgcgcggcgggcggcggcgcacggacggaggcttgcggcgaaggcaagccagctagcgaagcgtcggcccccgcccgatcgattcccggccgggcctctctctccccgatcgcaaccgaccgaccgatcgatcaggctcctatccttgggccgtaccacgtcgccgaacgaggccggccggccatggcagtggcggcggcaccagcggcggcgtcctccgtcggccccgacccgtcgtcctcgtccgtggcgcaccggcgccgcctcaccgacgtcgagcggccggacgccgacggctgcggcaggcaccgcggggtccgggcgctgttctccgtgaggaggagctacggcaagagggcgtcgtccgtggtcgacc

SEQ ID NO: 105360 - DNA, 400 bp, Triticum aestivum
  Clone ID: PAT_TA_105360
tctcctccgctccgctccgcccctctctcacgcagttcacacactcctctccctctcctcctctcctcaccccaccaaaacctaagcaagaaaggccagaggagctccgaattcgggctcgaatggccaacctcctgcacctcccggacctcgcggcggcccggccgccggcggccggcgtcgcgcggagaagggaggcgagggtcgtggcggctgccagggccgggggccgcgtgaagcaggaggagcccgggacggggacggggagggggcgggtgatcagggtcacggaccccgtgcggaacgggaggctgccggtgccggcgcccccgccgctcttctccgtgccgatgacgccggcctcggagtcgccggcggcgaccacgcggcgggacgacga

SEQ ID NO: 105361 - DNA, 341 bp, Triticum aestivum
  Clone ID: PAT_TA_105361
ttttttttttttttttttaagttagtatcttaggttgccttattaactgtcatgcatcacacaaactaatacaacatttaatatgatacggtatcataatatgatatcacatccacttttccctcatttaattatgtgtcacatcattcgcgatttggaatggaactcccgagtcacttttccctcatttaattgtatgtcacatcattcacgaaggagatgaatctgagctagctgttggctctttggcgatgtggataacatccagcagcggcaaccaagctttaattttgatccgtctggtggtgggtggctgggaaacaaagttgacttgaccccaa

SEQ ID NO: 105362 - DNA, 278 bp, Triticum aestivum
  Clone ID: PAT_TA_105362
agtggagcgagccaactcaaacgcgcggagtcgagcgcgggcacgatccaaatccggcgcccggagtcaactccaccgcctcggcacgactcgaatccccgctctgctgcttgcttgcccgccggacgggaggctccgctcctcctctcagggcacttgccgcttggttgccgcgggcggcgattgtgcgaggggatccatggacatagaatcctcccgctccggggcccatggcgagcccgacgcggcggcgtgggtgacggtcgaggagtggggcg

SEQ ID NO: 105363 - DNA, 459 bp, Triticum aestivum
  Clone ID: PAT_TA_105363
ctccggcgacttcgcccagccatctccccggcgatcccggcggcggccactgaaggcttcatccccctctcccgattcgatcgattgcggagcctagctgaggtgggaaggaagatcgatggatgctccggaggtggttccccaacgtgtccatcccaagaagaaaccatgtgtggatggcaatcaacagcagcattcccaatcccagacatccatgggccagtgtcacacgatatccgaggtgcttaacgacgacaacctcctcatcgagatcctcatccgtgtgggcttccctaccaccctcgtccgcgccgccctcgtctgcaagcgctggtaccaccacgcctcagaccgcgggttcctctgtcgtttccgcaagcgcaacccaccccgcctccttggcttatacatcgacgtaaggtggacctggttggggttgtacgctactccgcgctttgt

SEQ ID NO: 105364 - DNA, 365 bp, Triticum aestivum
  unsure (1)..(365): unsure at all n locations
  Clone ID: PAT_TA_105364
tgcgaacgtgggtgtgcgcccgattgcacatacaacagtaacgggcgcagagggcgccgtttaggaaatgccgggcttcggaggctccttcatcgactcctatcggtgctgcgctcggtcaggagggccgggctgcagtgccaaaggcggcccagcctagtttccagctcggccaggagggccgggcgtcggaggctccttcatcgactcctatcggtgctgcgctcggtcaggagggccgggctgcagtgccaaaggcggcccancctantttcccgctcagccaggagggccgggcgtcggaggctccttcatcgactcttgtcggtgctgcgctcggtcaggagggccgggttgcagcgccg

SEQ ID NO: 105365 - DNA, 276 bp, Triticum aestivum
  unsure (1)..(276): unsure at all n locations
  Clone ID: PAT_TA_105365
aggacgacgcaggacggctagctagctttgatcgccgccggatcggagtactcgtggtgtcgggggccatggccggcgccgcgggcgacgggccggagggggtgggcggaggcggggactggccgccgttcgctggcgacgccttcgcgaagtactcgtcgtcggtgttcgccgacctcggcggctggccggacggcctcngcgcgggcgccggggacctgccgccgctggatctgccggcgccgagcccgtccgcgcaggtccagctggcgccgt

SEQ ID NO: 105366 - DNA, 447 bp, Triticum aestivum
  Clone ID: PAT_TA_105366
ggtatccggccttccggcgccacacggtccccaccgccatcatcccgctcccggctgccttcctccgctacctcgccggccggaccgcctaccccgaccccgacgagggcgatcaggggccgctccccttcgtcctcccgacgctcacctccggccgcgcgcccttcccgccgctccagggccacttcccggaccccgtctccctcctcgaccgcgacaacaccgaccccctcttcggcgactccgactccgatgacgagggcctgctcccgcccgctttcccggagctcgaggccgcggtggatgccgccatcgccggcctcggcggcgccgcgctccccaagctcaactggagcgcgcccaaagacgccgtcttcatggccgccgacggcaccgtccgctgcacctgcttcgccgaggtcgccatgctgctccgcgcctccgact

SEQ ID NO: 105367 - DNA, 385 bp, Triticum aestivum
  Clone ID: PAT_TA_105367
ccggtgctggacttcctgcggcagaacggctcgccgttcatgatcaacccgtacccgtacttcgcgtacgcgtccgacacgcgggacgagacgctggccttctgcctgttccagcccaacccgggccgcgtggacgccgcgtcggggctgacctacatgaacatgttcgacgcgcagctcgacgccgtccgggcggcgctggacggcaaggggtacgcgggcgtggacatcgtcatcgccgagaccgggtggccgtacaggggggacgccgacgaggccggcgccacgccagacaacgccagggcgtacaacggcaacctcgtggcgcacctcaggtcgcaggtgggcacgccgcggacgcccggcaggtcggtggacacctacc

SEQ ID NO: 105368 - DNA, 304 bp, Triticum aestivum
  Clone ID: PAT_TA_105368
acacgacatacatccatcagtttgcttggtggtagggaaggtgtggtgtggtaataatagggtgggtgttaaggtttgtaagaagcatattctcttccagtatgaggctttccctgtgttgctcatggaacagacgatccttggttcagcaaactatcttacaacattaacccaggagtcccaagcaacctgcaaatgcggagagcgtctacagcaaaacgtaaagcagagcaaaatgtagcctgcattcagtaccacccattacgtcctgtcgcattttttttgttccatggccactacagca

SEQ ID NO: 105369 - DNA, 504 bp, Triticum aestivum
  Clone ID: PAT_TA_105369
gcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagctgtcctctccgtgaacgacggtagtggatcgggatgagttgattccggttgtagtttgttcctaattgctgttctaggtcttaagcttttgtgt

SEQ ID NO: 105370 - DNA, 251 bp, Triticum aestivum
  Clone ID: PAT_TA_105370
ctctcgcgcctcctcccactcccatccagccccttccccgctcatccctgaaagatccgagacgtgcgggcacggaggcgaaaggcgatggcggcggcgcttgatttgaggcagcgtcatgggatcggcccctgctgagcgacaagattgctggactgccaccatctcacctccccccaccagcttccagcgccatggatccgctggagatggagggcaacaagtgagagggagtaggagaaagaggtgaa

SEQ ID NO: 105371 - DNA, 428 bp, Triticum aestivum
  Clone ID: PAT_TA_105371
caccgtgcacgggcggtgaggatggagggggacgggaggaaggagggcgagacgccgccggcggtggcgagaggcgcggcgtcgttgggcgcgtccgtgcaggagtgggtgcagcacatgaaggccagcgtggtgggcgtgtggcggaaggcgacggcgaggagcgagcaggaggcggcggaggcggacctgcgcgccgccaaggagcaggtggaggccaccgacgaggccgaggccaagaagaagcgcctcgccggctgaccgaggtggccgcgacgttcgtgcagactgcagaagaacccacgtttcagtccatcgatttcgcctgttgtgtcaacgcacggttgtaaacagcaacagcatctgggctttttctttcttctaatctgctgtttgtagtgcttccactttgtagtaaagtggaattg

SEQ ID NO: 105372 - DNA, 434 bp, Triticum aestivum
  Clone ID: PAT_TA_105372
ccaccggccatggcgctcccccccccgagatcctgccacatcaccggccatggcggctcgggctcctctgcagagccggctctgacccgctccctcgaggccgccatcgctctcgtaccttgcgcggcctcggacatcctgctccaccatcggccatggcggctcgggctcctctgcagagcttgctccggccgctccgtcgagaccgccgtcgctcttgcgcgcccccaaggccgcctccccctgcctcctccaaccgggcaagcaggccaagccgatgcccacgcccctctatcatcctctattccccttctctctaatctctctcacactttttctccagggagcccccatggaggtcgtcgcctctccgcctgtatccatccgccgccggatccaccaccggtgtcctccagggagcccgccatggaggt

SEQ ID NO: 105373 - DNA, 520 bp, Triticum aestivum
  Clone ID: PAT_TA_105373
tgccctgctccctcatccctattagccgtcgctcctctcctcttccccacccgccgccgccaccgcacctcaatcccgagccatttccttctctccctctgtacctcctgcactaccgccgctcctacccggaccatccacgtccttctgacccacgcacgccgcctgcactccacgcctccacacgacgccaccacaccaaggggcgctgatggccgccaccggtgtgggtcgtggacttgcgggccacctcatgccgacgcggtgcctcccggcgacgaccaccaccacctcctcctcctcctcaagccgtcactgtcgcctcccctccaccatggcttgcctgcgtgagcccgacgcgggaggacgacgtcgaccatgcagcggagcctagcgggcgtggaccgacgcagtggtcgtcgccaaggatcgatggccgacgctgaagaggagggggccctcttactgcagctatctttaccatcccctacgggctggatctagagaacagatatacaag

SEQ ID NO: 105374 - DNA, 471 bp, Triticum aestivum
  unsure (1)..(471): unsure at all n locations
  Clone ID: PAT_TA_105374
ccaacgaccgctcgaacaaccgcgccgccaagctccacctgtccgccgcgtgcgtgcatatatccaagggcgatcgatcgatcggccgccgcgggagctagcggagcgagtccgtcggttggcccatacgttcgaaggttcctccaggactagtgcatanatacagctgttggagaaagagagggagaaagatactgagatagcgaggataatgaggaggagcagcggcgccgcggcgtgggctcttggcgtggccgtggccttcttcctggcggcggaggcggccggagcggcgcccgtgccgcacgactacgagcaggcgctgcgcaagagcctgctctacttcgaggcgcagcggtcggggcggctcccctacggccagcgcgtcgcctggcgcgaccactccggcctcaccgacggcctcgagcaaggagtggatttggtgggcggatactacgatgccggcgacca

SEQ ID NO: 105375 - DNA, 186 bp, Triticum aestivum
  Clone ID: PAT_TA_105375
actgcaactcaccgagcagagtttgttacaggacacatggctttatctcgcctgtgcctcaagaaggccctcgccggccgcgcggcagctatggcgaggccagcgtcatccagttctcacggaggaatggacctccggtccctcttctccgcggcagctgacagcgccgcgaccagggctcccctg

SEQ ID NO: 105376 - DNA, 212 bp, Triticum aestivum
  Clone ID: PAT_TA_105376
accaaccgatgggtagttgcactctcagccatcaaggtcgaacttcaggtgtgctccatggcccatgcccctcctgaaatggtacgtctagctgcaggtaccatttgccttttactacgtgtttctgattccacagtagatcgacccatagatcaccttctactttcctgggacgattcccggcctccttttcagtcactaataaaaccctc

SEQ ID NO: 105377 - DNA, 373 bp, Triticum aestivum
  Clone ID: PAT_TA_105377
ctctcccaacctccgctgccgccgccaccgccgccgttcggatcttccaaccgaccggattccgcctccctagaacctcttccgtgtttgcccccaagcgttccgctagtcgccgcctctccggcatcacctgctcccccgggattgccagcgtcgccggccaagccacgtccccggaagacgccgtccgcatcgtggccgtcgttggcgacggaagcatcagcccgctcaaggatacgccctgggacgaggttatgcgccatacggctgataggttgaagtgggttgatgaaggatttgaaatgcttgtattcaccgacaagtcgattgaccatgatgatcttaagaaagagttgtctcactgtgatatgct

SEQ ID NO: 105378 - DNA, 229 bp, Triticum aestivum
  Clone ID: PAT_TA_105378
ctcggcacccggctcaacttcggcggtatcctctcaggtatgccacagggggaccaactgctggcgcacagaagatcgtatccctctgtgatcgctggcagaagaagcccgcgccgaatccgaagacccgcacccgttgggaccttgagcgtacgcatagacgacgagctcgccaagtggtacggccctgacaggaggatctacttgcccaacggtctccttgaccggt

SEQ ID NO: 105379 - DNA, 430 bp, Triticum aestivum
  Clone ID: PAT_TA_105379
ctggactgttccacacgatccatgacgtccacggtgaccacgcccacgcccagccgcccgctcccggcggggccccagcggcgccggtacaggcccacggtgctcgccatcgccggcggtagcaagccgccgcgccgccgggcgcccgccgccgccaccagctgcgcggcgctcgcggcgcccgagaagcagagcacggcgccctccaagctccctgctccgtcgccggcgcccgagggcacggactacgacgaggtggccgccacgctggagacgctgtacaagctgagccccgtcatcgtggaggaggacgggaagaggagcaagaagcaggcggcgaccaaaaagaagaggaagcaggggagggcgaaatcgggagcagcgacgacgacggcggcgacgccgaggaggacagtggtggtgaggagcc

SEQ ID NO: 105380 - DNA, 391 bp, Triticum aestivum
  unsure (1)..(391): unsure at all n locations
  Clone ID: PAT_TA_105380
tctgcaggtgcaccttgtccaccttgtcctgatttgccaccctgcatcccaaaatatattgcaagtctgaatgtatgccctctctggtcaatgatcttgctctccctctcttctcccatgctatttttctcttgttatttgtgatctctgatgttacattaatttctttctaccgatggacatggtaatctgcagggagtgggcatctaggaagagtgcagtgaaaagaatagatgcactgatgttagtaaaaaaacagtgcaatggcagttcccagtttctacgaaaacaaagtgaagaggaatgacttactttacggttatgtntacgaaaacaaagtccagtcttgaattgtatagttgatagagtagttaattttggaatttgatcc

SEQ ID NO: 105381 - DNA, 507 bp, Triticum aestivum
  Clone ID: PAT_TA_105381
gcgctggctgccctcgccatggagacgatggccatcccgacccctaccttgatctcccccttgaaatcgccgaggagcggcggcgcgctgctagactcgctgatgagtgccgccgccagcaccgcgaaaccactacttgtctgctctcgctgccggctcccgttgccatggacggcgatgctcatctcgtctcgctcctggatcttcaccctgaactccccgaggagcggcggcgccccgaaccgtcctctttccataaaactgagattgaggagcatgctagcgaggttagcaacagtgaaggctctgtaactatgggtctgtcagaaatcactgccctagcgctgaatgacatctctcctatacttcagtcgacctattggtccaatgtgtgttatgatactggcagcagcgagagtgagtcggacactgtggtggagaagcctgaagacgaatcagattttgatttggacaaggaactgcaagatatggaggattacttgaaag

SEQ ID NO: 105382 - DNA, 429 bp, Triticum aestivum
  Clone ID: PAT_TA_105382
ccacgcgcagctgctgcaggtcggcgacgccaaggaggacggggaagaagccggcggccgcggtggtcgaacactacccgcactccgggtactcctacccgtacggcgactactacccatcgcaaccggcgcctgtcaacgtcttctacgagcagcagcactaccctgttgccgccgccgtcgaggcgtacgggtacccatgctcgcggccggagccgggcacatgttcggtaatgtagatagggaaggaggaatttgttggttaatcctgtcgcgtgtattactacagtagtgttcagctagctatagtgtcgaatttcagttagttaagctggcatcaatttcaggtcttgtgtttgcttaaatcctattcctatgtaatcgcctgcgacctgcagctcaaagcctcaaagggcagagtttttaaca

SEQ ID NO: 105383 - DNA, 366 bp, Triticum aestivum
  Clone ID: PAT_TA_105383
tttctccagcttgggagcagatccactggcaaactctatcttggtgatagatgaaccgtcgacaataagaagattgaagcttccgcaggatgtagtacagaatgtcccgagttcgaagggctcgcgaaaggatgtgcactgctgggatgtcgatcatgacactgcgcccgtgggaacaactttctttccacattaccgaagctttctccgcaatagccagggtttcctccttatccggtgccacaatggcgaccgatggtatgggctccccctcagcagtgcggccttgagcgacatcctttatccattcggctagcttcaccataatgttctcctcgggcgtacgaggctggtaaaatgtccctc

SEQ ID NO: 105384 - DNA, 293 bp, Triticum aestivum
  Clone ID: PAT_TA_105384
cgtggcacgagcgcgcccacccctgaaaaaggcggcctccctctggctcccttctcctcctcttcacagcgccgtcttcctctcgaccaaccactccccctccccctctcctcctttggcgcctgcgtcgactctgctgcagaggaagcacgcgccggccagagccagaggcaatcctgcctgcagctcatgcggcagctcctcgtcctctgcttcctctgttgtgaccaaagatcaagagggagcagcagcagcagcagaggcgacggcccctgcccctgctccggcggctg

SEQ ID NO: 105385 - DNA, 376 bp, Triticum aestivum
  Clone ID: PAT_TA_105385
tttttgctggaactaaccaaattttgctgccatgtctttttgctggaatcattttttgtaccacttttttgctacaacagttttggttttttgctactaccggcactgtcgtttgttacatcctttttcatgagattgtcgagaccctgcgcttgtgtgttttgctacaaccttgtactgtttttgctactactggagaagcccctagctggaccacaagttatttttgctacaaccgttttgtggtttgctgcaaccagtgtcaatttttgctaccaccgacttctttgatttttctggaaccagcgctcgattttttatttttgctaccactagcgtttcgatttgctggaacaagcttcaatttttgctacca

SEQ ID NO: 105386 - DNA, 626 bp, Triticum aestivum
  Clone ID: PAT_TA_105386
ctctctcgtacgcagtaatattgctctctcatctctcatctcgtaggcagtagtaatattgctctctcatctctcatctcgtaggcagtagtaatattgctctctcatctctcatcttgtaggcagtaatattttgatgaatgtgttacaaaacaaattccgtattgacattcagtagcttagagagagtagcacagagaaacgttgttgtgttgtggatgacaaagaacacatgtgacagcaagtccaggtattactacatggggagtacaaaattacttttactgagagatcacttgaatccttgatagctactagccataggaacctaacccagaaaaaatgtgcgaaaaagaaacattttgtactaccattagtcatcgatggcgtgtaatgttatattttcttgcttccctagcgttgaattagaacagcattttcaagagctgcattagctcattacttatctcttgtactgttaattttattttcaaaaccaaacttgtactgggcacatgagttccgatagtagcttctctttgacagattttacataatcaagcattcttgatgtgctgcctttcttccagatatatagattcagttttgaatccgattctcaaatc

SEQ ID NO: 105387 - DNA, 558 bp, Triticum aestivum
  Clone ID: PAT_TA_105387
actatggggcgcttctcttgctattaacacacctcctatgccataaccgctagcatcgcaatggatctcaaaaggtttattaaagttgggtaatgcaagcaaaggggcatgtgtaagcaaattcttaagctcattgaatgcggtatcttgttgtggtccccaaataaatggttcgtttttcttactcaaggcatgcaaaggtaaagcaatggtgctaaaatccttcacaaaacgacgataaaatccggctaagccaagaaaactacacacttgtttcaagtttgttggttggggccaaattttaatagcttcaatcttagattcatctacgtgaacacccttagaatacacaacgaaacccaagaaaacaagcttatcaacaccaaaaaggcatttgtccatattagcataaaggcgctcttttctaagagtttgcaaaatggttctaagatgggtcacatgatctttgatagatttgctaaaaacaagaatatcatcaaaatagaccacaacaaatacaccaatgtaagggcgaagaacaaaatgcatcacatgcat

SEQ ID NO: 105388 - DNA, 449 bp, Triticum aestivum
  unsure (1)..(449): unsure at all n locations
  Clone ID: PAT_TA_105388
catttgcctcgcgccggagttcgtcggcgtacgctgaacgacgccacgggcaccgcgccgcgtgccgtggaggtccgcgtcaacctaggccgagggccatggctacgcgaggaggaccgggccgaggccgtactcgacgtcccgctccgcgtagccgcgcaccagccggccggaggaaggagcgcaggtcgagggtcgccaccgccgtagtctggcggtggaaacgacaccgttcgcgcgctgggcctcgccgcgccggaggaggcctgtgccangttcgggcctggccgaccgtcgggggcgagctgcacaatcagctgaagggagagcccgctccatcttcgctacgggcaggaccgtggctgcaggaactccacgcggatgccgggagccgcgtcgggcgcttgctgcctcgcctccctcgcccgtcttcgtcgtcgccaggacgt

SEQ ID NO: 105389 - DNA, 527 bp, Triticum aestivum
  Clone ID: PAT_TA_105389
ttgtaggaatatgaaccattttttaaatcttaaatatgaatttcgaaaattatgtacattttcagaaaaataggagcaaaatttgaaacatgaacatcttttcaaattcatgaacattttttgaaaaagcaatttgaaaaaaaacatggacattatttgaatttgtgaacattttatttataatgggaacatgtgttgaaaattcataacattttttgaaaatatttatcttttataggcgaacattattttgaattgtgaaaatttcactaaaccaagaatatattttgaatttggagcatttcttaaatgccattttctttttcaaaatattgaactattttgaaaaacaataaaaaaatagaacaggaaacctttttcaagttccaaatatttttttaaatatcaacaaaatattggaattctgaacattttccaaaatttgtttttttaattctaaacttttttgagagttttgaatttatgaaataaattctgtaagaaaaattaacatggaagggaaaaaa

SEQ ID NO: 105390 - DNA, 352 bp, Triticum aestivum
  Clone ID: PAT_TA_105390
ctccatcctggtcaccacctttttttacctctgctgtggctgcttcgcctacgccgccttcggtaacgacgcaccggggaacctcctcaccggcttcggcttctacgaaccctactggctcatcgacttcgccaacgcctgcatcatcctccacctgctcggtggctaccaggtactattactacccaaaaccctgaaactgaaacttcttcaggctggttttattacagaatgaaatgaaaaacacgagcagagctctgaactgatacgaaacaaaacgaatgcaggtgtacagacagccgatctaccagttcgcagacaggtacttcacggagcggtacccggggagcgg

SEQ ID NO: 105391 - DNA, 355 bp, Triticum aestivum
  Clone ID: PAT_TA_105391
ctccactcgcccacggttctacttttgccggccgtccaaccaaggtctccctcccccaggaacggatctgcatccctgcctcctcatcgcacatgcccggccgcggcaccggagctcccccgcagaggcagtgctccctgccacccctgctactcttcttcacgtcgccccgcgctcgctcggaaccggctcagccacgtataaagttgcaaccgaaattataaacctaggcagtaagaattgaacaatgattctaaaatagtaggatatattctttaggacttcttgtttgtgaggaattgccgagaaaataaatcctcctaaaagaaaactcagagtgtatcaaagagctaca

SEQ ID NO: 105392 - DNA, 209 bp, Triticum aestivum
  Clone ID: PAT_TA_105392
ccgcgcccgctccgtggggctcagccaccccgacaccgccgctgctttccctctccatggcgttggtctctcttccgtttttcttcttctgatggatccgcgtacaggcagaggtgtccgatggtgagcatgagctgagcccggcttccttgcataatccttgctcctgtgtggccgatgtgcatggatcgacgcaagcaaaagatggg

SEQ ID NO: 105393 - DNA, 208 bp, Triticum aestivum
  Clone ID: PAT_TA_105393
cggccgtgtctaggcggcctttctggggcatgcgtgcgggaactcccggaggtgggcgcatgctgtggcgcggtggtgctcgggggtggtcagcggcagctcaggcatgggcttcatgtcgccgttggcggccgtccctggccggatccgtgggcctcgcgcccggatctgtgggctggcggtggttgcagggagatggaggtggtgc

SEQ ID NO: 105394 - DNA, 215 bp, Triticum aestivum
  Clone ID: PAT_TA_105394
caccttcctttttcagcagcgcgcctctgcgtcatacagcgggtctctgtttcggaatagtcatagaagatgatttttagattatttatttggaaacatatattgcgcatacaactgaaatctccttatgttcaagttgatttcagccacccttggatcccttagtatgactacttacataacctgatgttggaagcaagtatttttgtttccct

SEQ ID NO: 105395 - DNA, 360 bp, Triticum aestivum
  Clone ID: PAT_TA_105395
tatggcacccagcagagaggcgtgtgcgatcgccatggccgtggcagcgccgttcatcgcaatggcaagcaacatcagcaccgacaacgtcgagaagcggcgcaggacctcgtccgacatgctccagcgcaccgtctccgacgtctccttgcagctccaccaccacggccccgccaaggaggaggaagaggcggcggcagaggcggagatgaagctgctccacccggtctcggaggtggaggacgccaagtgcgagtgctgcggcatgtcggaggagtgcacgccggagtacatccgcggcgtgcgcggccggttctcggggcggtggatctgcgggctgtgcgccgaggccgtgacgga

SEQ ID NO: 105396 - DNA, 410 bp, Triticum aestivum
  Clone ID: PAT_TA_105396
aaaatgatgataggtactcccccagttctacgtactgtgggttgcattatatttcagtatcagggttttgaatgggttgcatgatcttttctatatctatactaaagcatgttgaagcggcacattttctaatgtttgcatgtgttcatccatacttccatactcgttcactgggaaaactgatcgcaactcaaattctgtttccttcaaagatcaggcagaggcttcagtttttaattcgcacaaagaattgaatatccagaatgtacttgtcatatgcatcttacagttatatattgcctttgaagattgcattcttgctcttgatttgtctcttaaatcaacagaaaaaaaaactatcgctggttagttactcctgttggcaaatcattgagcaaccgattatattg

SEQ ID NO: 105397 - DNA, 462 bp, Triticum aestivum
  unsure (1)..(462): unsure at all n locations
  Clone ID: PAT_TA_105397
tacggctggatagaaattccctctccggcccagttccagcgaacctgaataacctcaccaaagtaaacgagctcaacttagccaacaaccagcttaacggaccgttgcccaatctatctgggatgactcttctcaattatgtcgatctgagcaacaacacatttgatccttccccgagcccgcagtggttttggaagttgccacagctctcagctctggtcatacaatccggaagactctacggcacggtgccgatgaagctgttcagcagcccgcagctgcagcaagtgatcttggacggcaacgcgttcaatggcaccctcgacctgnggaggagcatcagcagcgagctgagcatggtgagcttcaaggacaacgacttctcctccgtcacggtgacctncagctacaacggcacgctcgcgctggccgggaacccggtgtgcgaccacctgccgaaca

SEQ ID NO: 105398 - DNA, 360 bp, Triticum aestivum
  Clone ID: PAT_TA_105398
ccgaggcgcgggagccgccgcgtcagacaacgggagctgatgccgagatcgccaagacggagaagctcctgcacttgctcctctgggggcctaactgagcccccgaccacccgtctgccatgtatccacgcgtgcaacgatccgtgcaccaagacccgtctcagtagggtgcaatgtttgcttcttcttttttaaatcagtagggtgcaatgtttgcttcttcttttttagatcagtagggtgcaatgtttgctagctgttcgatgtatgatcttcttaggacttgcgagcacaggtacagcctacgggcaggatttgcgtatttgtatggtttatatgcgtatctgatctacttggcag

SEQ ID NO: 105399 - DNA, 415 bp, Triticum aestivum
  Clone ID: PAT_TA_105399
catcaccattgattgctccttaactttgcatatgattctcagcctctcatctttccatttctcaaaaagaactggatgccttttcctcttttctttggtccagttttcatgttcctgaataataataatatcctgcaaccacaatgaaagggacctaaccgctgcctccatttgcctgcagagacggatttgccgcacgatcgggtgagaactgtgcgggagacgctgcctggaaggcatatccgacgcggtggcgctctgcggatcaggccagggcgctggtttcttgacggagttcggcatatgatagggactcgcaacagaaagcagtcatatgttgataggtagatagatatgctcccacctcttaagatgcttcgtgcatcccatgctctaaatctattatccgcggaat

SEQ ID NO: 105400 - DNA, 605 bp, Triticum aestivum
  Clone ID: PAT_TA_105400
taactgcacgccggccggtcggctagctctagctgacagtatacacggcaccggcagagagctcggccgccggcttgttgtacgggctcgggcgcggcgtcccactcccatgttcgtccacagagctgccggcccacgatgggcgcaagagcgtcctcctgcttctgctgcctcatgctggattaatctgcgttgccgccgaggccgagacaactcccaggaaacatgatgacttttatgtgtctatgcaacacccagccgcttgaagaatttttgattgactgcccacttgtatataccgtgtctatatttggcggcgaaatgtctgaagctgcaacagaccatggcaggtgtctgtttcaggccatcatggctgatatattaaagaaccacttggataatatcagctgggatggggcattcagtattgccgatgttctgatcgttaagcatgaagagtacgtaaatgtgaagatacaaaaggaacctgtcaagtttgaaggtagaagacagcttgaggccagagtcaaagacctgaacagagctgctgcggttttcataccattgtaccagaacagtaatggtgttttgccagttttctttga

SEQ ID NO: 105401 - DNA, 495 bp, Triticum aestivum
  Clone ID: PAT_TA_105401
ccccgctccgctgcctagggtttgcgccgagcagatccggccggcggcgccgccgccggacgagctgaccggccccgccgtccgtccgtccccgcacggggccgcagcccgaccgccccgacaccggccgcgatccgatcccgctgccgccgagggaggatgtctccaccgccggcgtcacccgcgctgtcggcgcagaagctgacgaccaacgacgccctggcctacctcaaggccgtcaaggacaagttccacgacaaccgcgccaagtacgacgagttcctcgaggtcatgcgcgacttcaagagcgccaggatcgacacggcgggcgtcatcatccgggtgaagacgctcttcagcggctacccggagctcatcctcggcttcaacgccttcctgcccaagggcttcgctatcaagctgcaggacatcgacggcaccggcgacaagaagcagcccgtcgacttcatggaggccatcaacttcgtcaacaag

SEQ ID NO: 105402 - DNA, 217 bp, Triticum aestivum
  Clone ID: PAT_TA_105402
gaggatcgcagcctttctattacgtctgtctgactgactgaggagtgctgcttgttggatggcgcacatggcgacggcggtgggggacggcgcgctgcggcggctgttcgagaagccgttgccggagaaccccacgctgctggaggtgctgtcggcttgcaacaaccacagccaccacaagaagcagctgccggccgtggacccggcgtccttcacc

SEQ ID NO: 105403 - DNA, 379 bp, Triticum aestivum
  Clone ID: PAT_TA_105403
aagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccgcatcaagcaaccaccaccaccaccaccaccatcactagccgctgcatgcgcccgcccgcgcgcgcgctgaataaaataaaaccgtcgtgtgttccttaactctgtacctgtacgcccgtgttttccaccagcagtgtccttgctcatgcctccaactctaataaaaaaaaaa

SEQ ID NO: 105404 - DNA, 395 bp, Triticum aestivum
  unsure (1)..(395): unsure at all n locations
  Clone ID: PAT_TA_105404
aggatcataactgtgctagcgacgccgagagggccttcgtgctcgaagaactcaacatctcgaggatgtccgtggcgccaatgttgttgggtagaggaaccggcacgtcaaacacgactgatcgcgccccgaagaaccgtgagtcgctcagggtctctgccggtctggggaggaagaggctgaagattatgaggtactcaggcgaggggaagggacccggcaaagttaccgacgcctccttctcgccgggctgggcggaaggtgaagtttgcaggaaaccanaacttatattggaaatgctcaagaggaagagatagtagcttgaacccatccccatgtatgtatgccatggttgtgtacttgtatatgtatctaagtgaagcctacgccggacc

SEQ ID NO: 105405 - DNA, 378 bp, Triticum aestivum
  Clone ID: PAT_TA_105405
tgccatctggcgccctcctccgcagcgccaccgccccggcgcccggcggctcgtttgctcgcgcggccgccccttaccggcgacccccctggactctccccgtctcgggcaggcagagaaacggcgatgacggccgccgtcgccggagcggacgacgagaggaaagcgcaggccctcgtgcgggatgacgcgcccaagctgctcgccgctctcaaggagatgaaggacgggctcgacctcgtcaggtccaaggtcgagtcgctcacccgcaaggttaggaaaaaccagctgccgacaggcgatggcattgggtacctggaggccaagcaccacctgctactgagctactgccaggacctcgtctactacctactacgc

SEQ ID NO: 105406 - DNA, 213 bp, Triticum aestivum
  Clone ID: PAT_TA_105406
ggacgatgggatcccgcgctctcctgctcgtcgccgtcgtcctgacggcgcagctgtgcgcgtgcacggcgtacgccggcagcggcggcgatgggtttagcgtggagttcatccaccgtgactcggtcaggtcgccgttccacgacccgacgctcaccgcgcccgcccgcgtgctggaggccgcgcggcggtccgcaacccgcgccgcggcgc

SEQ ID NO: 105407 - DNA, 527 bp, Triticum aestivum
  Clone ID: PAT_TA_105407
cagcctcaggtgacggcgccggaggcgctcagggcgcctacgagtgcgccatcggcaacttcggcgtaccgcagtacggcggcaccatggtcggcgtcgtggcctaccccaaggccaaccggaaggcctgcaaggggttcgatgaattcgatgtttccttcaaggccaggcccggggcgctgcccaccttcctgctcgtcgacaggggagattgctacttcgcaaagaaggcatggaatgcgcaaaatgcaggtgcagtggcgatccttgttgccgatgacagggatgaacctttaatcacgatggacacgcctgaagagagtggaagggtggaatatttagagaacatcaccatcccctcggcgctaatatccaaaagcttcggtgataggctcaagaaagctatcgataacggagacatggttaatgtgaacttggattggagggagtctctgccccaccccgatgagcgtgttgagtatgaattctggaccaacagtaacgatgaatgtggtccaaaatgtaat

SEQ ID NO: 105408 - DNA, 537 bp, Triticum aestivum
  Clone ID: PAT_TA_105408
gtgctatcgccgatggggatgccttacattgaaaattggcgattttgggtttgccagatctctgatgcatgaaaatttggctgccactttttgtggctctccatattatatggccccagaaatctggcgaggggataaatatgacgcgaaggcagatttatggagtgttggagtcattcttttccagctagtaacaggggagctaccatttcttggggagaatagagtggagctgcgcgaaaaagtattgtcatctagtggcctcagtttccctccagatatggaggctgatttacatcctgagtttattgacctgtgcagaagactcatatgccttgatccagcggagagaatgccttttgaggaattctttaatcacaactttttggcaacagcaaggaacagtgaaatcatggatgagtcccatcatgctcttgatttaagggatacatgccagactgtctcttctgctgtcgtcaaagtaaagtctgaaagtgtagattcaaaagtatttgattcatgggagtggattgaacg

SEQ ID NO: 105409 - DNA, 296 bp, Triticum aestivum
  Clone ID: PAT_TA_105409
tggtgctccaccgacaattactcccgcaggggtagccccttgcacaccctgagaagctactggtcttcgagaagtccgtgccgagcgcgatccatgctaccccaacaacaactcctccatcgctgccaagaccgaacaggtacgacggcgagcgcgagcgcggccaccacaaaggctacacttcttacggggcgtgtaccgatgaggacacgagctctgccgccgcccacacagacatcaccatcatcatgcatggaaaacgcgaagtgaagacaatgaagacgaccacacagctc

SEQ ID NO: 105410 - DNA, 272 bp, Triticum aestivum
  Clone ID: PAT_TA_105410
gatgccctcggggcctcgtcgacaaatcacccacgcacgacgcaagcaccaacacgagattcacacactcccataatacgcaaacgcgagacgatcgatcagcggcgattcatggcgcacgggcaggagtcttcgacgcaggccgccgccggtggcgccgcgccactgtgcgcgaacggctgcgggttctacgggagcgaggcgagcaagaacatgtgctcaaagtgctaccgcgaccacctcaaggccggagatgtggctgcccctgccgt

SEQ ID NO: 105411 - DNA, 166 bp, Triticum aestivum
  Clone ID: PAT_TA_105411
ccggcgctacaagatcggcccgagccggttcatgggcccgtgcaaggagaggctagtggtgctgatgcacggcaccatcgtggcgccggaggagccgtcggagtgggaccccaagagcccgcggctgtggctcctcttcggcgggctcgtcggcgcgcgcatccaa

SEQ ID NO: 105412 - DNA, 477 bp, Triticum aestivum
  Clone ID: PAT_TA_105412
ctcctaccaaatcgcttgatgcgatgggtcatgccgcatccccaggccccacaaggtacacccaccagcactaccagatcgggcggtgaagaggacgcaatccgccggcgacgaggcgggcggcgccaccacgttcgtgcttaagcgcctccgggtaccaggcatgcgcgtgaggcaaggcgcctcctgggctgtatcgtcgcatcaccaacaaccccacggccgagcaggaggagtgcttccacggattcaaatatatgcaagtagatgcaggctgcagcacatgcttccatcacctccctgtgtcgctcgagtcatgggctccatcgtgtgacgcactgcaaggatgtcaaccatactgctgcagggttcagtgccgtcatctttgtccgcatcttccgctcggcagatggagtctccatcgttatatggctgcagaggtaagttgctcaaatgattaacattgtgtttgtgctc

SEQ ID NO: 105413 - DNA, 297 bp, Triticum aestivum
  Clone ID: PAT_TA_105413
tgtgctgctatgttggatgatcacacgctggtattattttctactaggtctatgagtggaaagcagttgatctcgaactgtttggtcccttgttcattttacttacttgcctttcctgcctttttggccaacttaggtgtttgaagccccttttgcgtatgaatcttgcctggtgcgactagaaactgcattctcaaatattcaacaaactgttgaaggggtgggttacaagattcacccattttgtagtattcatgcccttaagatctaaaatagctcgatcatctgcttgtgatg

SEQ ID NO: 105414 - DNA, 149 bp, Triticum aestivum
  Clone ID: PAT_TA_105414
cgcttctagaatctaggccgcggcatgggcaacggcctctccccttgcttgcgcgccctggccgtgcacggcaagggagcggaggcgaggctggtgttctggggcgggcaaacgaggctcgccacagcttccggcgggcggtacaccac

SEQ ID NO: 105415 - DNA, 246 bp, Triticum aestivum
  Clone ID: PAT_TA_105415
aatgcaggtgccattgttgttgattccattgttcatggccatctgaaaagctaaggaactgttcaaaccttgaaataaacttgaacaccctgcagttgtgtaattgaggagccccatgacatcaacaagaatgacgacgatgatgcggaggaggaggacctcaactacacaccacacaaagtccctattgtttgtcggcggtgggtgccttgcctgcagcagacctggaccccatgcccaagctca

SEQ ID NO: 105416 - DNA, 185 bp, Triticum aestivum
  Clone ID: PAT_TA_105416
tcctaagccccaggtgacgctgcccctgcgccgaggatcccgcctcctcgtgtcctgctccgccacttcaccatcctcctcgtcaaatgctgctggaggggtgggattccagggaagggtggggttcttgggcctcagaatcatgggcgcccccatggcatcaaacctcatcaaggctggccgcc

SEQ ID NO: 105417 - DNA, 261 bp, Triticum aestivum
  Clone ID: PAT_TA_105417
gcactccgcaggtgagctagacgcgctagctagcaagtagctcgacgctgccagtacacgcagagagaagacgacgcgactggaggccatggcgtactcttgtctgcccttgtatgcggcttcctttcttgtagtgcttctagttttgcctctcatggcagtggcatccgccgccgcgcccgctgccgagacatcctacgagaccaagtgcatggaccccggcctcgccctcatgacgctgccgcagccggtgtccggccc

SEQ ID NO: 105418 - DNA, 362 bp, Triticum aestivum
  Clone ID: PAT_TA_105418
ttttttttttttttttttttttttaacccactggaaaattcatttatttttccaatcgtaagaacattcaacatttgacaaatataactccagtttctatgcaaacatttgtattgtaatacctaacaccccaattgcccgggacagtcggttaattaatttacatcgatataccatatgggaatgctattaatatcataagtttggagttagtaaccaaaccatctcaccggaatgaacatttgaaccatttgaggtatctggcatctccatgtgtcacggccaaaaatgtattttatgattttatcaaccaaaccatctgttcttgactgactcaaaaggatgctaagggatgaatttct

SEQ ID NO: 105419 - DNA, 200 bp, Triticum aestivum
  Clone ID: PAT_TA_105419
ttctgttttgctcgccagcagccggcagctaggcggttgctctcccatcctccccaatcctcccctcgatctcgtcggagcgggcggagaccgggccgcggcgatgacggtgatcgacatcctcacgcgggtggacgtcatctgccagaagtacgacaagtacgacgccgagaagctcaacggcgccaacgtcgccggcg

SEQ ID NO: 105420 - DNA, 235 bp, Triticum aestivum
  Clone ID: PAT_TA_105420
ggggcagctgccgggagcagctcttgcgcgaggtctcccgcctcgtggacgcgcactccgccaagaagggcgaggatgtgagcgtgaccctcgccggccacagcatgggcagcgccctcgcgctgctcctggcctacgacctggcggagctgggcctgaaccgcgccgcgcccgtgaccgtcttctccttcggcgggcctcgggtgggcaacgcgggggggggggcgcggtgcga

SEQ ID NO: 105421 - DNA, 309 bp, Triticum aestivum
  Clone ID: PAT_TA_105421
atgtccgcaaggcagcgatcctcgacgcggacgcgcttaccatacaggtagcgagcctcgggcacaggctggtgaaggcgaacgagttcttgaacacgggcattaagagcttggaggaggagagcgggttccaacgcgagtgggcccagtttgtagagaactcccaggcgcaggtgacccgcctgctggaggaggagaagaagctccgcttgatggtgcgctccaccgtggactacttccacggcagcaaggggaaggacgagggcctgcgcctgttcgtcatcgtgcgcgacttactggtgatactgg

SEQ ID NO: 105422 - DNA, 133 bp, Triticum aestivum
  Clone ID: PAT_TA_105422
tgctacaaaataattgaggggatttgcaatggtttgcactaccttcaccagcaaattgacaagtctgttcttcacttggaccttaagcctgcgaacgtattgcttgacaacaatttggcaccaaaacttacaa

SEQ ID NO: 105423 - DNA, 112 bp, Triticum aestivum
  Clone ID: PAT_TA_105423
tggggtgatgaagccgacgttgcggcggcaggcgccacagaccttggtgctgcccccactgccgagatgccagaggtcaagctctttggccgctggagctgtgatgatgtcc

SEQ ID NO: 105424 - DNA, 448 bp, Triticum aestivum
  Clone ID: PAT_TA_105424
tctattcctgctgacagagaagtattgtctcagccagctgatggtgggctggatactaatcccactagttcgttgggtggcaccaacggtaatgtacatccagcaccacggaaggtatcagcatcctcccaaaggtcaacggtgttggctgcacataatgatgcaacagctaatcccaccggtgaaggtgaatctattgagttggttgattctaccgtgaaacggcaaaaaaatctgttcccgttgaagaacaagagagaacaggtaaacgaagaaaaggagaaattgaaggccgggatgatgacttaacagaacatacagacaaagagaaaagaatggacctgcgatcagtagataaattccattctgtggatcatgagagaggtaataatgaggaacaaaacataattcggacagagaaattaaaagagaagtttgatgagaaata

SEQ ID NO: 105425 - DNA, 429 bp, Triticum aestivum
  unsure (1)..(429): unsure at all n locations
  Clone ID: PAT_TA_105425
ctctgctctcccacaaccccaaacccgtccccgccgccgatctcctctcccccaaccccagccccgccgacgacctcctcccccacgccttgactgcccggcgacatcgtctcgttcatagccgtcctcgacctccgccttctactccaccctctccttctctccacgctgaaaccgtagatcgacgccatggccacctcacaggtgaggcaggcggggaggagcccntccatggcgacaccggtgagatctggtatggatcccccctttcttcttcttctagatttcttcattttgctcgaatctcattgcgtttgtccgagtttttttgtggatcatatggtcaaggaggacaccatggacaagcccgatgccatggcgacctcgcacgtagcacaggaggaagctagacatggcgacaaccgatct

SEQ ID NO: 105426 - DNA, 380 bp, Triticum aestivum
  Clone ID: PAT_TA_105426
ggacgaacccttgtaacaacaacgataaggacatgctacaacccggtaaaggggaacggcaggcagaagcagtacccactacaaacaaaggatgtaaataagatttatccatctcacacctccaagaaagatcgaaagcgtgctgtccacgaggtatattccgtggagtcctttgagccaaaatacaatccttggttgaaaatcctgatcacatgtgtgtgggatgaccaccagactatcgtccaccatggcggtttgcccgcacttgtcttggacccgatattcaacagtttccacctcatcgagcttgaacctcagctacgtgaatacactgagaaagatgcacttgaacaagtcatgtatcaagctggtgaaaacca

SEQ ID NO: 105427 - DNA, 309 bp, Triticum aestivum
  Clone ID: PAT_TA_105427
gtgctccttatccccctctcttaccgaattcaaccccagttcttccgtgttttgctgtatgccttcgaccttcttcttcttcctcctccactcgggtaccggcggtagaattgcaatcccacttgctcactcccttccaatccgatggttatggctgtgcacgcatggacagttccaaggcaccaactgccatgcagtggccaagggagcccgggcgggggtcccaaaatcttttttccgccccgtttcgtcagataactgatacgtagggtttatctttggatgacccgccgggtcttgatatttctg

SEQ ID NO: 105428 - DNA, 447 bp, Triticum aestivum
  unsure (1)..(447): unsure at all n locations
  Clone ID: PAT_TA_105428
cgatgagaaggagcaaaagaagaaggggaagggggagaagaaggcccgtggctcccgtgtggcgttcgcgaccaagagcgatgtcgaccacctcgacgatggctaccgctggcgcaagtatggccagaaggccgtcaagaacagctccttcccaaggagctactaccggtgcacagcggcacggtgtggggtgaagaagctggtggagcggtcgcancaggacccgtccacggtcgtcaccacctacgagggccgccacgggcacccaagccccatggccgcccaccgcggcgcacggatgctaatggccaccggtgcggacactgcctattcgcttgccgcgctccaacatcaccaacatgaccttttgccggctggtgccgacgtctacgggcgcatgtgcatgcagcccactacggccgccgccccgtcggtggcacaccgatt

SEQ ID NO: 105429 - DNA, 542 bp, Triticum aestivum
  Clone ID: PAT_TA_105429
gttgaatgctatggtatggggaatcaccaattgtctagaaaacagaaacataatttcagactatccaaaggtttacgccgatgggaagatctgatcacttgttactatagcaatccagtccttttctttactttgggctaaaaattttgtcggacttttattcatattgtattgtactaccaggatgagaatgagtctgtgagtaaaaatgtccattgtgggatggtaccattgtaactgtaattttgctggagactgtataacaaaaatatcaactaactttacaggaagtgcaagttggaatcataatttctcttgagaaaacggtgatttatcgatctgattgtctagtggtcgtgcattttctcgtttggtctttgaagattttctttcactctttgtcctggaaatggcatcatgaacgttgctgatatctttggatgccatggttgcattgcgaacatgtgatttataattgctctgtggcttcaatctgcatgaccattttgattgtttgtcattgtcatgaccaacacttaagc

SEQ ID NO: 105430 - DNA, 242 bp, Triticum aestivum
  Clone ID: PAT_TA_105430
ctcccctctcggctctcgtcgatgagcacgacggcggcgagttgagtgcctaatgggcgacatcaacgccatgtccacctatgggtggcagatggtgtggatccatcgccatggcttacgacgccgagctactcacgtaggaaacagcttcattctgatttatgtgaatataagcgtctgaggtccagtggcaatgctacaaaatcattccaaacttgagtatctggatcacactactactg

SEQ ID NO: 105431 - DNA, 468 bp, Triticum aestivum
  Clone ID: PAT_TA_105431
cgtcgcctggaggaggcggagaagaagcgccaggccatgatgtccgccctcaaggagcagagcaagagcaagggccccaacttcaccattaacaagaaggagggcttaacctctcatcagctcagattgagcgtaacaagaccaaggagcagttggaggaggagaaaaagatcggcctgtccttccgcatcaagccccttgtcctcgacaacatgagtgtggacaagcttcagctcaaggcctccgacctctgggaacagattgtcaagctggagaccgagaagtacgacttggaggagaggcaaaagcgccaggactatgacttaaaagagctgaaggagcgacagaagcaacagctcaggcacaaggccctgaagaaggtctggaccctgaggccctcaccggaaagtacccccccatgatccaagtagcatctaaatatgaacgcagagtggatacccggtcata

SEQ ID NO: 105432 - DNA, 560 bp, Triticum aestivum
  Clone ID: PAT_TA_105432
cctgggagcactatactatgtgctgatggcaccatcacgctcacagcgctttcttgtgatcctgagaaaggtctagttcgctgccgatgtgagaactctgctctcctaggtgagaggaagaatgtcaatcttcctggcgtcattgtagatctcccaacacttacagaaaaggacaaggtggatatcctacagtggggagtgccaaacaagatcgacatgatagcactctcgtttgtacggaaaggatcagaccttcagatggtccgaagtgtgctcggtgagcatgccaagtcaatcatacttatgtccaaggttgagaatcaggaaggtgttgctaattttgatgacatacttgcaaattcagacgccttcatggttgcacgaggagatttgggtatggagatcccgattgagaagattttctttgctcagaaggtgatgatcttcaaatgcaatcaacaaggaaagcctgttgtcactgcaacccagatgctggagtcgatgatcaagtctccccgccctacacgggcagaagcaactgatgtcgccaatgctgtcct

SEQ ID NO: 105433 - DNA, 425 bp, Triticum aestivum
  Clone ID: PAT_TA_105433
gacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccggcggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccacacagaagaccgttgatggtccct

SEQ ID NO: 105434 - DNA, 430 bp, Triticum aestivum
  Clone ID: PAT_TA_105434
gtttccttttcctattaatgcttccttccaagcgcacggctccttttcctttcccaaaaaactctgtcgtcccccatcaatcccataggctggacgtccatccctccagaggttgatcgatcctctcgcaactacccaggtctctacgagaggttgatcgatcctctccaactgtcgctcttcctcaccctccatggatcaggggggacgcgcctatccttcggctagctgaactgcctgacgatcgctgatggcttgatgctaccgactacgtgtggctatgccgaacagtgttggaaccagacaaggctattgagcaaaacttcaaaagaatggaggaggacaggtcacagcgctgtttacctgcttaacaccattcgattttgtgggcggtaaccttaccaacaggttattgaaaaaaaatcatgcc

SEQ ID NO: 105435 - DNA, 530 bp, Triticum aestivum
  Clone ID: PAT_TA_105435
attctctgttattagagacagtgctccgcctgtacagggaaagtcacaacagcggcactgaaaatttggaccgttctcatggtcattctcagcccatggaagtgcaatcgcctatcgaaaatgccaaccatcctgaagggcgtcctcagcccatgcgaatgcaaccacctactgaaaatgcaaacccttctcatgcgcatcctcagcccatgcgagtgcaaccacctactgaaaatttggatgatcctgttggattttagtccacctactgaaaatgtgaacaatttgtttggccatagtcagcctacgcaaatgcaaccatctactgaggctgtgcatcattttgcgcaaatgcaaccatctaccgaggctgtggatcattctaatggtcatgctctgaccatgcaaatgcaaccatctagcgaggtcgtggatcattctaatggtcatgctcagaccatgcaaatgcaactgttttgtagacctaccaagctgagacaaacaatgcttcaatgggattacttgagtat

SEQ ID NO: 105436 - DNA, 442 bp, Triticum aestivum
  Clone ID: PAT_TA_105436
ggcaagatcctgttcaagagtgtcgcagaattatgtgtgagtacagaagtcttgttgttctcgatggattacgttccagagaggattgggacttgataaaagccaccttcttacccgattctactaatgcatgtatcatcgtaattacaaatgaagcaagtgtggctacacattgtgtagataataaggaagatcgagcggtcaatgtgggaggtgttgaagctgacatgacgctcgttctcttcaaacagataataaaggatgggatggaatttactcctgacgagatggagctctccaaagttaccttaggcagatgtggtgggattcctaaagttattgctactataggccaactcttcaccaaagagaatgccagtcctactttgacggttgctcagattccctcaagccatgcattttctatctgtcaatcttccct

SEQ ID NO: 105437 - DNA, 446 bp, Triticum aestivum
  Clone ID: PAT_TA_105437
ggctgctctatagaacttaggtagtatactacttcatttagctatgggagtgttatctatctgcagtaacccagtaacaatcatattgcaaatagttctattttggtgcttttccacgattagattgtttatcccctattacagctatgggatgttaatatggattctggtccagttgcaacgttccaggttcacgagtacctaaggcctaaggtgattgctccgatgttaagatccatgatttgatagttctttgaggatgatgagcaacacatatttctctggagtaactctatttcacgtgttttcttaaactgcagttatgtgatttatatgaaaatgactcgatttttgacaaatttgaatgttgtcaaagtggcgatgggttgcgagtagcaactggttcttacaacaatgttgtgcgagtgttcaattgtggtgctggt

SEQ ID NO: 105438 - DNA, 362 bp, Triticum aestivum
  Clone ID: PAT_TA_105438
ggctcatcaaggccgccgccgccgcaatcgacaagctccccgagctcgacgccgccgccttccccaaccacccggcctcagcctcagccaacaaacagtcttctgctcttcacgcggaggccgacggctcgcagctccagcagcagcagctcaccagatcgggctgcagcagcacgtccgagaccagcaagggctccgtcctctcgctctctcgctccgacagccgcgtcaaggccagggagcgcgcgcgcgaccgtagcgcctctgtgaaggacaaggacgactcggtcaccgccgccgtgcgccgccgcgccccctcggcgcaggcggcttccttcaccgagctgctcactggattggcg

SEQ ID NO: 105439 - DNA, 585 bp, Triticum aestivum
  Clone ID: PAT_TA_105439
ctacatacactgctgctgctgtttgtcaaatgaatgaacgaaccttccttacttacttaatttgacaaataaaccaaccttcctctagatcaagcaaagaattaatgaatgaatttgcagcttcgctgctaaaatgaatggccaacttctctgaggtttattttggtcaatgaatttttatacaaatgaatcagactgtcatttggttttttattagtcacgcctgccggagtggctattactttgctgcagcagagtttgcaacggatgcttgcttcctgaggtgagtgaccacctatgcatcgtgacggcagtggatgatggcatcacctacaaaaccccaataaccccggcggctggataagagcataggagcaagcagagcagatggtttagccggcctcctcctctctctcccttcccttgctttcactcgcttttggcaccctcaccgccattggtcgcatacccagataattgatgaaaaaactacgataaagaaatatcgtcgccgtctcatcatcttcgtcgacatgagcatctctgtcggaccatgcacccatgccttcccatctaccttgctgg

SEQ ID NO: 105440 - DNA, 464 bp, Triticum aestivum
  Clone ID: PAT_TA_105440
gcctcccccactccgttcgaatactcctcctccacctagggttttgctgcctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattggtgttgaagttcacccgttggatttcaccactaactgtggaaagatccgtttctactgctgggacactgctgggcaagagaagtttggtggccttagggatggatactatatccatggtcagtgtgcgattatcatgtttgatgtcacttcaaggctgacctacaagaatgttcctacgtggcacagggacttgtgcagggtttgtgagaacatccccattgtgctgtgtggcaac

SEQ ID NO: 105441 - DNA, 483 bp, Triticum aestivum
  Clone ID: PAT_TA_105441
tttacccgaaccagtccagccactcgttagttcaactatagtacctccatcaaatgaaacgatcaaccctaaaccattgttcagcagtctatttatgcctggaaatagacctcttattcaacaatttgtacctgcggtcatacctcgtcccccatttgtgccattcttacctggacctattcccaatccatcgttcattcaacatcatcaaatgcaacacttacagcagcttcatcatcgattcgctcatcaacgccgacagttttatcctcgaccaggtacaccttaccagcatcacgatagaagttccaacgacgatgagtacgctggcttaatgactcaaagcaataaagaatggctgataaaaattcaaaatagtgcattaaatttcacaaacccttataaagaagaattttatttcgtatcttttaaaacaaaacaattggcaactgctgctaaagctaaaaaaggagacaatggatc

SEQ ID NO: 105442 - DNA, 177 bp, Triticum aestivum
  Clone ID: PAT_TA_105442
tctctcagtgtcggatatgaaagtgacttctattggtgtatgattgacaggatatgggatggttacttgcatagtcccctccatgctgctggtcagatgctaaacccaaagttgttttacacagctggattccagcctgatgctgagatcagcagcggcatcgcggcatgcacaatc

SEQ ID NO: 105443 - DNA, 558 bp, Triticum aestivum
  Clone ID: PAT_TA_105443
gatcaccgaacatgcactgcgcatgccctaatcgctgggatggatctgaaaaggagaatttatggggctctgtttggactttacgttccccaagagttggatattagggatctgctcatgaaatttttttggcgtttcggtgaggttcttggtcatgagaaaactcgagatctgatatcgcacagaattcactgcttaatgagcattgcacaagttgaaggcgtgggctacgaaaatgcttctgcaatggtcccagatgtgtatccggtggctcccctgggcagagtgttgaaagttgctgcttgcttctttgtcaccaaggacatggttgatcgcatcgtaaggctgctggccggtgggttccctctggtgaccgccgtgccaactggcaggtgcttccgctacgtggcagctggacagatctacaacgcgccaagcatcccccagaatcatgctgtactgctaataggttttggaacagctccttggcctggagatgattttgctcagcagaacagtgcagttactgctaactggccaaccgatcccactactggc

SEQ ID NO: 105444 - DNA, 393 bp, Triticum aestivum
  Clone ID: PAT_TA_105444
cccatcgtgttattggaactcttctagggtctgttgagaaaggtgttgtcgaagtcacaaactgcttctgtgtacctcacaaagaatatgaagaaactgttgaggcagaaattgtgtacgcgaaggaaatgtttgagttcaacaaacaagttaatcctcaagaaaatattgtgggatggtgggccaccggtcatgaggtgacatcccattcttcagcaattcacgatttctattcccgtgaatgtgctaatcctattcatttaactttggatacaactcttcaaggtgaaaggatgggcgtcaaagcctatttgaacgtgcctattggtgttcctggaggcaaggttggctgtatgttcacaccaatttctgttgatgttatctgctatgaac

SEQ ID NO: 105445 - DNA, 526 bp, Triticum aestivum
  Clone ID: PAT_TA_105445
ttttttttttttttttttttcctcataaatgttttattaaaaaaccggtcgtgacacaccacccgagccgatgactctcactggccaagtacactacagaacgatgcctctaagaagaaccgcgacacggaagcgccgccatcgtccgctccaggaacctggaacaagggtttcctccggagtgcgggagaaaaggccgtaggccctcgaatgacgacacctccaagaaggtgcgcggcacccacaggcgtcgccgttgttggctccagccaaggcaagagcatggctttcgccccgagaagcaaaggaagctctcccctcaaaccgacacatgagagccaccgcctgcctgaaccgccaccagagcccgaagccaccgatcagaacagcccgccgccgccacctgcaccacgctgagccgccggcaaggctacccatcaccacaacaggagccagaaacggccacgtttggacagatctggcaccccgcgcaacagcacgagccaacccaccggcaagtgccaag

SEQ ID NO: 105446 - DNA, 447 bp, Triticum aestivum
  unsure (1)..(447): unsure at all n locations
  Clone ID: PAT_TA_105446
aacagcgagcgtgagaggcagcgaccagatcggagtccggcacagaagagagctagcgcgcccgtgccgtccggcgaggagggggagcacctgcgccctgtggagttcatccccggcgcccgcatccttgtcgtcgaccttgcccgcacggcaggtcgccactgctggcggaggccacccaggtcgacaccaccccgtccggcctgcagcacatccttctcgaggacatgggaggagggacaaacattgtctgggaggcangcaaggagggaggccaatcttagttcatctaattgtttgatcggtctcctgatggacgccatggaggttgatgttaagtgagcaggcagtttgtcattgttcgtgaatcgtctgtttagtcttcctccttgctttgtccgtgctcagctttataataagtacactatgacttcctatgagaacttt

SEQ ID NO: 105447 - DNA, 375 bp, Triticum aestivum
  unsure (1)..(375): unsure at all n locations
  Clone ID: PAT_TA_105447
ctcggctcgtgctccagagagccgtcacgtccgccgcctcctccccctcgccctcgccgccgggatggccccgccctctccgctacgccgtcctcggcgccggcttcgcggggctctccgtcgcgtggcacctcctcaagcaaagcccgaagtattcgcgcgtgtcggtggacggggggacgagaacggcgtcnggggaggcgcctcgggggtctctggagggcttctccatccgtactcaccaaaagccaagcttctctggagaggaggcgaattctggaaagagagcatggatctcctgcgcagcgcagagaaagcgaatggaatcgctggatcagatggcgatggtcgggatgatgaagcccttatctggag

SEQ ID NO: 105448 - DNA, 435 bp, Triticum aestivum
  Clone ID: PAT_TA_105448
cggcacgaggttggttcgtcttgcggatcaatttttgataaaatgattaaaggcaaagctaatacggctcactgtgtacgttttccaggtgattggtttcatgtttttggaattgggacgaggtcaactgggtacagcatcagagtacaagtaaagaaaggctcttctgtaacggaggttattgttagtccagagaataaaacagttgtttctaaagataactttctgagagtaaatctcattggtgacttggttggtcacgaaagtatgccaacatttgaagacttctatcttgtgactccacggaagggtggtggtgagggtcaaccgcaagttcttggcgatgagttttcctggtggatgctgttggagagagtccggtttacattaaatggacttgagtgcaacaagattggtgttgggtatgaagcttac

SEQ ID NO: 105449 - DNA, 501 bp, Triticum aestivum
  Clone ID: PAT_TA_105449
tttgcctatccttatcgacaacttgtttgcacaaacgtatgagctgataaaactagtacaacaacagaaaccacgatttgtcgtatggtgaaaatttgatggaggaaacaaaaatactctatcttatttcgcgtctgtttgcttcggcttaaatgtcgcttttggaagaacgaatattttagctagctagcttgttgtgtaaggttgttgtgttgagttttgacttaagcagaagccacgtcgatggtcccgaactatccgaagatgcctattgcccaacatatgttgtgtatcttagcctcggctcatgtgtcgcttttggaagaagaacattttagctagcttattacgtaagcttatattgcgctgagccttgacttaagcacaagctacactcatggtcccaaaccatcccaacatgttgtgtgcatctgcatctagcacaagctacgccaatggtcccaaactacccctagatgcctaacatatgttgtgtatgtt

SEQ ID NO: 105450 - DNA, 394 bp, Triticum aestivum
  Clone ID: PAT_TA_105450
cctgaaaagtatgacaaaagctgtgacatctggtcgttgggtgtcatcatgtatattctgttgtgcggatttcctccattttacagcaaccatggactagcaatatcccctggcatgaagaaacgtattcgaactggacagtatgacttccctaatcctgaatggcaaaatgtatcacctgaggccaaagaactcatccgtggtatgctgaacattgaccctacaaagcgcttcactattgagcacgtcatgaagaacaggtggattgctcaatatacagaagtccctcaaactccacttcacacaggtcacatgctacgagttgggggagatatatggccagatgtacaggaagaaatgactcggtcccttgctacaatgcgggttgattatg

SEQ ID NO: 105451 - DNA, 363 bp, Triticum aestivum
  Clone ID: PAT_TA_105451
gttgctacaagtacaactaatcacaccacaagcaacatgcagtggcggggattccaacatgaaggcaaaccttttgctctcaagatggaggcggatcccttcaacatggtgccccaaaagctgttcttagactaacaagagcaaattaatcaatcgcacgcatgaattgcccaaccataaaataattcctggtgcctttcaagcctaacaactcactgaagggcaacgtggtctctactctcttcatataagaatgatctccattcatcatcactagactatccaactcgaatataaagaggcttagagtccctatgtttataaaaaaaaaaaaaaaaaaaaaaaaaaaaaaaaaaaaaaaaa

SEQ ID NO: 105452 - DNA, 212 bp, Triticum aestivum
  Clone ID: PAT_TA_105452
caggtcttcgccgccgccttcgccaacgctcgctcaagcaggccaaggaccccaagcaggacctgttcgacccgccgcacactagcgccatcgtcaccaagctcgcgcacacggaccagttccggtgcctcgacaaggccgccatggtggcctcccccgaggaggtgcgctccggcggcgccgcggcggccgacccgtggcggctctgcacc

SEQ ID NO: 105453 - DNA, 211 bp, Triticum aestivum
  Clone ID: PAT_TA_105453
tcccgcgctcccactctgtcggtccgcaaagccatgctcctgtcgccaccagccccatggccgcgcgtcgagcccgtgcgcttgaatcgccccccgcagcgcaaaggccggccgctctcgtttccccgtagccctccgcggccgacgacgccgcggcggctcggcgtgtgcatggctgagatgaccatggtcggaagcgggtcattccggg

SEQ ID NO: 105454 - DNA, 267 bp, Triticum aestivum
  Clone ID: PAT_TA_105454
gcttctcgcggctgcgccgcgccgccgccctcctcgacggctcgctgcgccgcctccggctgcggccgcatcgccgacgcctcgaccgagtcatcgggcaccaccaccgctgtaccacctccccgactgttagccatcctgtttgataaaatgtcggcaccagcatccattccctgtggttccaagagtgtgcgaggcaacggggcggtgtcaacaggctcaacagcctgtccgacgatctgctccaccacgtgatgtccttcctgc

SEQ ID NO: 105455 - DNA, 504 bp, Triticum aestivum
  Clone ID: PAT_TA_105455
gggtggtggttgagtacatctctgtaagttttgtaagttcagagacaggaaaccggtaagtttagacaaaatttaaactgtcaaagaacatgagtttttgtacagtttagaacattgaccgtcgctacccattcaagtaatcacaataccatcatggatgacaacagttcaaactgtcatggatgatgcaagttgtatccgtgtacatagttatttatttctattatgacaagttcaactgatcaaatgctacaagtttgcgtgttattttctaggcagtacaagtgataattgttcttatttcttcaccattttttctataacctggactctgtagagaaggtagcgagtgctctttgtgatattaatttgatcaaaactgaacaaggtgttcccattttaactaagccttctgcattatttctatgatacatttttgcatagatgatagtacatctgcagttttttgtgaaaagtcgagacactgaacatgtctactgcatg

SEQ ID NO: 105456 - DNA, 443 bp, Triticum aestivum
  Clone ID: PAT_TA_105456
ctgcccacaaaaccctagccgtcgcctcacagctcgccgccgacgcagcgagctctccctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgcgggtgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggccgagtcactccgctacaagctcctcggaggccttgccgtccgcagggcttgctatggtgttctt

SEQ ID NO: 105457 - DNA, 327 bp, Triticum aestivum
  Clone ID: PAT_TA_105457
tttcctctcgttttcttccgcctctgtaatatttttttcgattttggggactgggtgagtgcatttcactgaggccttccatgtgcttatgggtgtgcttgctttgcacaaaattgaatattcttgatcaaatgtgatatgtataactaaaagctaaaagatgaattgtgttttctggtagcaaaaaagtgatgctctataggtgcatactagtatatggggggctcatgtatatctgtcatcagttcataaaaggcatatagaaagtgttcaaatctgtgtgttaaaattccagtttggttttgtattaactgctccaaggaatga

SEQ ID NO: 105458 - DNA, 378 bp, Triticum aestivum
  Clone ID: PAT_TA_105458
ccttttctgataggtactatgaagagtcaccagaattgttcgttaaccgggatgctgccctggtgctgtcgtattcagtaatcttgctcaacacggaccaacacaatgtacgggttaagaataagatgtcagaagaagattttattaggaacaatcgccgcatcaatggtgggaatgatcttccgggggaattcttatctgagctatattattctatttgtcgaaatgaaatcaaaaccattcccgagcaaggagttggatgctcagagatgtctttcagccgctgggctgatctgatgtttaagtcaaagagggcatcagcttacattgcttgtcactcctatccttttcttgatcatgacatgtagcttatgatgg

SEQ ID NO: 105459 - DNA, 446 bp, Triticum aestivum
  unsure (1)..(446): unsure at all n locations
  Clone ID: PAT_TA_105459
cgactacaaccatttgcaggacgattatgtggttatctgtggcagtgtgctcctatcctccccgcctccatacttcatttttggaaaactaattattttaattcctggatgtcatanatgttgaggttggtcctggaatggttggcattgggacttttggtggcagtatattcttatgccgacgacaagcatttgcaggacgattatgtaccgtggggttgtgcctcagcttcgtagccgatcttcgatcgtccatggcatcaacacacaaattgataatgcaaacctcaggtcaatacctccccctatttgatttctgcggcagagtgctaataacttttattgtttgtgtttttggataagatttgcatggtgattctatcattggttgattgcttggatactttcactatagtagttgttctgcctcatctatcactatctgc

SEQ ID NO: 105460 - DNA, 361 bp, Triticum aestivum
  unsure (1)..(361): unsure at all n locations
  Clone ID: PAT_TA_105460
ggttttccgcttctcttcgcccgatttccgttgatttctgactctgcgcggtgcgccgggcgtgtaggataaggtcgaggagcaggcggtggccgcggcggcggcggaggatgacgacnaggatgtcgccgggagcgtcaacggcgacgaggtggagatggagcccgtggagcccatgccggagccccccgacgacaccgggcccgggtggtgggccatgccggacttctgccctctcacggtgagcgcccggcttgcttgcgttcgttgcggttggattgaacttgtaaagtcggaaacggaattgatgtcctgcctctctctctctctctctgtcggtgatgtttggtggtatcacctc

SEQ ID NO: 105461 - DNA, 595 bp, Triticum aestivum
  Clone ID: PAT_TA_105461
aatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattga

SEQ ID NO: 105462 - DNA, 343 bp, Triticum aestivum
  Clone ID: PAT_TA_105462
gtgaccagggttcggcttcatctccccggaggacggcagcgaggacctcttcgtccaccagtccgccatcaaggccgacggctaccgcagcctcaacgagaacgacgtcgtcgagttcgaggtcatcaccggcgacgacgggcgcaccaaggccaccgacgtcaccgcaccaggaggaggtgcgctcgccggcggctcccgccctagcgaaggcggtggtgaccgcgggggtcgcggcggcggtggctacggtggaggcggctatggcggtggcggcggcggctacggaggtggcggcggtggctacggaggtggcggcggcagctacggcggcggtggcggc

SEQ ID NO: 105463 - DNA, 238 bp, Triticum aestivum
  Clone ID: PAT_TA_105463
cacggggccccaaaccctatcccgggccgcgccgcgcatgggcaagtacatgcgcaagcccaaggtctccggcgaggtggccgtcatggaggtcgccgacgggccgctgggggtccgcacccgcgcgcgggcgctcgccatgcataggcaacctcatggggctccgggggccaacgaccaaggggagtacctggagctcaggagccggaagctcgataagctgcccccgccgccgccg

SEQ ID NO: 105464 - DNA, 492 bp, Triticum aestivum
  Clone ID: PAT_TA_105464
ttgcatcggtatactgctgacaaactatcttcctttggagagctagcactgatgtataacaagccacttcagtcttcggtccgtgccgtgactaatggaacattatgggctctaaagcgggaggatttccggggaattctgatgtcagaattttcaaacataccatcactgaagttgctccgatctgtacaactgtttacaagattgacagtgcttcagctaagtcaacttgccgactcacttgttgaggtatcatttgcagatggacaagtaatagtagacaaggatgatgacgtctcttctctatatattattcaaagaggccatgtgagacttacagtagcagctgataggttaaattcagattcgtgggatcttcttagtactcacggaaagcaggtccaacagagtcaagaaagtggtaattatgtggttgagatagatgagggaggtcactttggagagtgggctctcattggagagactatcaca

SEQ ID NO: 105465 - DNA, 521 bp, Triticum aestivum
  Clone ID: PAT_TA_105465
tcccgcgtgccaagccaccgaccaactggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttg

SEQ ID NO: 105466 - DNA, 347 bp, Triticum aestivum
  Clone ID: PAT_TA_105466
gacctcaccataagggtgatcgtaaagcaagggcagcaggctctgttccaggccgtttacctcggcgcgtgcggcgcgctggtggcgacgatggacaatcagttcccgaagctgggcatgacgagcgccgactgccagcagatgacctggctgcagtccgcggccacgcccttcctcagcttcgccagcaatggcacgctggaggaagtgctcctggacaggaccgtctggacgagcgccttcaccaaggccaagtccgactacgtcctgcgcgccatcccaaatgccgtgtggaaggacatcttctcccgctggttcgccatggacggcgcgggggacatcattct

SEQ ID NO: 105467 - DNA, 484 bp, Triticum aestivum
  Clone ID: PAT_TA_105467
acgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaacca

SEQ ID NO: 105468 - DNA, 435 bp, Triticum aestivum
  unsure (1)..(435): unsure at all n locations
  Clone ID: PAT_TA_105468
cttctccacccctctcaccgacggcgccgtccgcgtccacccgcctctgccgtctccttccttctccccgttggccccctccacctcctctctgtcgtcgtctgacccagatgcggccgcagcccgccggtgcagtaggcggaggagacgcggctaagaggagcacgagccaccgccgacgcctacccgacgacgctgtgaaggagtcgaccagagagggaggacctctatgtgcgccttccgctgccgatctcngagggtcacggccgatgcgcgtcacgatccaaccacacaacgagccaaaggatgcgccatggattcactgtccggtttgtcagtctgggttcataagagtatagtaatgcatcttcagttatcaagggtgtggcatatcttggcagattagtggggagtgaggacatattgatggacaat

SEQ ID NO: 105469 - DNA, 291 bp, Triticum aestivum
  unsure (1)..(291): unsure at all n locations
  Clone ID: PAT_TA_105469
ctgaacccgcaacctgcggttggagtgtcgtgctgcctcctcctcccccgtaagttgattatccttttttcttagctttccccccttgttttcttggcgctggttttctattccaccgaaaaaaacttaggatttgtttgtttcgtttctctaagaagcctttcgatcattgcgtcttgtttagtggatatttcccttnagattcttgtttttgtttagtagtctgcaaatgtatgtggttttttggatccactggtgtggtgtggtgtgatgtggaagacctgttgggat

SEQ ID NO: 105470 - DNA, 408 bp, Triticum aestivum
  Clone ID: PAT_TA_105470
tgcatcattgctaacaagcagttgttattgtgaagggtcttgatgagtggcctaatgagttccagagacagtatggtactattgacctctattggattgtgagagatggaggattgatgcttcttctgtctcagctcctgctcacaaaagcgactttcgaaagctgcaagatccaagtcttctgcatagctgaagaggacactgatgctgaagagctaaagactgatgtcaaaaagttcttgtatgatcttaggatgcacgccgaggtcattgttgtgactatgaagtcatgggaatctcatgtggagagcagcagcagtggtgctcagccagatgattctcaagaggcttacacaagtgcacagcgcaggatcagcacatacctttctgagatgaaggaaacggcac

SEQ ID NO: 105471 - DNA, 228 bp, Triticum aestivum
  Clone ID: PAT_TA_105471
tacttaccaccctctgctttcctcccatcacacagccgcgcctctctcttctccgtctcactcttgtcccccacgcccccgcttctgggaagcggccttctgaaccttctctccggctagggttccggctccgacggcggcgaggatgtgtgccgcgcggccgcggaggtgaggcggcgggcgtggtgggataaggattggtgttggtattgggattggaggaagggg

SEQ ID NO: 105472 - DNA, 547 bp, Triticum aestivum
  Clone ID: PAT_TA_105472
aacatggttcccaggtgcagtgctcaacattgctgaatgttgtctgctaccttggccctcccagaacaagacagatgatagcacagctattgtctggagggatgagggctttgacgattacccagtgaaccgtatgtcgttgaaggagcttcgcacccaagtgatgactgtcgcaaatgcccttgataccatgttccaaaagggcgaccggattgcaatagacatgccaatgacgtgcaatgcggtcattgtttatttggcaatcatccttggaggctttgttgttgtgggaatagcagacagttttgcacctcaggagattggcactcgcatgagggtcgcaaaagcaaaggcaatttttactcaggatttcataattcggggagggaagaaatttccactttacagccgtgtcatggaagggacttcagctaaagctattgttattcctgcaactggagaccttcttggagttacaccaaggaatggtgatatgtcctggaaagattttctttctcgttctgctggaaggtcatccatgtactct

SEQ ID NO: 105473 - DNA, 443 bp, Triticum aestivum
  Clone ID: PAT_TA_105473
ctcgcctccaccgcctcctgtcccctcgcgcgttccgcctcccagttgcggctccggtcgttcccctcctcctcggttgctgagatggccggtcgtgggaaggcaatcggcgccggcgcggccaagaaggcgacgtcaaggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacacgtatcgtgccccgccacatccagctcgccgtgcgcaatgacgaggagctgaccaagttgctcggcggcgccaccatcgccagcggcggtgtgatgcccaacatccaccagcacctcctccccaa

SEQ ID NO: 105474 - DNA, 498 bp, Triticum aestivum
  Clone ID: PAT_TA_105474
gcacggcggtctctccgggatcgacctgctcggcaggatcatgaaccacgaggtctgcaaggacatccccgtcatcatgatgtcgtcgcacaattcgatgggcacggtcctcagttgcctgtcaaatggtgctgctgacttcttggccaagccgatacgtaagaacgagcttaagaacctttgggcgcatgtgtggagacgctctcacagctccagtggcagtggtagtggaagtgccattcagacgcagaagtgtaccaaatcaaagagcgctgacgattccaataataacagcaataaccgcaacgacgatgccagcatggggctcaatgcaagggatggcagcgataatggtagtggcactcagagctcacggacaaagcgtgccgttgagatcgacagtccacaggacatgtctccggatcagtcagttgatcctcctgatagcacttgcgcgcatgtgagccacctcaagtcagagatatgcagcaatagatt

SEQ ID NO: 105475 - DNA, 477 bp, Triticum aestivum
  unsure (1)..(477): unsure at all n locations
  Clone ID: PAT_TA_105475
attacaggtgatcagttggctattggtaaggaaactggngcggagctaggaatgggcaccaacatgtatccatcatcatcattgcttggtgacaaaatagatagtgatatcgcggtcctatcagtggacgaactgattgagcaggcagatggttttgctggagttttccctgagcacaaatatgaaattgtcaagaggctccaagccagaaagcacatatgcgggatgacaggagatggagttaatgatgcacctgctctgaaggtagcggacattgggattgcggtggctgatgcaactgatgctgctcgcggggcctctgatattgttctgacagagcctgggttgagtgtgatcatcagtgctgttttaacaagtcgcgccatttttcagcggatgaaaaattatacaatatacgctgtatctataaccatccgtattgtgcttggttttttgctcttggcgtgcctttggaag

SEQ ID NO: 105476 - DNA, 452 bp, Triticum aestivum
  unsure (1)..(452): unsure at all n locations
  Clone ID: PAT_TA_105476
ctcctctgttgggcttctttgctgggtttgatgaaacgagcctcaacttcgttcctttccctgacacggnaatccaacagcatccccatccccaccgagcgctttgccgtgcccgagagcagcagacactcctacttctggagcttcttgggctgccgccatgggctcgctgtcctgctcaatgagagcctgcgcaaggtagtcgtgtgggaccccctgaccggacagcagcaccgcgtgtcttttccacaggagctctccaacgaaatcttcgacgaagacggtgagttcatactctggcagtggcacgccgcggtgctgtgtgctgataccgaggaggggcacattcatggcgattgtttctcgagcccgtttaagttggtgattatccgcagcggacagtcagaaggatatttcagtactctaccgacatatgcctgcctctacgattc

SEQ ID NO: 105477 - DNA, 152 bp, Triticum aestivum
  Clone ID: PAT_TA_105477
aacaatgccatccaagacatgcctgtccatgagggcattgcccgcctattatctggaacttatattaactactttcactgcttaaaaattattgaaattttgaaagaaacagaagctgatagtcgaaatgtctttggacgttatggttctca

SEQ ID NO: 105478 - DNA, 499 bp, Triticum aestivum
  Clone ID: PAT_TA_105478
acccacttatgatgcatctctagctgcattcgcagctccacttgtatctacatgtttgtcctttgttggtcatcatgtactatcttttcaagctttttcaatgttcatgtttgtagttcatgcagcaatttttaatgttcctttcttataatttttcttgctcttgtgccaatgcaacagggtctaccagaagcagagtttcatgagccaggtgagaagattgtcgaggcaagtagcaacggtcacaacggtcttgtgaagaaggcagttaagaaaagaacagcccagcctcctgatggtgttccaaagatgaagaggatcaagatcgaccgaaaagatgatgctctgtaccaacagtatgtgttgagtaggtacaaaataccaagagcaaagaaagatcaagtaatagggtttccacacatcacttcagaacttccatggttcattaaagccacgaggtgatcttgacagtgaggtaatggcattgtatctgaaaact

SEQ ID NO: 105479 - DNA, 330 bp, Triticum aestivum
  Clone ID: PAT_TA_105479
ctcatcccgtccccgctcggctggtcgccgcccgcgtgcgcgtgcgcttgccggacctgaccgtgcagcagcttggccggcaccgaagcccccatcggggtcggccggacctgcgttgattggctggccgcggcccatgtgcgcttgccggacctagccgtgctgcagcttggccagaatcggcgcctaaatcgacgtcgggcggacggcggaccagcgtcgccacccagtggcgcggaggttggtgagccggcacggggcgactacacaagagggcggcgcctcgggcttgtggaggagcttggaggaggggtcgagggagcgagatga

SEQ ID NO: 105480 - DNA, 326 bp, Triticum aestivum
  Clone ID: PAT_TA_105480
ttttttttttttttccttgagtaggtcccacctataagtgtcatatgcgtataggggcaaaactggccagaaaatgtcatgtagccagtcaaacgcctttgaccacatggaaatggtacggaagggtatttctataagaagctttgacggaagaggggcatttttgagcatgctcgaaatttaggggtaaatgccaggtgtgggttcaagttagggggagaaatggaattgttcctttttttatttttagaataattctgaaacgaggtcactcctactgatcttgctcttcgagtttggtggtaggatgctaggtcaagaatgca

SEQ ID NO: 105481 - DNA, 564 bp, Triticum aestivum
  Clone ID: PAT_TA_105481
cccaatctcctccacaccatctggttctaaccttcagttcgtttaggtgatcatggagctcaaggccaaaggatccacctctatcaaggcactacttgtagaggacattgaagtttgtaggttggtcctctcaacaattctgctcagacttcactgtgaggttactctagccatgaatgggaaggaagctgttgatttgttccttgaggggaaaaagtttgacattgttttgttcgataagaatatgcccatcatgactggtccagaggcaattgtgaagattcgtgctatgggggaaactgatgtgaagatggttggggtttctgccgatgatcatgccatggaggccttcatgagtgttggtgctgatttatttgtgccaaaaccaatgaggatggaggctctcggccctatcattcaagaggtcatcaacaagaagaagaatgacatggtctagcgcaattcatcttgcttaagtgatggaggaaataataatgtataactttttgatctatgtttgcttcagtctccgttgttgtgttgcttggtcaaatgtatcatttg

SEQ ID NO: 105482 - DNA, 519 bp, Triticum aestivum
  unsure (1)..(519): unsure at all n locations
  Clone ID: PAT_TA_105482
ccaccgccgtcttcctccatggcgatgagctgctcagcgtttaactagtagtactccgtagcatcttctccgagagcattgcaacacacngagattgangaaaaatcagcacccacgccgtccgaatcgatgagcagcggcggcggcggcgacgacgcgggggacggcgggcgggccgagtggcagcgcatctacgaccgggtcgaggcgctcgccgccggccgcgcgcggctggaggcgcgcaacaggatccagcacgagttctgggacgcccgcctccaccaggtgtgattcatcggaccgttcctgtcctcttcctcttagggttttctcttgggcttccctgcgcctgattgatggcttacatgttctcatcccggaaggcggagctgagcagaagcaggtgggaggcggcctgcagggagctgctcccttccgatgatcccaagctcgccggtacagctgaaggaagttggaacttgtgtactgcttaatgaaaacactgcggatcatgagcac

SEQ ID NO: 105483 - DNA, 428 bp, Triticum aestivum
  Clone ID: PAT_TA_105483
tcgtcggcctcatcaaccgcgactacgccgacttcgtcggcctcagcgcccgcctcaaggcgtcgacgccgccgctgcccgcatgcgcgccccgctcgccgacctcagggacaaggtcgccgccttccgcgccgccgcctccgccgcgctcgccgccctccgcgcagggctcgagcagcgcgccgcggcgacccaggcgcgcgagctcctcgagctgctgctagacacctcccacgtcgtctccaaggttgagaaactgatcaaggaattaccaacagcaccatctgattcatcagatattgaagatcgttcagttgataagggctaccctggcaatgatactacgtcaccaaatgtggaggcagggacagatgtcagagaaacacaaagcattctgttagaaagaatcgcaagcgagatgaaccgac

SEQ ID NO: 105484 - DNA, 437 bp, Triticum aestivum
  Clone ID: PAT_TA_105484
ttctcgtccactccaaaccctagcctcctcctcctctcgccgccgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtgaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcgcttagagctcttgcacgttctggcatgaag

SEQ ID NO: 105485 - DNA, 313 bp, Triticum aestivum
  Clone ID: PAT_TA_105485
ctcaaggcaaggtcgttgtcatcaccggcgcatccggcgcccgcggcatgggcattgaagccgcccgtggctgcgccgagatgggtgccgatttggccatcacctacgcctctcgccccgaaggtggcgagaagaacgccaaagagctcgccgccgagtacggcgtgaaggtcaaggcctacaagtgtgacgtcggctcctgggacagcgtctcgggcttcgtcaacgacgtgatcaaggacttcggcaagatcgatgccttcattgccaacgccggtcgcacggccgacagcggcattctcgatggctccgt

SEQ ID NO: 105486 - DNA, 458 bp, Triticum aestivum
  Clone ID: PAT_TA_105486
aactccaacaaatccggcgactcgagctcctctacctcctctgccacaagcggcggtagcgggacaagaagaagaaagggaagactctgtctctggggaaattccatattgaggtggaaagtgcatatcctcaaggtcagtctgcggttgctcaaactcgcgctcgcactgctgatcctactccgcagactcggcgtccgaattacaagagtaaagaggaattccccctccttggggcttcgcctgccgcttcatcacacaagcagaatttccatgcggctgcacatcctcccgagtctgaccgtctgctaccccgtgaacaagtgatggatgtgagtggctctccgtctgagctggcttgtctgaaggccgcggctgctgagctggctcgtctgaaggcccgtgacgacctcttggaagagctcgccgctgaaggcagcgcagagctgaaagctgag

SEQ ID NO: 105487 - DNA, 186 bp, Triticum aestivum
  Clone ID: PAT_TA_105487
gcaatggtgaccaccggcctcgtggcggtggcgtcgctcctcctgctgctcgcgggcgacgcgtcggcggcgacgctggcgctgtacaacaagtgcggcgagacggtgtggccgggcatccagccgggcgccggcaaggagatcctggcgcggggcgggctgcagctgctccccaaccgggccacc

SEQ ID NO: 105488 - DNA, 330 bp, Triticum aestivum
  Clone ID: PAT_TA_105488
acgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccttcagactcaacaaccacaacaaccatt

SEQ ID NO: 105489 - DNA, 155 bp, Triticum aestivum
  Clone ID: PAT_TA_105489
cttgctgccgtcccgatggcaagcaccaacatggcgtcggcccctccagatcatgctggcggcgggcatccccagcggcaccaacggcggcgtgagcagccgcgtcaacttcgtcccctccaacccgctgggcttgaagctcgtgggccgcgccg

SEQ ID NO: 105490 - DNA, 199 bp, Triticum aestivum
  Clone ID: PAT_TA_105490
gctgtccccgcacgtccgcaccggcgacaggcggccgccccgtcccccgccgcctctgcaactgcaactgcgacggcggtgtcggcggcgagcttctccggcgagttcgagctgctgttcggcatgaaccagagcgggggggtctcgtccacccccggcgagaagatcacggtggtggtatcgccgtggcgcccgacgg

SEQ ID NO: 105491 - DNA, 528 bp, Triticum aestivum
  unsure (1)..(528): unsure at all n locations
  Clone ID: PAT_TA_105491
agcagcagcagcatctctcccctctccacaagcttcgatggcccgcacgaagcagacggcgcgcaagtccaccggcggcaaggcgccgaggaagcagctggcgaccaaggcggcgcgcaagtccgccccggccaccggcggcgtgaagaagccccaccgcttccgcccggggaccgtcgccctccgcgagatccgcaagtaccagaagagcacggagctgctcatccgcaagctccccttccagcgcctcgtccgggagatcgcccaggacttcaagaccgacctccgcttccagtcctccgccgtctccgccctgcaaggaagncgccgaggcctacctcgtcggcctcttcgagacaccaacctctgcgccatccacgccaagcgcgtcaccatcatgcccaaggacatccagctcgcccgccgcatccgcggggagcgcgcctaggctccgcacgcgccctgcccgctccgcttggttgccggtagctgtctatggttctgtagttgtttgccctccttgtatgt

SEQ ID NO: 105492 - DNA, 295 bp, Triticum aestivum
  Clone ID: PAT_TA_105492
tgttgtgcttcctcggtggaactcagaccgtggcatgccattcctatcgccgtcgtcacaccgatggcccgggcgggatccgccatccgcacggccgggcccctcctcggagggcgcccctccctcatcgccggcaacagcagcggaaggtgccgagtctgcaccgaatgccacgccgtttccgacgtggcggagcacagccacacggccagggcgctcggactccgcccgctcttcggcgcaccctccggttcaacctgcgcggtaggcggctccggcgcaacagccccccgcg

SEQ ID NO: 105493 - DNA, 526 bp, Triticum aestivum
  Clone ID: PAT_TA_105493
caaacttttaggtatggttacctctcgtgatattgatttcttggaggggaagcagaatcataacatcaagctggaaaacgtaatgacaaagagggaggatctagttgttgcatctgctggtgtcactttaactgaagccaatgatataattgaaaagtcaaagaagggaaaattaccgatagtcaatgattctgatgagctagttgctttaattgccagaacagatctgaaaaaggctcgtagttaccctgatgccagtaaagatgacaataaacaattacttgttggtgcagcaattggaacacgcgaaaatgacaaggagcgattacgtcttcttgctgcggctggagtagatgtcgttgttctggattcttctcagggtaattcaacttatcaaattgatatgattagatatattaaacagacttatcctgaacttcaagtcgttggaggaaacgttgttacggcagctcaggctaaaaacctgatagatgctggtgtcgatggtctccgtgttggaatgggt

SEQ ID NO: 105494 - DNA, 394 bp, Triticum aestivum
  Clone ID: PAT_TA_105494
tgtacactacctgtagccagggctacgggcaatgccagcagcagccgcagccgcagccgcagccacagccgcagatgaacacatgcgctgctttcctgcagcagtgcagccagacaccacatgtccagacacagatgtggcaggcaagcggttgccagttggtgcggcaacagtgctgccagccgctggcccagatctcggagcaggctcggtgccaggccgtctgtagcgtggcacagatcatcatgcggcagcagcaagggcaaagtttcgggcagcctcagcagcaggttccggtcgagataatgaggatggtgcttcagacccttccgttgatgtgcagaatgaacatcccacaatattgcaccaccaccccgtgcagcaccatcacccc

SEQ ID NO: 105495 - DNA, 291 bp, Triticum aestivum
  unsure (1)..(291): unsure at all n locations
  Clone ID: PAT_TA_105495
tggggcgtttgaacgcccgtggcggcgttcgtcgccggccagaaatcttgtgtccactgttcttcttcttccacctccgttcgagtgagaggagaggtagctagagggcttcggttccaacatttggtatcatgagcttggtgtcttgggcgtgctcgccgtgccggatgcgtggcagcgatggcggtgctcgccggcggctacncgatggagctccgggccgtgtgtcggcctatggaggtggtcggcgctgtggctgccatggcgcgtggcggaggcggcgggcggtga

SEQ ID NO: 105496 - DNA, 362 bp, Triticum aestivum
  Clone ID: PAT_TA_105496
agtcaatatcttagctgtaaattcttctggatcaactagtgcggtcttgagctttgtatgcgactatcttgatgcagtacagctcattgttgaaatatggtggttcattcagttggatgattctcatgcttttggccccacatcacttgatattttgcttgagaagttggatacatctgtgagaaggatgaaatgttgttatgctggattgcatagagaactggaggttcaagtcttggagtttgctttgttagctattttatgtagactgtctgagtttggaacatgttcaaaattagtgctagataagttgcattggataattaatcacattgatggtctgtgtgccgatggatcctatg

SEQ ID NO: 105497 - DNA, 395 bp, Triticum aestivum
  Clone ID: PAT_TA_105497
agctgcggcagcttctgtaaaggagctctgcatgggcaaaccttacgaggcctggcactacgtcttgcaaaccatggggaacttactagactatcgggtttagtggccaatttgatcacagctggccatggatgtgaagcagcatttgcagctgcagttctgggtgataatgccctcatggagaaagcatggcaagacacaggaatgctggctgaggccgttttacatgctcaagcccatggtcgtccatcgttaaggagctcagtcataacatggaacaagatgctgcaaaaggagctggatcacatgccaaccgtaaaaaccgatgctgcagcagcattcttggcttctcttgaggaccccaagctcactagtttgggagaaactgagaaaaa

SEQ ID NO: 105498 - DNA, 300 bp, Triticum aestivum
  Clone ID: PAT_TA_105498
acatgtagttttagagaacttctgaaaattccaattcagttttctgtgttccattcagagaacacatagtctgcactggggtataaaattatctactacttacctttgtgtctcgacatatgcttgtgatgcatcgtgctgccagaggccaacattatccagtatcatagtgatgctaaaaatgcctattggttactccgcatattctcatctgatttctcatatatagatattaatttcctttcatgggaggccttcattacatttcagcggcggttgcggatgtgattggcggttgag

SEQ ID NO: 105499 - DNA, 285 bp, Triticum aestivum
  Clone ID: PAT_TA_105499
atctaactaattccttgcatgccatcaccacacaatccactagaggtagactaagccatactggaaacgagcttctgattttccagtttattttgtttcagagtttgcagtatttccccacttgatcatgtatacttctctttttaatgtatctatggtcctccttatacaaagaagttattctttgtaggtgaggtgaagtcttctttcttttttggctaaaaacgttcattgtagaaaaggggagggatgcctaatgaatgtgttaagtgagatgtggagtaa

SEQ ID NO: 105500 - DNA, 304 bp, Triticum aestivum
  Clone ID: PAT_TA_105500
ccttcccccctcccctcccctcccctccgagcgagctcccgagcagcagcggcggccggcctcccttccacctcctctcctccgttcgtccgccccatgcccctgccgtgtgcgccacgccggcggccgcgcgcccgccgctccatgtttcgcgccgctgcccgcccccgccccctcgggggcgccgccagctccacctccgctacggcatgccgctgcaccgcgggctccttacccgcggcatcggcatcggcgtgggactggacccgctggagctggcacttcgcggaggtggaccaggccg

SEQ ID NO: 105501 - DNA, 388 bp, Triticum aestivum
  Clone ID: PAT_TA_105501
ccgccgcgctcaggttctccggcccggtggggggtggagagatgctggcgccgctcatggaggggcccgatccggagtccggcgacggcgtcggcgccggcgccaggagggagggctggggccgctgggtgcgcggccagctcgcgcgcacgccgtcctccgtcgccgccgcggcggccggcgccggcgccgcccgcaacgaccggcgcctcctcctcggcgtcatgggcgcgccgctcgcgcccgtgcacgtctgcgccgccgagccgctcccgcacctcagcattaaggacacccccatcgagacctcgtcggcgcagtacattctgcagcagtacctggcggcctccggtgggcacaagctcctcgcctccgtgcgcaactccta

SEQ ID NO: 105502 - DNA, 498 bp, Triticum aestivum
  Clone ID: PAT_TA_105502
caataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagt

SEQ ID NO: 105503 - DNA, 369 bp, Triticum aestivum
  Clone ID: PAT_TA_105503
aagcagctggtccggatccgatgcaggctctggcacgcccatggctctgcttccgccatcggccggaggaacgcagacggaatatgccgtcgccatcgcacattcttcctcctccgctaccggtcctctgcccctcccctcttctccccacgggatagccaagggcccaccttgtgctcagggatgggaaaaagatggaggggccgccggcaggtgtggatgaggagatccaccacaaacaacctgaggttattcgcctgtccatgctgctattatagaggcggacgccgtggccgctgtttcctctgcacacgcattggccatcccagaatgtgaccctatgcgtggtggtggggtatgatatgatca

SEQ ID NO: 105504 - DNA, 352 bp, Triticum aestivum
  Clone ID: PAT_TA_105504
tgtgtagttggtcactgtatgttccagtggatagggtttggccggtttgtacctattgaaaagagcagggcagatttagcacggctaattagtttcacaaaatgccttcttatgcaacagaaaatgccttcttgtgcaacacaaattctttactaatctcttaagaacaaaattctttagggtagtctgtgttttacccacaaaagaaaaagtgtgttatgtaagaggcgaaccctgtggtaactgtctgtaacgggccagcatcgtttgaacagataaaatggtgtaacactacataactcgttgtcagatctagtgtcaagaacgctcttatattatgggatggagggag

SEQ ID NO: 105505 - DNA, 464 bp, Triticum aestivum
  Clone ID: PAT_TA_105505
tctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaggccttcagcctcttcgacaaggacggagatggttgcatcaccaccaaggagctgggaacagttatgcgttcgctggggcagaacccaacggaggctgagctccaggacatgatcaatgaagtcgatgctgatggcaacggcaccattgacttcccagagttcctcaacctgatggcccgcaagatgaaggacactgactcagaggaggagctcaaggaggccttcagggtgttcgacaaggaccaaaacggtttcatctctgctgctgagctccgccatgtcatgacgaacctcggtgagaagctcaccgac

SEQ ID NO: 105506 - DNA, 498 bp, Triticum aestivum
  Clone ID: PAT_TA_105506
aatttccaagtacgtagatttcatggcgggagcgctcgagccttttaccggagatgctccgccgccccagagccggcctctcaccccttcttcttgcccccgtctttccccgccggagcccgcatggcgccgacccatactcagcatgtccaggcgcgcccgcgtcttcttcgcccgcaggccgggctgcctcctcgtgcccagccaatgaagaccgcagcagccgcgcctgcggcggtgaagctgtaccgcggcgtgcggcagcggcacgggtgcaagtgggtggcggagatccggctgccgcgcaaccagaccaggctctggctcggaaccttcgacaccgccgaggaggctgctcatgcttacgaccaggccgcctgccgcctccacggggacgccgcgcggctcaacttcccggacaaggccgcctcgtcgcggccccccctcaacgctgccgttgatgccaagctccaggtcatctcccgcaccatcgccgcg

SEQ ID NO: 105507 - DNA, 449 bp, Triticum aestivum
  Clone ID: PAT_TA_105507
ggtagggaggataaggcaacatggaaggcaaactacttcaccaagatcgtccaacttttggacgactacccgaagtgcttcattgtgggggcagacaatgtcggctccaagcagatgcagcagatccgtatgagtctgagaggaacagctgttgtgctcatgggaaagaacaccatgatgcgtaaagctatccgtggtcatctggaacgtaacccagctctggaaaagcttttggctcacatcaagggaaacgtgggcttcgtcttcacccgcggagacttggttgatgtccgtgacaagctgcttgaaaacaaagtgaaggctcccgctcgtgctggtgccattgctccctgccctgtcatcattccggcccagaacaccggtcttggtcctgagaagacctctttcttccaggctctgtccatccccaccaagatttccaagggtac

SEQ ID NO: 105508 - DNA, 315 bp, Triticum aestivum
  Clone ID: PAT_TA_105508
cgcgctcacgtaaggtgcgggctccgtcttcagtcccacacccaccaccgcagggccccgcccgcttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgttggtaacgtcctcccgctccgctacgtgcctgagggaggcg

SEQ ID NO: 105509 - DNA, 527 bp, Triticum aestivum
  Clone ID: PAT_TA_105509
cacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatgtctacgttgatggagtgctcatacgatactgagc

SEQ ID NO: 105510 - DNA, 576 bp, Triticum aestivum
  Clone ID: PAT_TA_105510
gttcgctgacgccgcctccttggtctttcctctcctcccttcccctccgccgcgatcgaccccaaaagcacgaaaccctagccctagcccaacccatcttctccatggccaacagcaacctcccccgccgcatcatcaagctcctggcatcagtgcttcaccatcagaggagaacatgcgctacttcaatgtcatgatccttggcccaactcaggcgccatatgaaggaggagtattcaaacttgagttgtttttacctgaagaatatccaatggctccgccaaaggttcgctttctcacaaaaatttaccatccaaacattgacaagcttgggaggatatgccttgatatcttaaaggacaagtggagtcctgcccttcagatccgaacagttcttttgagcattcaagcactcctcagcgctccaaatcctgacgatccgcttgctgacaatgtggcaaagcactggaaggccaacgagacagaagctgtggaaacagccaaagagtggacccgtgtctacgctaatgatgcatgagctctgcatgctatgactgattgctcagtagtcttggc

SEQ ID NO: 105511 - DNA, 189 bp, Triticum aestivum
  Clone ID: PAT_TA_105511
tacagtggaacatcctattgatgcagatttgctgatgggggtgttcgacggtggccccctggagactcggacgatgagcagggtggggtgcctcgactacacggcgaccccgtgggaggagaccaagccgggcgtgctggagcggcacgccagctacaagttcaaccgctacatgtccatcttcggcgg

SEQ ID NO: 105512 - DNA, 264 bp, Triticum aestivum
  unsure (1)..(264): unsure at all n locations
  Clone ID: PAT_TA_105512
gtgctcgttgcatgtgggtggcgccactcggtcagtgtgtcgtcgtctggtggcctgtacacgtacgggtggagcaagtatggccagctaggccatggtgatttcgaagaccatctggttccacgcaagatcgaggccgtgaggacgtttccatttctcaaattgcaggtgggtggaggcatacaatggctgtcncttcagatgggaaactctacggatgggggtggaacaagtttggccaagttggtgttggagatgatgtgg

SEQ ID NO: 105513 - DNA, 543 bp, Triticum aestivum
  Clone ID: PAT_TA_105513
gctgcctttgtggcacccgtccactcgtcaagctcccacgctgagcctgagcgcatggagagtagcaggtcgttgcggcacctcgccgagtacgatgacttcttcttcgggtggctcgacgacagcgcacggcactcgccgccgtccttggaccacctcgtccacggcgtcggtcattccttccaaatctcaacgtcgtcctccttcatcgacttgtacccccgcgacgatctcttctccatcgacttaaccacggcggcgagtgacttcgacttcgacctgccggtagtagacgatgccgcgccgtccccgatgatgccgcagatcagcgcgagccgcctcctcccctgcgagcccggaggcggctccggcgcgcaagaagacggcgacgagtcggtgtcggtgatcaccagtcggtatcatcactctgcggacgccccgagcgcgccgtggttgtcagccttctcgtcgccggtctcccactcggcgcggagcacgctagtctcgctgagtgcgtgctccatcgcgacgagcaagcacgcc

SEQ ID NO: 105514 - DNA, 286 bp, Triticum aestivum
  Clone ID: PAT_TA_105514
gcatgaacgcgctgttacccatgcaggccaccaccttcgccctcgtcctcgatggcaacgacctcgtcggccgcgcgcgcaccggacagggcaaaacgctggcttttgttctacccatattggaatcgttggttaatgggccacacaaggcaacgagaatgactgattacggaaggcctccaagtgttttggctctgctaccaaccacagagctggccaatcacgtgcatgcaaacttcgagttttatggtggaacgttcgggctttctacatgctgtgcttatgg

SEQ ID NO: 105515 - DNA, 545 bp, Triticum aestivum
  Clone ID: PAT_TA_105515
caacaaccccacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcaacaacaacaacaacaacaaggcatgcatatctttctgccactatctcagcagcaacaggtgggtcaaggttctctagtccaaggccagggcatcatccaaccacaacaaccagctcaattggaggcgatcagatcattggtattgcaaactcttccatccatgtgcaacgtgtatgtcccaccagagtgctccatcatg

SEQ ID NO: 105516 - DNA, 629 bp, Triticum aestivum
  Clone ID: PAT_TA_105516
tctaccgcaacaaccaccattttcacagcaacaacaaccagttttacctccacaacaatcaccttttccacaacaacaacaacaacaccaacagctggtgcaacaacaaatccctgttgttcagccatccattttgcagcagctaaacccatgcaaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgccattcggcgttggcaccggagttggtgcctactgat

SEQ ID NO: 105517 - DNA, 313 bp, Triticum aestivum
  Clone ID: PAT_TA_105517
ctccatcctgacaatccttgcggatggcaataaccatcggcaccgccaatatccaagtagaccctagcgggcaagtacaatggctacaacaacgactagtcccccaactgcaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccactacaacgatgtccccagcaaccacaaca

SEQ ID NO: 105518 - DNA, 351 bp, Triticum aestivum
  Clone ID: PAT_TA_105518
tccacacccaccatctcctctccccacgaaacgcctctccagcgctcccgaagccaaaagcgagacggcggcgccgctattggaggagggggagaatggagcgacggaggatgaggcgcggggggcgcaagaaggggcggagggatacgtggagagcgttggcgccggggaccccgcgggccctccggcccatcacctcgcggtccgcgctggtcttggggacccggtgttcttcctcctgactttcgtcgccgtcacgacatccgttgccttcatcagcatggtagcggtggcgattcctaccatgctcgctatgaggagagctgcaaattcatttgctctgctggctga

SEQ ID NO: 105519 - DNA, 590 bp, Triticum aestivum
  Clone ID: PAT_TA_105519
tattcgactcaatgtgcacaggaggatccatcattatcaaatgaagattgcctgggtatctctgcgccgcaatacttccttgaggatatccttgcggagcgtctcacaatgttgcagtggtcccaaatctatgtccacccaatcaagcaaaggccacatggacccgcccctttatttatcctcgatcgacgcagagccgcttcatcgttaccgtcaaggtggttatcatccaattatactcggagaattcttgcactctggcagatataaggtgttacataaactaggatggggtggttactcaaccgtttggctggcgagggatcaaagggatgaagtttatgttgctatcaagatcggcgttgccgaagcctatgataaagtgatacgagagcttcaggtcatgaaaaggctggtgacatgttatcctcgtccaaaacatatggtgctcatgcttgaccactttcatctgaaggggccaaatggaaggcacaactgcctagtctttgagcttttgggccccaatatccctgatatcattggtgcacacttcccccatggaaggctcccagggaaacttgccaaagtga

SEQ ID NO: 105520 - DNA, 519 bp, Triticum aestivum
  Clone ID: PAT_TA_105520
acaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatgggggggcccaaccccaacaaacattcccccatcaaccacaacaagcatttgcccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaaccatttc

SEQ ID NO: 105521 - DNA, 334 bp, Triticum aestivum
  Clone ID: PAT_TA_105521
agaagaacttttgcagttgcggaaggagggacgaagaaatgagtatgaacgccacaaacttcaagcacttactcagaggcaaaaattggttcttcaaaggaagactgaagaagctgccatggctaccaaaaggctgaaagagatacttgaagctcggaaatcttcagggcgtgataattcagctggcatgaatggcacttctcctggctctcatatgagtgagaaatcgttgcaaaagtggctagatcaagagttagaagtcatggttcatgtccacgaagtccgaaacgaatacgaaaaacagtctcaattgcgtgctttacttggcgaggag

SEQ ID NO: 105522 - DNA, 246 bp, Triticum aestivum
  unsure (1)..(246): unsure at all n locations
  Clone ID: PAT_TA_105522
ccatcgatccccaaaccgtctcccgtccttccccgtgcggcggcggcggcggcgccggcgcacgaggtgagaaagatgccgagggctgtcaggatccgcggcgacgagccggagacggagcggagagcgaagaggcgaaacgtggcaggggaggaggaggaggaggaagggacagctctccgcgggggagccctanatctcccggcgaccgcgtggatcggaggaggaggaggaggaggaggagga

SEQ ID NO: 105523 - DNA, 629 bp, Triticum aestivum
  Clone ID: PAT_TA_105523
gaggtcgatgcccatgtaaagtcactggaaaactttatgtaaacggaaagcgaaaacggcaaaggaagctgaagcactaataatgaagtgggttcagcaacttatcaataaagcagttgataatctagaacgctacataaaaggaacatcacaagattccaggggttgtagctacaatactggtgtgaccggcaaacttaagggaagaaaggaggcgtccacatcaaaggagatgtcagaagctgttattgccgtcttcaccgttggatcagtgatcctagcttgccctgatgctagtgtgcaaggcatcattcctttgctgcacacagtcataacctctggaaaccccgagccaagaccaacaatgcttgcaggtggagccgtttctttcaatgaggtagctccatcattatatatacagtcgtgggatacaatggcgaaaatatgccttgtagatgacaaactagcaaaacgatatattccgctctttgttcaggagcttgagcggagtgatttggctaccctccggaataacatcatgatagcaatggctgacttttatgtacgctatacagcactagttgactgttatatgtcaaaaataacaaaagtgctgcgtgatccctgcg

SEQ ID NO: 105524 - DNA, 384 bp, Triticum aestivum
  Clone ID: PAT_TA_105524
gactgggataggcgttttagtttgccacatattacagatgtctttgatttagagccaaggctcactactttttcactgaagaaaaacagaactccccgtggcgctagcgatgcttcatcacctgacaagtggaatggctatgtaaataaggatgatagagcacttctgaaggtgagtgactatgcctctaatacttctgctggagccgagtgcattgatcctgattgtagctgggtggaacattgggtgcatcgtgcggggcctcgtaaggaaatatactacgagccagaggaagtaaaagcagccattgttacctgtggagggctctgccccgggttaaatgatgttattagacagatagtatttaccctggagatctatggg

SEQ ID NO: 105525 - DNA, 387 bp, Triticum aestivum
  Clone ID: PAT_TA_105525
ccttctccaaagccagtggaacgtgcggtgtccatgccgccgtctcaaaaaccggtcgaacgtgcggtgtccatgccgccgtctccgaaaccggttgaccgtgtggtgtccatgccgccgtctcaaaaaccaaccgggcatgtggtgtccgttccgccggctccaaaaccgggggagcgtgtggtgtccatgccgccgtctcaaaaaccggccgggcaggtggtgtccatgccgccgccggctccaaaaccagttgaacgtgtggtgtccatgccgccgccggctccaaaaccagttgaacgtgtggtgtccatgccgtcgtctcagaaaccggccgggcaggtggtgtccatgccgccgcctacaccaaaaccagtaaaacgtgtg

SEQ ID NO: 105526 - DNA, 297 bp, Triticum aestivum
  Clone ID: PAT_TA_105526
ctgactccaacgcagagctgtgatggctgtgttcaagtacaacttcgttcctttcgaggatcatccccttcctgtacaacggctggttcgtgcgccagctcaacgccgacgactgcgcggcatatgcattgcagcttccacttttcatcaattgtgtcttatttttaagccgggaggggtggcggcgtgcttgcttgcgtaataattctgggaggagaagtggggacataagcccaagtgagctgctacatgagcacaaccacatgtaggggatgggcattgacaaattgtgtgaca

SEQ ID NO: 105527 - DNA, 324 bp, Triticum aestivum
  Clone ID: PAT_TA_105527
atggtgttgaaatttgtgttttagcgaaactagtcaagaatggacaagagatggacagataaaggtagacacacacaaacatatattgatggggtaaaggaattaataaagtttgcttttacccattcagcaaaaatgcgacctcaagcaagctgatgaggtaatgtaaatgtggctcttggttattgctatgttatactctctctgttcatagatataagatgttctgggtatttcaatatggaccacgtacgggctaaaatgagtgaacaaacacactaaagtgtgtctatatatacctgattgacaaaaaaagttgaaaca

SEQ ID NO: 105528 - DNA, 375 bp, Triticum aestivum
  unsure (1)..(375): unsure at all n locations
  Clone ID: PAT_TA_105528
ggggtgccttcaagaaaagagcgattagtgccggaaataaatttaggcgctccttgaagaggaagagcaaaaagaagagcggcgatctagcctcaatagaggatataagggatgtgcaagagttggaaactgttgaaagattccgccgatgcttgcttgatgggggcttgttgccanaacgtggtgacgattatcacacaatgttaaggtgcctgaaagcaagaaagtttgatattgagaaagcaaagcatatgtggtcagaaatgcttanatggaggaatgcgtatggggtcgacaatatagaggaatttgactacactgaattaaatgaagttaagaagtattatccacaattttaccatggagtggataaag

SEQ ID NO: 105529 - DNA, 392 bp, Triticum aestivum
  Clone ID: PAT_TA_105529
aggcggcgtacgcgaaccggggatgcccgctcaccggcgagctgcacgagcatgacaaggcgtggtacgccgcggccgggaagcggcttctgctccacacggagggtgacttcaggttcttggacaaggcggcgatccgtgagcgtgaggcgtgcacggtgaccgaggtcgaggaggtgaagctgatcgccggcatgatcgtggtgtggctggtgtaccctggtgccatgcaccatctgggcgcaggtgaacaccctgttcgtgaagcaagggacgacgctggaccgctccgtcggcggcgtgcgcatcccggccgcgtccctcggcagcttcgtcaccatctccatgctcatctcgatcccgatctacaaccgcgtgctggtgcccctggc

SEQ ID NO: 105530 - DNA, 444 bp, Triticum aestivum
  Clone ID: PAT_TA_105530
tgggtttcacggtaagatcgtctattggtggattccgtctggattggagcagtgcaacaggaacagtatcgggggtggtagtggtccaggacatggggacggggagaggagagatagctgtgagcacgaggtccttgccggctgaatcgaatcaaagcactccgtccatctctattggccttggacgaacaaggcaataaggtacaggacgaacatgaagatataaggatgggagatcaacatattgttgttttctctggttaatgtgaagttccggtctatctaaaaagcagctaatgtctagcaatctgcagcaagaactctatccactcatctggtccaacttacacccatggaattctccatccacatctctctgttcgtgaaagcaactgctaaatttgtatgaccttatgagaaatcgacggaggcagtgcgtgagct

SEQ ID NO: 105531 - DNA, 532 bp, Triticum aestivum
  Clone ID: PAT_TA_105531
agtcgcagttaaagtaagacatcctggtgtaggagactcaatacggagagatttcagtataattaatgctgtagctaaagcttcaagatatattctagatgagagtgtgcaacagtttgctgtcttcatgatgtctcaagttgaccttgcaagggaagctgctcatttgagccggtttatctacaacttccgcaggtggaaagatgtgtcattttcgaaacctctttatccatttgttcatcctgctgtcttggtcgagacttacgagcttggggagagcggctcacactatgtggatgaccacgatggagaggaacgagttaaaagtgctcttgcacatattggcactcatgcactcttgaaaatgctactgttagcagaatcgtctctgcagcagagaattaattgagaatatatggtttacgaaaactgaacaattgacgccgccgccaccaccgatccccgcggatgcctcagccgtcgccggaccccaatggacgacgttgacgccgccgccgccaccgatccccgc

SEQ ID NO: 105532 - DNA, 290 bp, Triticum aestivum
  Clone ID: PAT_TA_105532
cccctcaccaccgacgacatcaaggcagtcatcgtcgacatcttcatagcgagcagcgagacgtcggcgacggcgctgcagtgggccatggcggagctgatgaggaacccgagggtgatgcgcaaggcgcaggaggaggtccggcgagctctcgacgggcgcgacagggtcacggaggagagcctggcgggcctgcgctacctggacctcgtcatcaaggaggtgctccggctgcacccgccggcgccgatgctgctcccccgcgagtgccgggccccgtgccgggtcct

SEQ ID NO: 105533 - DNA, 408 bp, Triticum aestivum
  Clone ID: PAT_TA_105533
tccgccacgatgtacggccagatttggcgcctcgtcccctacgcctgctcgccgctcccgccgatccgcgccgctccgcaggccggcgctcgcctccgcctccacctccacccgaggcctatgccgccccctcgccgtctccgcccagtcggccagcctcgacgccggtttgaggttcgttctttgctgaatttcgtgtaggagagcatcgaagttatcgcccgtgctccgtggcgagtcggatgcaaactggaatggggatttaaccaatttctgctgagcatgtgggacatgtttacggtgcttccatctttgccatctttagctacaaactatgcctgtcaagtagcttcagacatcagtggtttgtagaaagcaagaaagaggtgtcagtggctttactaatga

SEQ ID NO: 105534 - DNA, 493 bp, Triticum aestivum
  Clone ID: PAT_TA_105534
tccccacgccatcaacggctccggtgaccgccgccacggcgacaaagccgtacagttgcgcggctgccgcttcccgttccactctcctcacaccgtcaacggccccggctccggcgaccgacgccaccacggcgatgccgtatggttccgcggcgtgcagtgcagacgtggggcgtcccatctgttcttcgcggtggaggcctaccggcggggaagaagggcacactgtcgcggtggacgactcgcgactgtggttggtggcggaggacaaaatccaccccatcttctagacccttcactaccgaggcatccagggagtccagagcgtgctcgacgcagtccgaactacttccagtggatgagtatgagctgccctcttcgtggcatgctggatctgggactatggtgacagactcttcattcagataatgtgaggctcatgaaggttgatttcttgctgcaaacaagtcgaggaggtagctcttgttgtccc

SEQ ID NO: 105535 - DNA, 388 bp, Triticum aestivum
  Clone ID: PAT_TA_105535
actcaaataatagcatatcaaaccttccgattcagccctcgatgacccttgatccatcccttgaaattgaggacatgttcttccgcatgcttcatgcatggactgcctgcatcatcattgtttcatccgcataatcctccttgccggatgtctcagcgtagtgcttgtccatgtactcccatgtccgaatccattccttcaaaggaggaggaacaaatttagcacgggcatttcaccaaacacttgcccgcgtggtgaccaccgtggggcggatggtacctgcgcggcagacgtgcgagaggtgtggaccggcggcacaggacaagcggcgtggcgaccggttgtagcgctggaggtccgggaaggcttggcgggcggccggggtggt

SEQ ID NO: 105536 - DNA, 139 bp, Triticum aestivum
  Clone ID: PAT_TA_105536
accagcagtcgcccgctgccggcctctgcccggctccgcccgtctccacgcgccgacggcctccgcccgcatccggctctgcccgtctacacgcgccgccgtctacgcccgcatacagttctgtgcctgtattcgcgcg

SEQ ID NO: 105537 - DNA, 335 bp, Triticum aestivum
  unsure (1)..(335): unsure at all n locations
  Clone ID: PAT_TA_105537
cctggtcctccattccttgacaatgcagcttcttcagtggcaacttccttgcgccgttgtgcgaatgataaacttcctgtatctgacaatagggataccacagtatctagatggagaaaacattgtcctaccccaatcgaaaatgacaatatctttgagattgaaacgcactgcaaggatccanaactgtgttcaactcttgcttgtgacatttacaaacacttgcgtgaagctgaggccaagaaaaggccttcaccagattttctggaaaccactcagaaggatattgacacaagcatgagggcagtacttatagactggcttgtggaagtcac

SEQ ID NO: 105538 - DNA, 384 bp, Triticum aestivum
  Clone ID: PAT_TA_105538
aatagtaacaaagcattttttattctctataatagtttttattacgattcacatattttatcttcgtagattctagaagttcttaagcttactatgaaaaaacggaagtttcttttataaggttcagtagctgcttcatgttgtactgattagtttccattaatttgaaaaaaattagctcacgttgctctctttagctgccatttgcacttgaaggtcaggatcgaggcaggaggtgaggaagtggggatcaggctgtaagctagggttaagaaggcagtttttattttctataatatggttttattacgattcacatatttttatctttgtaaattctacaagttcttaagctcactatgaaaaaacagaagtttcttttat

SEQ ID NO: 105539 - DNA, 543 bp, Triticum aestivum
  unsure (1)..(543): unsure at all n locations
  Clone ID: PAT_TA_105539
cgcattccagttcctccgttgccggccaccggaaagcgccttcctcagatccgcttctcccctaaaacttctcaactttgtgttgcacccgtcctcaatgatggttgtagaggagggggcagggaagtagatggcgtggccgtcggccggagacagagcagggtgctgccaacgggagaggcgcccctccctgcttcttggcgagcgtggccacttcttccaggcccgctacttcgtcgaggatgacgagatcaacatctacaagacatggctgttgaggaggctcgtgcagcgcgtggggtgatgggagcgggaagaaaagaaagagcggcggcggcagcgaatttctccatctcacggggccagccctcctgtccgcgccgcaacaccgctgttcagttgaccgaatgtggtggcctatcgccgaccgtggcggtggtggattccctaaggtgggtaactgaggcagccacngagggaggtcactcttagttcatctgccggtttgctctgtctcctgacggcagccaatgagtgcaccat

SEQ ID NO: 105540 - DNA, 287 bp, Triticum aestivum
  unsure (1)..(287): unsure at all n locations
  Clone ID: PAT_TA_105540
gtgcatacggcggcggcagaaaccacccaccacagccgccgtattatcatggcggcggtcgtggtgggtatccttctcctcagtttggtcggggagttggtgctggtggctatagctgctacggcggtggcggtggcggctatcctcccagttcatttccgtctgaggaggaggcggcggctgtgatggtggggtcagcaacgcttacggagggccgccgcaggagaagccgcggatgagcgtcnggtgggtagccgccgggggtgctaccgcctatggagggtacc

SEQ ID NO: 105541 - DNA, 469 bp, Triticum aestivum
  Clone ID: PAT_TA_105541
cgcctcctggcctccctcgccgccgcctccgcctccacggcgctcctcttcccctccacctcctcctccaagccccgcctcccgctctccacatcccttggcttctccgcgcccgcgcggtcacgccgcgccactgcggtggcggggagctccggcaggcgcccggggctgctcgtcgtgcgcgccgccaggggcaagttcgagcggaacaagccccacgtcaacatcggcaccatcggccacgtcgaccacggcaagaccaccctcaccgccgcgctcaccatggtgctcgcctccgtcgggggcagcgcgcccaagaagtacgacgagatcgacgccgcccctgaggagcgcgcccgtggtatcaccatcaacaccgccaccgtcgagtacgagacggagacgcgccactacgcgcacgtcgactgccccggtcacgccgactacgtcaagaacatgattaccgggg

SEQ ID NO: 105542 - DNA, 565 bp, Triticum aestivum
  Clone ID: PAT_TA_105542
ctgttattcacttcacaagactgccatcaacagtggcgcagttgcagaaattggtacgcctatttgtatctaatgaaacacaattacgtacaagtgggttccggagtctacaagccttggaggagttacgcgtccacgaaactgacgacccagtgagatttgcggaggaagtaaatgagttgggcaaatgcaaccttcggtatctttatactgatgcagagatagccgaacgtctgttctgtaacccatgcctccaagttcttaaaatttggccacagattggaatggttcccaagggaatggcctccctcaagaatctcgtgaagctatccataatggtccagaaatttgataatgagggtctccaagtcctcatgggcatgccttctatggcccatcttcagctatgcgttacaggggtcatcgaagaaaagctgaccatgggtagtaatggattcaaactgctaaaggtgctgcagttcaaatatacgtcagtcttacatcctgcttttctcctggaaccaacaaatggactgcggctaatatttgaaccggatgctgtgcc

SEQ ID NO: 105543 - DNA, 413 bp, Triticum aestivum
  Clone ID: PAT_TA_105543
ccgcatcaagcaccacaccggctgcgacacccgtggaacacccaccatctcctcctcctctcattgccctacctcgcagccagtgtcgcatgtccgtagtcctcacccccagcagccgccagattggttcaccatcccgccgcaccagccataggcgttgttgttgccagccaccaccccaatctgctgcatattggtaggcacaaccgtctccctttggttgagtccttcagcggtccgcctaccttgacacagccacccgctgggcgagcgagatcgtcatgactctttggatcggaggcatgcggtattggatggaggatatataactacatctacagttggttcgtgagaaagggggagcagcgccgaacaggaaaccctccccgccaccattagggagctcttggttg

SEQ ID NO: 105544 - DNA, 281 bp, Triticum aestivum
  Clone ID: PAT_TA_105544
tggttatgtatcattgaaagcgtaatataacataaagtgttatcttatagttagtagaaatattactcttcaagattactattttatcttggttgtaccatatttagtttttttgtcacttgaacatgaacactaggtttgctgttcgtcaatattctttttatgctcttgttgattttgtttttgcatcattttgctctgttgtgattaattttgcagtatttactctaaagtttgccaaatgtagttttaactgattatacttttttattcctgccttg

SEQ ID NO: 105545 - DNA, 426 bp, Triticum aestivum
  Clone ID: PAT_TA_105545
ctctgccttccctctcgtgctcgccgccgcctcccctcgccgatccgggggagacgaagccctctcgctctcgagggatccccgtctctgctcgccaatccgctcgttcttgtgctaatttttgcccgatcgatccatcgatccgcgtttacttctgcagttccgcgccgccttttcttgttgcgattactgttatttgtttgcctgttctttttcttctgttctaaccatggatgcaggctcccgctcgatctcttccggcaagagccgcgccgccgtgcagcggccgccgctccaggaggccggatcccgcccctacatgccgccgctgagcacgcgcaacccgtcggccaagtgctacggggacaggttcatcccggatcggtcggcgatggacatggacgtggcttactacctgctcacgga

SEQ ID NO: 105546 - DNA, 205 bp, Triticum aestivum
  Clone ID: PAT_TA_105546
cgcggtcgttattagcatccgcccaactcgcttaacgcgcaagtggtggtggtggtgaggcgtacactgaccgaagcatagatctccatggtgcccgtaccggcgcctccccatccacgggcgccgtcccctcgccgatcgcgagcgacctcaggaaggccgcgcgctccggcgggctcgggctgcccacgctgccgccgctgcc

SEQ ID NO: 105547 - DNA, 340 bp, Triticum aestivum
  unsure (1)..(340): unsure at all n locations
  Clone ID: PAT_TA_105547
ttgctaaaaaggcccacaatcctcaatacacttgcttgcctattattcacacaacaagaataaggtacctcctgttagggtccaaatatgatgagttgatcaggatccaagctctcttgacagcatatggtgtaattntagtgtgaaagaatctagtcacaatccctttgtatcaaacagccaatatataatgcaaattaagtcgattctggatgttgacttcaaaagctttgtgctttcgttacttgtgctttttatgcttgttcgtaagcaatttatgttgccttctgggtgcatgactcattttgggtgcatgcatgtgatgtcgataaaatgaatc

SEQ ID NO: 105548 - DNA, 537 bp, Triticum aestivum
  unsure (1)..(537): unsure at all n locations
  Clone ID: PAT_TA_105548
cgtactgaacacccatgccccgatgccgctgcgcctgccagccgctgccccgccgaagtgcatccacacgacccccgcgtggcacaccaggttgcaccccagcagccagccccagctgacaggcgagcgccactggcgccgacccgctccgggcggcgcgcgccacagggagccccgcgttgttcagtcagaaccggaacctgaaggtgacggcgtgggccancgtggaggccangatgtccagctcctggaacgactacgagaactccagccaaaggaacgccatggccacggacgccgcgtgcccgaacacctgggcggccgccccgcgacggcgccgcaacccatatccacgcagcagaagccccaacgtcatggacgatctgtgcaagaggctggtcatggcgccggacatcgatcccgcagctcggcaaaaggcggccatggatcaggaggcgcgcgtgcgcagtgcantatgggcggcacggaacgaggagatcgagcgccacggacgacccgtgatgtaccattgctggc

SEQ ID NO: 105549 - DNA, 343 bp, Triticum aestivum
  Clone ID: PAT_TA_105549
tccgcttcagtcagctgacatgcctgccctcgccaagcccgctgcccgccccgccaagcccgccgccgcggcgccgaagccgaagcccgccgccgccaagcccaagcggccgccgctggagccgcccacccgacctactttgagatgatcaaggaggcgatcgcggcgctcaaggacaggaccgggtcgagctcggtcgccatcgccaagtacatcgaggagaagcacggcaaggctctcccgcccaacttcaagaagatgctctccgtccagctccgcgcttccgccgccaagggcaagctcgtcaaggtcaaggcctcctacaagctctccgacgccgcca

SEQ ID NO: 105550 - DNA, 394 bp, Triticum aestivum
  Clone ID: PAT_TA_105550
gtgcaggtggtaaagtcctgcttcgtaacgccggctgcggacacgccgaggaaaacactatggctctcggcactcgacctcatgctagccaacaaaggctacaccccgcttgttcatttctaccgtcgatgtcccggcaccgaaaccaccgacttgttcaacgggaccaagttgaagacagcgctaggcatggcccttgtgggcttctaccatggccagccacctcagggtggacgccgacggcaggttaaagatcggttgcaacagcaagggcatgctttcctcctggctcgttcccaactcaccatcgacgactttagcaatttgaagccatcaccaaggctgaggaggttgtttgttccccaaatactcccagctgaggtgtgtgccaccc

SEQ ID NO: 105551 - DNA, 146 bp, Triticum aestivum
  Clone ID: PAT_TA_105551
ttgcggggctcaagtcggtggacggagctcacgaggactcgatctgggcggccgcgtgggtgcccgctgttgaccaccgccccacggcgctgcttctcaccggctccatcgacgagaccgtccgcgcctggcaacccgacgacctc

SEQ ID NO: 105552 - DNA, 365 bp, Triticum aestivum
  Clone ID: PAT_TA_105552
aactttccatggtatgtcaagcacgcatttcaactcctaatgctcaattaggcctcacggagcttcagtttggagtaatacctggatttggaggaacacagcgcctgccccgccttgtgggactgacaaaagcacttgaaatgatgatgctctcgaagccaattaatgccgaagaagcccatgagctgggtctggtggacgctgttgtttcacctaatgatttgttgaatgatgcccgccgttgggctttggacatctgtgagtcgaaaaggccatgggtccgagccctctacaaaaccgacaagcttgaatcccctgaggtggccagagagatcctcaattctgccagagttctgtctcgtaag

SEQ ID NO: 105553 - DNA, 253 bp, Triticum aestivum
  Clone ID: PAT_TA_105553
ggagagcagctcgtcgtctcctgcaatccaccggcggcgcgcatggccgccttgctccacgtagcggctctccagccccctcaccccaccccaaaaacccatcatccatggacgcacagccgggccaccacgtccatcctctcggcacctgaggcagccccgtcgaagcgacgacgagccccagctcggcggctacacgcggccggcaacggcagcggcgtcggcacgccagccacggacagcacaagcaaca

SEQ ID NO: 105554 - DNA, 319 bp, Triticum aestivum
  Clone ID: PAT_TA_105554
ctttctcgcgctccttgttcactcatctcccttgccttggctttcccttcgacgcttcgagagagagagagagagagagagagagagagagagagaaggaaggaagaagatggcggacgaggggaccgccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcatgcaggaggggctcctctgcctctgccgc

SEQ ID NO: 105555 - DNA, 278 bp, Triticum aestivum
  Clone ID: PAT_TA_105555
gttaaacatccatgcccgcgctgagacttcccctggaaatcaagattcaagaaccatctccatcaatggatgacgcgggaggggacattctcccgtctctcggccgcgtgcgcctcggcgatctcgcggccgtcgagggcctcgcttccgacagcgacaagatatgcgtatcgacactgatgcagtcgctggctcagtactcggcagccatcatccagctgcctccggccgatgctgccctcttaaggtctggtctggactccgctcgcctcttcttc

SEQ ID NO: 105556 - DNA, 246 bp, Triticum aestivum
  Clone ID: PAT_TA_105556
agcttcatatgatttttttcctccaaggtaaccatgggatccatatttttttaggtttgtctctaatattatgtatgctcttcccattgaagtttcaatacttgggttttagagctgcacttatagacttcaattggtttgtactatatataattataaatcatgtaattattttatgtgcttcccgtacgtttcatgtattttccattttgtttttactatgacaagctcacaaagagtgtgttt

SEQ ID NO: 105557 - DNA, 247 bp, Triticum aestivum
  Clone ID: PAT_TA_105557
tacacggtggcgctcttcctcgccgtcgccctcgtggcggggccggccgtctcctacgccgcctacgcccccggcgccccggccacacccgccgccccagggacccagcccaaggcgacgactccagagcagaagctgatggaggatatcaacaatggcttcaaggcggctgtggcggccgcagccggcgtgggggcggcggacaagtacaagacatttgaggccacattcagcgcggcctctaaca

SEQ ID NO: 105558 - DNA, 437 bp, Triticum aestivum
  Clone ID: PAT_TA_105558
tcttcttcggcctcttttccctccttgctgtggtcgacggacgaccgcgagagggattgagctgggccgagaagaggatgaacgggagtagcaggagcaaggaggcgggcgagaagcgtttccttgaagattctagggtactggtgaagcaagtgagggagctgaggaggctggtgccctgctgccacgagccgtgcgggctcggcgagctgttccaggatgcggcgagccacatcgaggatttgcaggtgcaggtcaaggtcatgaggatgctgctcgacaagctctcagacgactgatccagtgatccatgcgcgtgcaaacaatggcaaatttgtggacgctctgtcgatgtatgaatggatccacagcgacaaacatactatttatttataatcccattcatttgtttgaattattattattattacttattt

SEQ ID NO: 105559 - DNA, 293 bp, Triticum aestivum
  Clone ID: PAT_TA_105559
tagcggtgttgcatggcttactcattcgaatgcataggacgaacacctaagcttttccaatggacccagaaatcatgtcatttgcctaagtacaggggtgggtggcggtggtgggtgccttatttccatgtggggcgtgttcagtgtatatccttctggtggagtattattgctagattaatagaaattccaactatcattaacaatagtatcatatatgctaattataagctcctgtagctacaaactttgctgaacaacactcgaaaaaattgaaagatggagcatgtcat

SEQ ID NO: 105560 - DNA, 192 bp, Triticum aestivum
  Clone ID: PAT_TA_105560
tctggcgactcttctgggactcagatgcatgtcttcaaagttgcccctggaggcatggccaaagtcgacaagaaacataaattgggcggctcttaagaaaaacccaaactgctgagccagagaagcaaatgtcagtaaacccagatgccacaattcaagatcatgacgatgaggcccacgatccaccaccgc

SEQ ID NO: 105561 - DNA, 276 bp, Triticum aestivum
  Clone ID: PAT_TA_105561
tgaacccctctctcttcagagtgctatccacttatgtctgatccagaatcccaatctgcatgttccaggaaggtggacaacttatttaaagatggtatggaagttctggatagcacgtctgaagtatcaccaagagaagaaatagtagaatcatatcctgttggatctgaaacaatatctaattctggagatgagttgaagctaattcatacttcaaatacatcaactgattgctccacagagcgctcttcacagaacttgtctgctcaagatact

SEQ ID NO: 105562 - DNA, 272 bp, Triticum aestivum
  Clone ID: PAT_TA_105562
tgttgatcaatccattggaagcaacggatcgaattggccaaaagatgtggatgattcaggcagtcttccgcctctgcaactgccacccaaaaaagggtttcaaggttatactgtaccgatgccagaagtagctgaactgcatggttcacattcgtgagtatcatttgatgagaaccaaagcggttgcgatgagaaaactccaaccaggccaatcccttctatctgcatttatatgcacatgtaaaatggaaggcaatggtgaaatggtcaat

SEQ ID NO: 105563 - DNA, 194 bp, Triticum aestivum
  Clone ID: PAT_TA_105563
ccctgtcagcggccgccgccactccacctccttctctgtcaccggcggccagctcatcccactgcctcgtgctcgccgctgaccatggatccaccatggacggagggtgtcaagaggggaaggaagtcttcggcttcgcaggcagcgctggcggacgagcacactcgcatgtcctcttcctgggcgagccaact

SEQ ID NO: 105564 - DNA, 339 bp, Triticum aestivum
  Clone ID: PAT_TA_105564
agcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtcc

SEQ ID NO: 105565 - DNA, 261 bp, Triticum aestivum
  unsure (1)..(261): unsure at all n locations
  Clone ID: PAT_TA_105565
gcggtggctgcatgctctcggcgacggcaggtcctccagctcgaccacacgtgcctgctgctcgccgccgccgtcaattggatggtcgtggagttgggcccctttgaacctgagcggtcggtctcctccagagagtccatgggtggaggcgcgttgtgggcttgctactgctgtcancttccacctatgtaatgtgctacaactttgcatcattactactttctgcacaccggctgattcatcacagggaattgaagccca

SEQ ID NO: 105566 - DNA, 186 bp, Triticum aestivum
  Clone ID: PAT_TA_105566
acatgacatggtttcagttcggcattttcagagtaactagattaaatcaaattccaatacctcttaatccacccaggtgcccattgatccggcttcatcgcagattctcaggacgccgcaggcactctgtccctgctgtttgggtcgtctgcggcggccgcgccaccattgccatgcgccccgcca

SEQ ID NO: 105567 - DNA, 540 bp, Triticum aestivum
  Clone ID: PAT_TA_105567
accacggcaacgccgtctccctcctccgtcctaacgcgacgagcgggaaccagaacaacatgctcatcctgcaggagacgtgcaccgacgcgtccggctcgctggtggtgtacgcgccggtggacgtgcagtccatgcacgtcgtcatgggcggcggcgactcggcctacgtctccctgctgccctccggcttcgccatcctccccgacggccacactgcgccggccgccgctactgacccttctccccagggctcgtcgcccaacgctcatggcggcagcagcaacaacagccccggctcgctcgtcaccgtggcgttccagatactggtgaacaacctgccgacggcgaagctcaccgtggagtcggtcgacaccgtcagcaacctgctctcctgcaccatccagaagatcaagtccgccctgcaggccagcatcatctcgccctagctccatggctagcgggcatttgacatggattccggccaacacaccgatacagcgccagccggatgcatttcaaatgtctaactagctcgat

SEQ ID NO: 105568 - DNA, 290 bp, Triticum aestivum
  Clone ID: PAT_TA_105568
cgaacaatagatatccatccatttctctgcctcatctcagaacatcatcatcctaggcacaagcacaaacttggtgagaagaagaagcatgagcaatggcagcccccccacatcctcctccccttcggtctgctcgaggtcttggtccataagtgaggattctttgaggaggtacgtgagctacgctagcgagagctgcatccaggagctgctcgcggcgtcggactccggtggcgctggacggggcggggaaggaagtggaggaggcggcgaggaggatgacgggtggc

SEQ ID NO: 105569 - DNA, 369 bp, Triticum aestivum
  Clone ID: PAT_TA_105569
caagtgaagatggttctcctcaagcagagcgagatctggcatgatggcgcgcctccaggcgccgcatctgcggcggatatgcagaagtacagggacatgtacaagaagccattacctgacaagttcattgcggcggtcgaagctctgatcgatggctccacgcagggcaagggcaaggagatcagcaagacagggcagacgatttgtgcctgatttggctctggttggttgctagtgtgggtctttcagtttctctatgttagcaggcctttcgtctctagagtatgggtgctgggtcgcgtcgaagagtgagtgtgtccccctggaacgaggtgctgctggggattgtgtgtttgtgttggctgattg

SEQ ID NO: 105570 - DNA, 159 bp, Triticum aestivum
  Clone ID: PAT_TA_105570
tttctcgggggactggatgtttagtccgagttggtgacgaactcgcgaccctgggcgcgcgcttaagtgttcgatcgattgccgaccagagccacgcacctttcagccatttctgatctgccggattgggttacaagggcgagatggtcgggagcgtgc

SEQ ID NO: 105571 - DNA, 169 bp, Triticum aestivum
  Clone ID: PAT_TA_105571
atgtatttaagggaaaattgccagtaacgattcagggcacatactcggactcaaactcaacccctatgatagtaaatgttttgagaacgctgccgccaacctacgacaacctctggagttcgatgcctccaccaaaaacgaatgttgggaaaatccaccctctacaaaa

SEQ ID NO: 105572 - DNA, 386 bp, Triticum aestivum
  Clone ID: PAT_TA_105572
ttatttgggaatttctttggtgtttttgtttctttgtttcacgagcgagcggcctcggaggattcgagcggctgggctagggttttggcatctccgtcaagggtgtcccgttccgtgtcccgcgccaggattttcagttatcatgtcatcattccctgtgctgaagaatcgacctatcgatcaatggaaagttactggggggaaggatgaacttcgaaagaggaggctccctgtaaaaggtctgaaagaagaacttgtgaggcggctctttgaatctattcagagtgaagaggcatctgacgaatctgctgaagatgttggagccaatgaaggcacacccattggcaaagacgcgaaagatgtgggggcgaacggaccggctgatc

SEQ ID NO: 105573 - DNA, 274 bp, Triticum aestivum
  Clone ID: PAT_TA_105573
cgttccctgttgccgatgtcgtcctaggtagcttggatccacatggactccccgcaaaagaagctcggatccaccatggacggcgagatgccacatctgctgcctgtgacgacggtgagtgagaccgtgcccaaggacacgctggcccctcctgcggaggctgtcgtgattgtcagcgcttacgagttctaccccgccttcgtcgtcctcctctactacgccctgcactacgccatgatctccgcacggtccatcttcttcctgctgacgcacg

SEQ ID NO: 105574 - DNA, 105 bp, Triticum aestivum
  Clone ID: PAT_TA_105574
ctgatgagggacttcaagcggctgatgcaggaccctcctgcgggcataagcggggcgccgcaggacaacaacataatgctgtggaatgctgtgatttttggccct

SEQ ID NO: 105575 - DNA, 360 bp, Triticum aestivum
  Clone ID: PAT_TA_105575
tccctccgccgcgctgtgtaggagctctgctgcagctgccaacctcccgcgaaccctgcctccgcgcccgagctgctcagccctgctttgccttgccaccgcgagcaccggatgctcaggtgagcccgcgccagccagcaacctcctgatgcccttgccccatgcttctaccactcctgcgagcaccccatctgcgaagggggcggccgtcggaggcgaccaattcatcgtgtccttttgaacgctataaaccgaggcctttttggtgttgttctggatctcgccaaggccttcttgtttttggatttcggcaagcagcatgaggaccgaggactcggagcaaccggtccttcaagtttc

SEQ ID NO: 105576 - DNA, 155 bp, Triticum aestivum
  Clone ID: PAT_TA_105576
ccaaagttttcctcacacgaaaaagccgacaagccaagagccagcaagctggcaaccgcttctggaagatgttggccttggtttcaagacccgggggaagcgatcgatggtacctacattgacaagaaatgcccattcactggaactgttgccat

SEQ ID NO: 105577 - DNA, 381 bp, Triticum aestivum
  Clone ID: PAT_TA_105577
tttgtgcttgacaacgttgtaccttggcattttcaataaaccgcatcatgtgcttccaaggatcgccgatttcgaccctgattcactccgtaaaatgctcaccatggctcttgaccccgtcaagggagctacgtcgtattcacatgccaatctaagagacgcgtcaacggtgtgttacatgcgttctaaggtacaagtgagtgcggcgtcatcatcaaccagcaagagggtgcataggtgtgcaaagacaccggttgcagtgtccatggttaacaccacaactcctgttcatgtctatacaagtcatgcatgcaacgacagcgccgcacactccaacaaggctgcacctgggccactaaaatttgcacactacttacggga

SEQ ID NO: 105578 - DNA, 328 bp, Triticum aestivum
  unsure (1)..(328): unsure at all n locations
  Clone ID: PAT_TA_105578
accggccgtgcgcaacaccccacctcctcctcctccccctcccttccccttcctcctctgcccgcctcttctctctcctccttcctcccggcggccggcgatgggcgcggacgaggaggagcaccagtaccccgtgcggaagcgcgagcgcgaagagggggaggagcccgcggccgccgacaagaagcgcgggggcgcggcggacgagtcagagggcgtttaccangagaggccgccccgaagcctctcgccgccggaaaccctcgccgcccatctccaccggagcaccggcgagaaaccgtcctcctccctggcaatggataaaatc

SEQ ID NO: 105579 - DNA, 411 bp, Triticum aestivum
  Clone ID: PAT_TA_105579
actcaatcctgggcaaactgtattcactccctggactgaatttgggcggctttgttttagctgatctgatactgtgggtgggatctatagaacaaccttgacatgtgtctgcaatcagtccacattctgcacaactcccacaacttgaacaccaatctctttgtccttcaagtaagtctacggaccccaaattgcttatttgaaagtgtagagggtagtttgcaactgaatgacttaatttgtcttgtgattgcgttatgtgtaattttaaatccactactaccaacactcgcggctgtaattgtggctcactggttttattaagaaatgctctgctaatgttttttggggaactcatgaccggtttttaaccattaaattgccccagtcatgtactttttattcttaaat

SEQ ID NO: 105580 - DNA, 489 bp, Triticum aestivum
  unsure (1)..(489): unsure at all n locations
  Clone ID: PAT_TA_105580
gatcccaatattgaagggaaggagccacagcgaactcatgggaagaactaaaaacttatctggcgcgaaaagagatatctcctcctgattgatgacatatggtctgcacaaacatgggagaatatcagaaaatgcttgccacataatgataaaaaaggcagcagagtaatagtgactacaagatttcaggctgttggtagtgctgcttgctcacgaagagcagaaattaattttcttcattcagtcgattttcttagtgatgaagagtctaaaaaattgtttgatcaaagtgtttctgaatccaacaacaacataggtagtgagaaagaactcccacctgaagatgtatggaaaatatgcaggggtctgcctttggccatagttaccatggctggtattgttgctancaaccctcgcaaatccatcaaagactggaaagaagcatgtaactcattatttccagagttgatgccttctctgaccctggat

SEQ ID NO: 105581 - DNA, 394 bp, Triticum aestivum
  Clone ID: PAT_TA_105581
tgggagacataaataattcagatatggtaccattataactgatatgactcaattatcagtacatgtgagtctcattttcctccaaaagtggtgatatcatatcttagaggagtctgaatcattacctgacttgtggttttcgtgcctcattgcactaagttcgtgtaatgttctcctatgtaaaatatttctagcgctccttgtgtgttgctatctatctccatcatttttggcgaactttcttctaccgagtgcctacatttgtggagttagtcaagtaaaattattactttacaatgatgaataaacatgagtcacgattcatttgttgataaataattaaagatagtgttccatatgtaaggaagttctcgagtttcatctatgtctaaat

SEQ ID NO: 105582 - DNA, 534 bp, Triticum aestivum
  Clone ID: PAT_TA_105582
ggctcgccttcgacgcgtactggtacgccgctgccgcctccgcacgcggcctctccggccatccgccgccactgccgcgcgccgcctctctgccatccgcctattctctttcccctccccatccgtaccaatcttctccggcgccacctgaagcctcctcaacctccaatctcatgctgccaagcccttccaatctcgccggaacatggacttaactgaaacgccgtcctgctagccgtgcccacttgagcgaggagagagtggtgaggcggcttaggtgaggctcggaacggcatctcgcatgtaactacgccacccctgcatctctatgctaatctgagtgcagtactctgcctaatgctctacttctcctcgaaaatatctcttgaatgccccatgtctggtttgcacttatgatgtccgacaatatgcctaagcagtgaccgcatcaatgctgatatacagttctttatctcgtgtatgattattatgatgtatgagaggcttgagtgaagggatccttaattaatttgt

SEQ ID NO: 105583 - protein, 435 aa, Triticum aestivum
  Clone ID: PAT_TA_1.pep
RPPNSRAPPSTSSPGGLNNRRFDLRAPASHQGHQRRDALASSDPPNPPLQSGNVIARKRRVQAQFNELQEYYLQRRRTGAQSHRQEDAVTMNREGYHEGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPKMLVSGSDDCKVKVWCTNQEASAINIDMKANICSVKYNPGSSYYVAVGSADHHIHYFDLRNPSAPLHVFGGHKKAVSYVKFLSNNELASASTDSTLRLWDVKDNCPLRTFRGHKNEKNFVGLSVNNEYIACGSETNEVFVYHKAISKPASSHRFLSTDPDDAEDDPGSYFISAVCWKSDSPTMLTANSQGTIKVLVLAP

SEQ ID NO: 105584 - protein, 197 aa, Triticum aestivum
  unsure (1)..(197): unsure at all Xaa locations
  Clone ID: PAT_TA_2.pep
MGRGRSEXIKRIDNPTQRQSTFYKRRDGLFKKARELAVLCDADLLLLLFSASGKLYQYLAPTVPSVKEFVERYEAATHTKVWSDIRQERRAELEKVAKMCDLLEKELRFMTVDDGEQYTVPSLAALEHNLEAAMHKVRSEKDRKIGGEMSYLENMIRGKQAERYGLCDKLAHAQSLKVVEGGSTSLNNGLDLKLGFN

SEQ ID NO: 105585 - protein, 282 aa, Triticum aestivum
  unsure (1)..(282): unsure at all Xaa locations
  Clone ID: PAT_TA_3.pep
VRRSGRPFGHPPRRPAQRIRTAHGRRALASPAARPDSSAAETWPATGDDAGMDEVQRRLMFDDECILVDEQDNVVGHESKYTCHLMEKIESLNLLHRAFSVFLXFNSKHELLLQQRSATKVTFPLVMEPTTCCSHPSCNXESELIQEXNFLGVRNAAQRKLLDELGIPAEDVPVDQFTPLGRMLYKAPSDGKWGEHELDYLLFIVRDVKLVPNPRTKWLDVKYVSREQLRELIQQADAGEGGVKLSPWFRLVVDNFLMGWWEHLEKGTLAEAVDMETIHKLK

SEQ ID NO: 105586 - protein, 114 aa, Triticum aestivum
  Clone ID: PAT_TA_4.pep
AGGLPTMVFSHSMISIAPLRPFTPSVPTRLRLRSCWRWEALGAVGLLPEELDSVQSRACQLRGTTPFPCLWPGSKFHRSPASSKYHVGDVRLRRGCQICQGCARAWPPHHRDRG

SEQ ID NO: 105587 - protein, 171 aa, Triticum aestivum
  Clone ID: PAT_TA_5.pep
CAALEAAGSDKPRIVRGHLQSSQVLRNGGTSCCMLGPGNFSGDELLSWCLRRPFRERLPAASSTLVTLESTEAFGLEAADVKYVTQHFRYTFANEKVRRSARYYSHGWRTWAAVAVQLAWRRYRHRKTLTSLSFIRPRRPLSRCSSLGEEKLRLYTALLTSPKPNQDDLLL

SEQ ID NO: 105588 - protein, 136 aa, Triticum aestivum
  Clone ID: PAT_TA_6.pep
SDITTLRLSIRLLQQLVLLCWRKACIMVVRSLHCTAEGMHHGRPIPPLYGGGAPRTVGVWLRTVGSTAGCALSVAHGMVRVQRTNADAADCMADGAAHDHRGDDEQRDLEERHQTGSSGEGRHRNVAWLTGVVSGD

SEQ ID NO: 105589 - protein, 230 aa, Triticum aestivum
  Clone ID: PAT_TA_7.pep
PLVRLMQINLPGVRWVGGVELELIAIATGGRIVPRFQELTPDKLGQAGLVREKSFGTTKDRMLCIERCANSRAVTIFIRGGNKMMIEEAKRSIHDALCVARNLIRNNSIVYGGGSAEISCSVAVEAAADRYAGAEQYAIRSFADALDGIPLALAENSGLPPIDTLTAVKSQQIQENNPYCGIDCNDVGTNDMREQHVFETLIGKQQQILLATQVVKMILKIDDVITPSEF

SEQ ID NO: 105590 - protein, 217 aa, Triticum aestivum
  Clone ID: PAT_TA_8.pep
AARSRPGRFREIYTDKETGRKKGDALVTYLKEPSVPLAIQLLDGTSFRPGGKTLMTVSVAKFQQKGDVFLAKKADKQKKKKGKKVEDKMLGWGGHDDKKVMIPTQVILANMFSPAELRNDETLLPELEVDVREECVKFGPIDNVKVCENHPQGVVLVKFKDRKDGLKCIEKMNGRWFGGKQIHASEDDGSIKHALIRDYDAEVSRLERFGEELEEST

SEQ ID NO: 105591 - protein, 332 aa, Triticum aestivum
  unsure (1)..(332): unsure at all Xaa locations
  Clone ID: PAT_TA_9.pep
MSEKNDVTQTENGVPKSKRTCARHCKRFWWVYLIVLCIITVIVVPVIILVAVPKIAQSKINEAELEIQSVQILETEEGAYLMKIDSSITTDGKIHASVDPFEAEMYLEDWPAHVPFATVNMPETNSNKHQVVNVTQHVKIADMEEFTRFNIWFHNNETLRVTVNGKTKVKPSGLTRKYGVTFKKTVELKGLNHFAGTEVTDGHIGFGDGTDEPNFNGTTVIPNASVFTLDNGNVTFTNFVGDVEVGTLTIPNLLLKPGNNVVNITASMNQSLVLNAVQQEPYCKTGILPFKLXXKSVMNHGENLTYXAAALGSSXQTVEIDIGSILKKGIXL

SEQ ID NO: 105592 - protein, 203 aa, Triticum aestivum
  Clone ID: PAT_TA_10.pep
MNKEKHHRNEHHLRRCCGGFAACLLALVVVVAFIALVVYLALRPTKPSFYLQDLQLHSINLGDPSLSATAQVTLASRNPNDRVGIFYRRLDVFVTYRDEPVTVPISLPPMYQGHRDVTIWSPVLSGESVPVAGYVAEAMKQDIASGYVSLQVKIDGRVKWKVGSWISGSYHLFVSCPAMLRRRPRRHAAPGVAPTAPGAPSRH

SEQ ID NO: 105593 - protein, 214 aa, Triticum aestivum
  unsure (1)..(214): unsure at all Xaa locations
  Clone ID: PAT_TA_11.pep
MNAALTVAVAEEEIDEAVAGEEIDEAASRAQADMSEIMSSLPRCPVYLTRHYRGFWIREFVLKGMAAAQASFEPRPTDVFLASCPKSGATWLKALAFAMLNRATHLPSDSNHPLCHRNPHDCVAFLETRPVPETMALPSPRLLATHIPCSLLPSRITECGRVVYVCREPKDALVSFWIYNNKIVPMLRXEVGLESPSPTFEEAFELFCEGQSSF

SEQ ID NO: 105594 - protein, 121 aa, Triticum aestivum
  Clone ID: PAT_TA_12.pep
HASSSLHSLQLPLSPPPPNRARIHETPAARVHEPPDALLRPILPHQALTSPFHPCQSPHLARSPVPAASSHTSPSPQRPRLRQPTTAAVSGDPCAAAGDAHIEQHRPGTGAGSGRRSESMY

SEQ ID NO: 105595 - protein, 267 aa, Triticum aestivum
  Clone ID: PAT_TA_13.pep
PAGPGFTLDSLLDLLSGFILWFTAFSMQTPNPYRYPIGKRRMQPLGILVFASVMATLGLQIILESTRSLVSSNGAEFRLTKEQEMWVVNIMLAVTLVKLLLVIYCRSFTNEIVKAYAQDHFFDVITNIIGLVAALLANYFEGWIDPVGAIILAIYTIRTWSMTVLENVHSLVGQSASPEFLQKLTYLCWNHHKAVRHIDTVRAYTFGSHYFVEVDIVLPCDMPLQEAHDIGEALQEKLESLPEIERAFVHLDYEFTHQPEHARSYDT

SEQ ID NO: 105596 - protein, 65 aa, Triticum aestivum
  Clone ID: PAT_TA_14.pep
MNSLSVCDDRAVYSYWGINMQRSLGLSVSAHNFVSSPHVDHYRSFPHLYSAKIDEFLKVCSPVRV

SEQ ID NO: 105597 - protein, 353 aa, Triticum aestivum
  Clone ID: PAT_TA_15.pep
TLLFLLFYWFFLSDTTFASSSAKILLVISLAPYIHGVLPSYVLGFTGEKVTPDCLPASVSSLTAQFSNMIHHRLGLQMSSTPPLYPDAVYFLSHTRTFNISKARRQLGYAPTVSLEDGIMRTAASVSELQDNLGISRKQGSCGSSKADKLLGSGVAADILLWRDEKKTFSYITLLFLLFYWFFLSDRTFVSSSAKILLVISLALYIHGVLPSKVYGFTVEKVTPDCFEVSDSTLRNPIMCMASLWNGGIYKLRVLAEGDRWGTFVKAVASLSCGKVMLHFQFRTLIGLALASLFIVFIVYEQCDEGIDALVAMASVKIKSLVDKVVRDLPAVRNVLVSSKASYILQIMLAMTL

SEQ ID NO: 105598 - protein, 232 aa, Triticum aestivum
  unsure (1)..(232): unsure at all Xaa locations
  Clone ID: PAT_TA_16.pep
MASPHADPQQHHASAPPLLLAVRRIPYPGAQRPRALPAPDLAPLARRLDELTAAAAAHPLLKPLFDLRHHLSTFSQSRRQRMVAMRQAACPLAGGEGCFAAVLGGSVAGMVVSYGVNSFLSLYNTVLVIRLVLTWFPNTPPAIVSPLSTVCDPYLNIFRGIIPPLGGLDLSPILAFLVLNALTGTAAALPAELPSQKTASGSVHPDXVTANQRKWTRRFRPXKSQEAEDAAR

SEQ ID NO: 105599 - protein, 201 aa, Triticum aestivum
  unsure (1)..(201): unsure at all Xaa locations
  Clone ID: PAT_TA_17.pep
AGRADPPPPPCITPPSSQSPMAAASHQVPPHPTAGXMTPHRCSPSPLALSTSPSTAAPSPSGHSPPSPAAPSPSGHSPPSRANAALSTSSHSPPSPASLPSRALQRXGAFIPDDRRPCQICSTAPLRSPSTGASSAAPSTSSSPPRCSATPAPPRRPARPRPSDPTHCLALCFPSSPAPPNRPKKKVTSGRCTSTKGKLEE

SEQ ID NO: 105600 - protein, 288 aa, Triticum aestivum
  unsure (1)..(288): unsure at all Xaa locations
  Clone ID: PAT_TA_18.pep
MSAGEGKRTACVTGGSGYIASALIKLLLQKGYAVKTTVRDPDDMEKNSHLKDLQALGPLEIIRARLDEEGSFDDAVSGCDYAFLVAAPMNIGSADPERDMIEPAVQGTLNVMRSCVRAGTVKRVILTSSDAGVSRRPLQGGGHMLDESSWSDVEYLRANKPPTWEYVVSKVLLEKAATKFAEENGISLVTVLPVFTLGTAPVSXPEPAPPLTLSLLTGDETQLDILIGVLSVTTSVSICHVDDLCRAQVFVAENESSTGRYICXSHDTTLVQLASLLAEKYPQYQCET

SEQ ID NO: 105601 - protein, 95 aa, Triticum aestivum
  unsure (1)..(95): unsure at all Xaa locations
  Clone ID: PAT_TA_19.pep
MCIRTCSSSVRSRLGTVSSDLVATGSGGGSFVATGSGSRSGGCCCFGGGSGSGGCCFCGELCSHRQRRREXSGGCCCCFGGGSGSGGCCFCGGSF

SEQ ID NO: 105602 - protein, 229 aa, Triticum aestivum
  Clone ID: PAT_TA_20.pep
MASAAPPLLPTTVPAAAPATVLPAAPDAAAANSIASPDPAATRAFLGRLYDSAKRSLSGARPWPELLDRAALSRPDSLSDATARLRKNLAYFRVNYAAFVALSLAFSHLPHPFSLAALLGAPRPPGCFLYLLRPADAAPLNAFGRTFSDRETLGGLIAASVFVVFLTSVGGIIFSALALGAAVVCAHGAFRVPEDLFLDEVPDQGLVGNGATINLLSFINGAAGGGGRV

SEQ ID NO: 105603 - protein, 311 aa, Triticum aestivum
  unsure (1)..(311): unsure at all Xaa locations
  Clone ID: PAT_TA_21.pep
MVAVKRIWNARKLEAKFDKEFEAEVKVLGNIRHNNIVRLLCCISSQDVKLLVYEYMENGSLDRWLHHLDRQGAPAPLDWPTRLAIAIDSAKGLSYMHHDSAQSIVHRDVKSSNILLDPEFRAKIADFGLARMLVKSGELESVSAIGGTFGYMAPEYASRLRVNEKVDVYSFGVVLLELITGKVAXNDGGADVCLAEWAWRRYQKGPPFNDVVDEHIRDPANMADILAVFTLGVICTGENPPARPSMKEVLQHLSRCDRMSAQAEACQLDYGGDGGAPLLEAKKGSRRRDVSDSGRWDDDEEDSGNFVVHAV

SEQ ID NO: 105604 - protein, 162 aa, Triticum aestivum
  Clone ID: PAT_TA_22.pep
MGDATASALASTKTAELDAPLSALGFEMEEVSPSRLTGRLLVTDTCCQPFKVLHGGVSALIAEGLASMGAHMASGYRRVAGMQLSINHFRSAAAGDTVLARAVPVHIGRSTQVWEVKLWKMDASTQGEGPLIAEARVTLLCNLPVPDEMRSAGESLRKYSKL

SEQ ID NO: 105605 - protein, 223 aa, Triticum aestivum
  Clone ID: PAT_TA_23.pep
MAATTEHSEQLSEKHDGLNGNFDPEAQRGEALSQFRTAQSVQMSPELFEKLYLSPMNKVKGDLRQKFANPTPIALVGFLLAFTPLTCDLMGWRGAGGSGAASNAVYMFMGGLLMIIGGVLEWVLGNSFPACVFCSFGGFWFSYGGTLIPAFGTYAAYAPADAKSSAEGLATQGFNASLGFWLLFMGLLSFIFFLCALRTNVVFVMIFFSLTFCFLLITAAFWA

SEQ ID NO: 105606 - protein, 311 aa, Triticum aestivum
  unsure (1)..(311): unsure at all Xaa locations
  Clone ID: PAT_TA_24.pep
MSKMAIRVPKNMRAKRELLKHAXPKLVENGKKMLILHGTKTSAVLNSVLADLFHLKRDHAVKYTKKNDNIRPFESGGETSLEFFSLKSDCSLLVYGSRLISARFPXQRKRPNNLVLGRTYDHHIYXDLVEVGVENYKSIESXKPFFAFIGEHFESVEELKHLKEMLLDHFKGEVVENLNLAGVDRIFVCTAISPTTVYMMHCALRLKRSGTSIPRMELVEVGPSMDLVLRRHRQAAESLQKEAMKAPGHAKFAESGSNGPGAGXQGGICIPDPEGSQVALARHSRPRGRERRDAKKNKEQSKKQKVAENPE

SEQ ID NO: 105607 - protein, 191 aa, Triticum aestivum
  Clone ID: PAT_TA_25.pep
YKGRKTNVRSARVAGGAARACCDLGSTSGLAMPLAGGGCWLLQAGRRVRRAAVRACQRRGCCVVRAAGGASTERGDEHDPSHDDGVRASHLTAAELAALRRLPPGQAPAARRTPTATSVVDGQPPRAPVGSNRRGLHTPRTRCGEDCCSRLNYDQNVAAGTAKEPTSAAAAKTTAHMLLLGWIAIAAASKN

SEQ ID NO: 105608 - protein, 120 aa, Triticum aestivum
  Clone ID: PAT_TA_26.pep
RGNKRLGGGLARGQPEARLKGNGRFGGRGGGGQPPAKRQAAGKDGPAEETDDGIVIAHMRKFYKKDVKSLPTKEGVDMREFYEKDRKSLPTRKGISLSMDQWKILRDNIEAIDEAIKENT

SEQ ID NO: 105609 - protein, 83 aa, Triticum aestivum
  Clone ID: PAT_TA_27.pep
MHPHLTLHRHPMCAEIIEEFQKCHVDHPIKKFFGECTDLKIKLDRCFRQEKAVKRKANFEESKKFKERLQASRAEFAARENES

SEQ ID NO: 105610 - protein, 133 aa, Triticum aestivum
  Clone ID: PAT_TA_28.pep
RQGLAVSCSWWPCRPASSCVALPPCLVGRAHSFVLQGHSPLQHAPPAPRQREQEGDPNHRCERRNPHRPSASDDRLQHPLHSAIEKQTHRASFFSFRKVDLPPSASDESEQGNGRRKKYSQPAEMYVIHPDAW

SEQ ID NO: 105611 - protein, 128 aa, Triticum aestivum
  Clone ID: PAT_TA_29.pep
MASRIVSRRFLSTTARRFQEHQKSELKKESQRNPEILILGGVMVAALGGAGYYLGRSPTGATSESPVTIATHPWESGSSGKYQYHPGGDLSQAPKDAPSALNVVVVPNVTLPSELHDKYNKWGKDGYP

SEQ ID NO: 105612 - protein, 171 aa, Triticum aestivum
  Clone ID: PAT_TA_30.pep
MASPSRSGAAAAAARPRMASTSSLDLGKIVPPAGFLLHRCTAVLSAPVLRGRSASGRCGLAVSVSSSNGAAGLSPLSDSEKKGPVVMEIPLEDIRRPLMQTRANDPDKVQELMDSIRVIGLQVPIDVLEVDGVYYGFSGCHRYEAHQRLGLPTIRCKVRRGTKETLRHHMR

SEQ ID NO: 105613 - protein, 119 aa, Triticum aestivum
  Clone ID: PAT_TA_31.pep
GDEGFQVSGSDNADGSSPAALADSDDGYKNSQSGNEDASSSSEATEPEDEEYPAEAIFTAEDLAFMISLGWSKDEKVQPLGLEEIADYVRRHKGLEQRLFSMEANADIKIILLYLCGQS

SEQ ID NO: 105614 - protein, 279 aa, Triticum aestivum
  unsure (1)..(279): unsure at all Xaa locations
  Clone ID: PAT_TA_32.pep
PESSWRSLKVRWDESSTIPRPDRVSPWEIEPASSPPVNPLPLSRPKRSRPNVPPASPESSVRTKEGATRADMDCAQAQRXQNNTALPGQEQRSNKLTDINDFDATVQKPMMWSPPPPPNIGKNNSLTFQQRPSVHNSIQLGRRETDFKDASSGAQPFGDSLGFFMQTTFDEAPNRLGSFKNQFQDHSYARQFADPYLFMHQQPSLTVESSRKMHTENNDLHFWNGPSTVYGNSIDQAQDFRFKEHPSNWLSPQFSRAEQPRVIRPHASIALIELEITTE

SEQ ID NO: 105615 - protein, 97 aa, Triticum aestivum
  Clone ID: PAT_TA_33.pep
DELTAELDRMFEFDGELMSSTKDWQIVYTDPEGDMMLVGDDPWEEFCNIVRKIFIYTKEEVQKMNSKSSTPRKEEGSADADGANEKARPATSSHLDN

SEQ ID NO: 105616 - protein, 265 aa, Triticum aestivum
  unsure (1)..(265): unsure at all Xaa locations
  Clone ID: PAT_TA_34.pep
SSLYRNPRGQTHAFRFEESPSNWLWQQQEFSSVEQPRAILPHAPIVPVALDKTRQRSGFAPSGPKFDATIFRSNHLSSTMAACHEXSVTIPSIPVVNXMQQANADFIPVLIVSTASNTDKAKSIQQAPHSSKDVQSKSHGASTRSCTKVHKQGVALGRSVDLSKFGDYDELTAELDRMFEFDGELMSSNKDWQIVYTDPEGDMMLVGDDPWEEFCNIVRKIFIYTKEEVQKMNSKSSAPRKEEGSGDADGANEKAHLATSSHLDN

SEQ ID NO: 105617 - protein, 236 aa, Triticum aestivum
  Clone ID: PAT_TA_35.pep
MASSSTPSTPLLYSCIAHNTTILSECTTSASSQTSSLASLILPKIEHTNPQKLTYTHGQHQIHYVAESPSEHRDYPSAGGLTFLVIADSSLGRRVPFGYLFEIRKRFLQQFPESTDFSDMPNYGAASFNSELKNLMVDYGTTTGGRDDAIGNAKREIDDVRGIMTKNIESLLERGERLDLLVDKTDRLGGSAREFRVRSRGLKRKMWWKNVKLMGLLALVIFLIIMAIVIAVQNGS

SEQ ID NO: 105618 - protein, 176 aa, Triticum aestivum
  unsure (1)..(176): unsure at all Xaa locations
  Clone ID: PAT_TA_36.pep
MSAKSILEADGKAILNYHLTRAPVIKASPLPAPTTHNPPSRLASLHFPEDANVADILNQAEVTYPWLLQPDAKFVAKPDQLIKRRGKSGLLALNKSWPEAKAWVAERAGKEQQVEHTTGVLRQFLVEPFVPHPQDTEYYININSVRDGDWILFXHEVDVVSPDVVAKAEKLLIPVD

SEQ ID NO: 105619 - protein, 82 aa, Triticum aestivum
  Clone ID: PAT_TA_37.pep
AIIRLFAMAPKSNATRMVAVFVVLMIMSSTLSSSSCYARTIEDGAPVCSRVEKCQDRCQTACSISGKPSTGAYCNNDQCCCA

SEQ ID NO: 105620 - protein, 141 aa, Triticum aestivum
  Clone ID: PAT_TA_38.pep
RGLFFFFFASILCILHFQKISFAQYQELLFTVYIKLFYTTTSQITGKMCQLQKIATQITDKMSKLQNFVQTTKFLPLAHLSLVITGNISSSNHWKDLPLGHHCWGCLLCRLRSVQPHVPRCSLQVWTAGELDGGRGRSAGV

SEQ ID NO: 105621 - protein, 182 aa, Triticum aestivum
  unsure (1)..(182): unsure at all Xaa locations
  Clone ID: PAT_TA_39.pep
PPPPAPPTPPSTTSTRXIEVREVHPLSPPHPPFTPPTXPCPPPPPPGTAPGTPPLRHPRGALITITAGSPPWSPPAPAPGRQXNPTLSTRQQNTTPTPPLRRPPRPAXPAWARTSWRSKPPNRAYATADAPSPRRPAVAPPPAPERPQKRAASHKGARPHGCDPPPARCSSKRVEQVLKGSK

SEQ ID NO: 105622 - protein, 123 aa, Triticum aestivum
  Clone ID: PAT_TA_40.pep
VGVSYGTGAQLVSQLWLLSSSNYITKRQAIKLLGDMLLDRSNSAVMMRYVSSKDNLMILMNLLRDSSKNIQIESFHVFKLFAANKNKPAEVVNILVTNRSKLLRFFYSADTSFITCSLSASNC

SEQ ID NO: 105623 - protein, 107 aa, Triticum aestivum
  Clone ID: PAT_TA_41.pep
KRQAIKLLGDMLLDRSNSAVMMRYVSSKDNLMILMNLLRDSSKNIQIESFHVFKLFAANKNKPAEVVNILVTNRSKLLRFFAGFKTDKEDEQFEADKEQVIKEISAL

SEQ ID NO: 105624 - protein, 152 aa, Triticum aestivum
  Clone ID: PAT_TA_42.pep
WNRSSLASLSGNLPKLKFFLQMAYTRSSNSVPGLCHAARSLHGNAQLGVTLEGSNCWKFLMTETYAVDDLVLVEERALLPPPRLKTGAWRRGRFPLRPQGALPARGGGSGSAVLGAAPAVPVASSVRALVRREGARRAVLAALISPPRAVFQ

SEQ ID NO: 105625 - protein, 85 aa, Triticum aestivum
  Clone ID: PAT_TA_43.pep
TPITDFEIEKPAIQVNEVAVVDKTVIKEQLREEGSKASNVMQETFDDDIDDWLDEEADLAGHTAILIGDEEDVSFSDLEDDDDTK

SEQ ID NO: 105626 - protein, 177 aa, Triticum aestivum
  Clone ID: PAT_TA_44.pep
MQECNCWLLGYSGQHRSRTSTVFLLMVHSKGMIVDDEYVIIGSANINQRSMEGIRDTEIAMGAYQPQYTWANKISAPRGQIYGYRMSLWAEHIGIIEEDFNHPESLECMRRVRQLGQHNWDQFFANEVTEMRGHLLKYPVSVDRKGKVKPLPGCATFPDMGGNICGSFTAIQENLTI

SEQ ID NO: 105627 - protein, 206 aa, Triticum aestivum
  Clone ID: PAT_TA_45.pep
PRVRQAEAASLLYKSNLNGGSVLEYALAFTSAALDRHYSKWSATPKTGFIDITTSKDFYRVFSGLQYSYLEDSMTNPSKKREMLGDSVAWAGCTIMYLLGQQLHFELFDFSYQFLNVAEIETATVSLYQPADRSKSPNIFQGYEVILEAMRKARRLNNHVFSMLRARCPLEDKVACAIKPSGAPLHRMKFSNTVSAFETLPQRANS

SEQ ID NO: 105628 - protein, 166 aa, Triticum aestivum
  Clone ID: PAT_TA_46.pep
MPELKVGADFPEGVFFSYVQPTPEIAEFSTCGAPTNYNASQEFKSKKVVLISVPGAFTPTCSASHVPSYVENIEQIKAKGVDQVIVVAVNDAFVMHGWAKANGITDDKILFMSDHNAKFSTSIGWNLGERTGRFAVVIDHGKITYASSDEPGSIEKSGALGVLPHL

SEQ ID NO: 105629 - protein, 140 aa, Triticum aestivum
  Clone ID: PAT_TA_47.pep
MPEDSRDADDLLGESAAGFDGGGANDAYAGAYMHDPDDFGRDIYPVEDYEYAPADFEIQSHHERELFNGMGEQGPIGQMYDGYDRKRRRTSSERNLDRPFYSERRSRQRETGPVEIDGSDLRHRLRMRKINGSPSINPER

SEQ ID NO: 105630 - protein, 166 aa, Triticum aestivum
  Clone ID: PAT_TA_48.pep
MGSRLGRRVLHFANLPIKLMLPPAPLSSVQEFAVRTVPSASKVDIRRCLESVYGFNIAEVRTLNMEGKKHRRGPFLAAKPDYKKAYVTLQAPLSVSPDIFPIGAILGERERKASAAAARRKVVEGAEVEGEREGKGKHWMEDEREGFSRAGCGKIVYGNPWRLGNC

SEQ ID NO: 105631 - protein, 202 aa, Triticum aestivum
  unsure (1)..(202): unsure at all Xaa locations
  Clone ID: PAT_TA_49.pep
MVQPKKKFRGVRQRHWGSWVSEIRHPLLKRRVWLGTFETAEEAARAYDEAAVLMSGRNAKTNFPVQRSSTGDPAPAATRDVRGGSSSSSTSNLSQVLSAKLRKCCKAPSPSLTCLRLDTEKSHIGVWXKKRAGARAHSNWVMTVELNKGAGPSGDAVAAQSTSVSNHGLLHRASTMDDEERLTLQMIEELLSSSGPASPSHG

SEQ ID NO: 105632 - protein, 272 aa, Triticum aestivum
  unsure (1)..(272): unsure at all Xaa locations
  Clone ID: PAT_TA_50.pep
DHASGCCSCETVEPRMERGKXYVLLDDGXQLCLECLDSAVMDTNECHPLYLEIYEGLNMNQYEQVPLRSSASCRKTGFKWGEKTGHHCLPETSXMCLFEEQTRSTILRRPRMTGIKSMEMITELYRLXRRCEVTKXTAILILYGLPRLLTGSILGCEMMHCWLKLTGYRTLTLDIEEGICQVLAWMWIESEIMVGSGSNAASTSSSSSSSTSSKKGGRSQFERKVGDFFKHQIESDTSVAYGDGFRAGNRVVQQYGLKRTLEHIRLTGTLPF

SEQ ID NO: 105633 - protein, 146 aa, Triticum aestivum
  Clone ID: PAT_TA_51.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKAATKSPKKKAVATKE

SEQ ID NO: 105634 - protein, 213 aa, Triticum aestivum
  unsure (1)..(213): unsure at all Xaa locations
  Clone ID: PAT_TA_52.pep
MVLQTAQQEPSLTRPPHCSAASARSPAAMDTSPATPLLLQPPAPSIDPFAAKAAVNKNGGAATAVYDLRREPKIPAPFVWPHAEVRPTTAEELAVPVVDVGVLRNGDAAGLRRAVAQVAAACATHGFFQVSGHGVDDALARAALDGASGFFGLPLAEKQRARRVPXTVSGYTSAHADRFASKLPWKENLSFGFHDRARAAPVVVDYFPTNLRP

SEQ ID NO: 105635 - protein, 131 aa, Triticum aestivum
  Clone ID: PAT_TA_53.pep
MAREMNGYFSHPPPPPPVPAPYQEEAAADVDDAEDGSGGQGKLCSRGHWRPAEDARLKELVGQYGPQNWNLIAEKLDGRSGKSCRLRWFNQLDPRINRRAFTEEEEDRLMAAHRAYGNKWALIGRLFPGRT

SEQ ID NO: 105636 - protein, 114 aa, Triticum aestivum
  Clone ID: PAT_TA_54.pep
CGHSERKPPHQERRATSPPPPTAGAAAHRAAAPTCVARPKKAPDPSGTHPSRPAPACLQPPTETRGARHRRRRGGSGRRGVLAAMVRSSSPSPAGATREGISLSFDFLLPKHVV

SEQ ID NO: 105637 - protein, 155 aa, Triticum aestivum
  Clone ID: PAT_TA_55.pep
MASLSLHSGRISAVAIGGGLRPHKAGPMGASASPFLRSSFISSSSTSSAPTSSLSAAVSASLAFTSASSFGGSSLGIEFSYNRLTTRRPRGLQIRAGKAALCLTKRSRSRKSLARVHGFRRRMRTTAGRKVLKRRRDRGRKILCTKSNSPTGTKY

SEQ ID NO: 105638 - protein, 126 aa, Triticum aestivum
  Clone ID: PAT_TA_56.pep
MEDFYYFPSSLETSEIVHRGFLPVVHSSPRNRSSPSPRPRRGSRDDAGELGHHYLDACFRCGRTIAGNKDIFMYRGDTPFCSEECRQQQIDTDEAAEKRSKKSAAATTTEQQSQRQSPHRVPVWAR

SEQ ID NO: 105639 - protein, 225 aa, Triticum aestivum
  Clone ID: PAT_TA_57.pep
PVHREINKNSLFFFFFFFFFFFFFFFFLAGFCYLFLALVQKNGARRVKRASIESTELEISWIEGGNQLSPMEVMTGKGGAKPVPNYLRPSTGSCHDACKHGGHHAFVEKQEAPRTQPKPRKKQQPSASDDQNQKRRLVKVRSVSRRRVVDFSKPDKADTPAGGSEIVVEWKDIVAYDAVPAPAPADGPSHQQPDGRKKKSDVMKGKTPFAKTTHPETPSRTQPNH

SEQ ID NO: 105640 - protein, 150 aa, Triticum aestivum
  Clone ID: PAT_TA_58.pep
MGSVSYVLAAAVLAALVSGGACIPRVPPGPNITTNYNNQWLSAKATWYGRPTGSGPKDNGGACGIKDVNLAPYNGMIACGNVPIFKDGKGCGSCYEIKCQKPSPCSDKPITIFITDKNYEPIAPYHIYLSGTVFGAMATPGKEQTLRSFG

SEQ ID NO: 105641 - protein, 524 aa, Triticum aestivum
  unsure (1)..(524): unsure at all Xaa locations
  Clone ID: PAT_TA_59.pep
MGKAAAVGTAVVVCAAVGTAVVLGRRRRRRDAELLGAAEAERKKKVAAVIEDVERTLATPTALLRGISDALVLEMERGLRGDMHSQLKMLISYVDNLPTGDEHGLFYALDLGGTNFRVLRVQLGGREKRVAKQQYQEVSIPPHLMVGTSLELFDFIAAVLAKFVETEGDEFHLPMGRQRELGFTFSFPVNQLSISSGTLIKWTKGFSINGAVGEDVVAELSKAMERQGLDMKVSALVNDTVGTLAGGRYMDNDVVAAVILGTGTNAAYVEHANAIPKWTGLLPKSGNMVINTEWGSFKSDKLPLSEYDKALDFESLNPGEQIYEKLISGMYLGEIVRRILLKLAHDAALFXGDVVPAKLELPFVLRTPDMSAMHQDASHDLKILGSKLKDIVGVADTSLEVRYITRHICDIVAERGARLAAAGIKGTRYVCHGAKWITGGXPLGSTVEAMDGGLYAHYEEGQQPRQICSFVAQRGRTLGRCWHIWHPEAARAWQGATGRQPDAKEAVVALDGGLYEHYNKIRTC

SEQ ID NO: 105642 - protein, 256 aa, Triticum aestivum
  Clone ID: PAT_TA_60.pep
NEAKDLLFSLIKKKRVVRLINGKPGENRYNSPIEQGNPTDLALTRPHTTPRRGHRHPTNNVIVIASPRAGDSDFLADDHQDPSERTALEDLVSRSQTIGRRRRGPAAPILLMSFTEESCKPRIDLSNATCGEHRPPKPPSWSHRCRMGPAARSFDFSVTVRNKHRHTQRRTEPPTSKGQAATQLHTSPSLSPHESQRQPLESPVGHLPIETPCTASPKEARERITGLQSNPPKDETPYGARRKQGIAIHRVFEIKP

SEQ ID NO: 105643 - protein, 174 aa, Triticum aestivum
  unsure (1)..(174): unsure at all Xaa locations
  Clone ID: PAT_TA_61.pep
AGRFPEKKKKKKKNPRLPSHPRISLRTSKTKRPHLPLLLQARCSAPAAAARRSARRPIRGFHSGYGAAARSRSQDGGRFPPHDLVPRAQVRAGGGVEREVRGRLPRPLGQPALPVPPAGAPARRRRRGPARSGGGPGVGRDWGARSRKAXVEIGXGPXGPXXEVXQXPXRPKNP

SEQ ID NO: 105644 - protein, 150 aa, Triticum aestivum
  Clone ID: PAT_TA_62.pep
FTVRRARIRRNQANQSMATAIRHAARILQRSQAAERRLFQTKLPRRLTGDEKKVAAAQLAEIQVKKEELYDKIAGWEARYTLHGSSGLKNVQLLRHLSVQVEPRHSDPRWRSYRRWAYIHDCLKVAGCLFIGKTAGDSLISLYQEKHQGK

SEQ ID NO: 105645 - protein, 243 aa, Triticum aestivum
  Clone ID: PAT_TA_63.pep
MLGLSRHTGQKYYGKSASAEPKQVPSKKQRADPILPASKWNREDDGSGDEDRKDGQGLGLSYSSGSDIAGDPGKADATEISTDHAIHHPDTIVDEEHRQKLRQIEIGVMQYRESLEEKGLWNMEELERKVASHRRRLQSEYGLSSSVDGANNRRSSERIPSDRKGRYDDARDSSKKRPHSPSRSHSPSRKSSLDRDREHNRSSHRLHSLAARPHRAREKSSGREKDDHHDRSREREKDRRKGR

SEQ ID NO: 105646 - protein, 289 aa, Triticum aestivum
  Clone ID: PAT_TA_64.pep
AGRAYGARRQWRHPPLSQPSPPPLRPAPKTTAPRRASPSSAAMDVAPGEEPPAAPSGIYYHRKRKPSDPISGISLPSAKMVGNWGFGSVTKDWESMHARKLEFMNFLSTLRKPTQSYVASAEANMINSSVEHTEEKNSEVLIILDSDNEDESMAAYKQLTPAKNKQLPSEKNKQLIPSEQAGTLPACVATQGIADVNDQNSHIVPYGQSATLMNQYHLPHYQPSVQFERVVLQKRPEEERMHDLAVASYAEKWQKHLFSLLLRRENTEYDQVPDRRDAELGQKKKKRPL

SEQ ID NO: 105647 - protein, 199 aa, Triticum aestivum
  unsure (1)..(199): unsure at all Xaa locations
  Clone ID: PAT_TA_65.pep
MAEDQSGPPAADGVVVAMKGHPGSGKSTVARAIASALRCPLLDKDDVRDCTLHLEHAAAGSGILNDLSYAVLWRLAERQLRLGLSIVVDSPLSRRAHLDALARLPAALAIVVECRPGNQDEWRRRLEERGGVLADDGWHKPKTWADLERLVEGYQGCTNYDIGDVPRIVVDTTDPTVSTEAIAVRXVVDFIRPLLARAH

SEQ ID NO: 105648 - protein, 243 aa, Triticum aestivum
  Clone ID: PAT_TA_66.pep
ASLLNITNQACQLFNEDEVHLLEWTDDLEGFVLKGYGESINYKMGLPLLKDVVQSMEEAIIAKEEDFPDGTYEKARLRFAHAETLVPFTCLLGLFLEGSDFEKIQREEPLDLPPMPPQRRNWKGALVAPFASNNMLALYQCPGKTDGKKTSQDQKSSYFVQVLHNEAPVSMPGCGNKDLCPFEEFKEKIVKPHLKHDYNMLCKKPVAAAEEEPSSFSSKLNFFLDLLSRKGYRIKGQDVKTEL

SEQ ID NO: 105649 - protein, 412 aa, Triticum aestivum
  unsure (1)..(412): unsure at all Xaa locations
  Clone ID: PAT_TA_67.pep
LDCDVPCRKPAAAAEEEPSSFSSKLNFFLDLLSRKGYRIKGQDVQTDLYSIRATQVPRASASAVAFGLGLLSGKGKLGAGNNRAFSVLSESRASDICLRFFDSCKTYKDYRKRKEPDVDKQKEPILEHVTSALVSRYHLKFTTQDVSSLWFLCKQEASLLNITNQACQLFNEDEVHLLEWTDDLEGLALKGYGESINYKMGLPLLKDVVQSMEEAIIAKEENFPDGTYEKARLRFAHAETLVLFLEGSDFEKIQRDFEKIQREEPLDLPPLEPQXVVPFASNNMLALYQFSGKNDGKKTSLAQKSSYFLQVLHNDNPFSMPGRIHRGFWPFGEFXEKDSEAAHSKHAYNMLCXVAWGXAAVEEPSSFSSKLNFFLDLLSRCSYRFKGQERGKMLRRNCRVQAPCAATTLDQD

SEQ ID NO: 105650 - protein, 147 aa, Triticum aestivum
  unsure (1)..(147): unsure at all Xaa locations
  Clone ID: PAT_TA_68.pep
MGKANITGTYDLAATYCEPDAGPGEQLQIMTHGIGFDRSYWDFPFNNYNYSYVARAVDEHGYSTLTWDRLGIGASSKGDPVNEIQVFLEIAALKXLTTHARQGSLPGVGCGGYSKVVHLGHSFGSVITYALANESPELSDAIVLTGF

SEQ ID NO: 105651 - protein, 76 aa, Triticum aestivum
  Clone ID: PAT_TA_69.pep
MAKSLAVALLLLVVLAHCDGRELSANDRALAGSGAGGVQESKASGSPGLPIVGTTPTGTSTINGPLVVIPGVPVHP

SEQ ID NO: 105652 - protein, 129 aa, Triticum aestivum
  Clone ID: PAT_TA_70.pep
MASAAASAVSFARPVKAINANSVSFSAPRKGNVSFRLQPVPQRSSVSCAAKKETVEKVCDIVKSQLALADDTVVSGSSTFADLGADSLDTVEIVMGLEEAFGISVEESSAQTIATVEDAANLIDSLVAN

SEQ ID NO: 105653 - protein, 129 aa, Triticum aestivum
  Clone ID: PAT_TA_71.pep
MASSAASAVSFARPVKPINANSVSFSAPRKDNVSFRLQPVSQRFSVRCAAKKETVEKVCDIVKSQLALADDTVVSGSSTFADLGADSLDTVEIVMGLEEAFGISVEESSAQTIATVEDAANLIDSLVAN

SEQ ID NO: 105654 - protein, 106 aa, Triticum aestivum
  unsure (1)..(106): unsure at all Xaa locations
  Clone ID: PAT_TA_72.pep
TPSCSHPCSSSLPSPPSLTPWKMSCSSSLSSTTWAAVSSRSTAPTPWAPSTPSSRRRQSQAVQSSSSSPSPRXSSPWRSASSRRSSPSSRPPRPTPVAATPSSAPA

SEQ ID NO: 105655 - protein, 80 aa, Triticum aestivum
  unsure (1)..(80): unsure at all Xaa locations
  Clone ID: PAT_TA_73.pep
MSTERSLPKRKKRHEFGLQRGKKAKEEQAKKLQAKKXKMKIDGSDKKKKGSSFKVGKKKVKTKLSALGKAKAAQAMELDN

SEQ ID NO: 105656 - protein, 155 aa, Triticum aestivum
  unsure (1)..(155): unsure at all Xaa locations
  Clone ID: PAT_TA_74.pep
MMGAKVTWTDTXSVTVTGPPRXPFGRKHLKXAVDVNMNKMPDVAMTLAVVALFADGPTAIRDVASWRVKETERMVAIRTELTKLGATVEEGPDYCIITPPEKLNITAIDTYDDHRMAMAFSLAACAEVPVTIRDPGCTRKTFPNYFDVLSTFVKN

SEQ ID NO: 105657 - protein, 411 aa, Triticum aestivum
  unsure (1)..(411): unsure at all Xaa locations
  Clone ID: PAT_TA_75.pep
MLEALEALGLSVEADKVAKRAVVVGCGGRFPVEKDAKEEVKLFLGNAGTAMRPLTAAVVAAGGNATYVLDGVPRMRERPIGDLVVGLQQLGADADCFLGTNCPPVRINGKGGLPGGKVKLSGSISSQYLSSLLMAAPLALEDVEIEPPASPTAASSPRPPPPPPXIIDKLISVPYVEMTLKLMERFGVTAEHSDSWDRXFYIKGGQKYKSPGNAYVEGDASSASYFLAGAAITGGTVTVEGCGTTSLQGDVKFAEVLEMMGAKVTWTDTSVTVTGPPRQPFGRKHLKAVDVNMNKMPDVAMTLAVVALFADGPTAIRDVASWRVKETERMVAIRTELTKLGATVEEGPDYCIITPPEKLNITAIDTYDDHRMAMAFSLAACAEVPVTIRDPGCTRKTFPNYFDVLSTFVKN

SEQ ID NO: 105658 - protein, 86 aa, Triticum aestivum
  Clone ID: PAT_TA_76.pep
PIGAFFFSALLAGYVYDKEAERQNPGVLDPSNCFGPDCFRLTFYVCAMVCCCGTLICLVFIARIKPVYQMLYASGSFRHPRQQQLY

SEQ ID NO: 105659 - protein, 302 aa, Triticum aestivum
  Clone ID: PAT_TA_77.pep
MKSPERMPKRPYEGRVGKKVKRRRRHLYVVMKDEDGRCGIHKFDLSTNLLDDGHPVVEVLPPALNHFDSPSRGFFVAFGTKIMVFHSKSDKIGPPFFDVSTHNMGQGPRTRSRLSQPIYLPVCDKLVALDGNHSELLYLPPLEGKWLRCKLPNLSFNLQDIISHAVHPDGRTIFVSFKSYSSTATFSLDTGSDHARWRFHGMWGLPFTGRAHFVPGLNAWVGLSGDQDTLGHLCSCDVVSTDPDSSNKHSPPPWKLGKEKLFCKKSFEEHVGANLLYLGVETNFCLLHYFSVKDDDCMPHLL

SEQ ID NO: 105660 - protein, 239 aa, Triticum aestivum
  unsure (1)..(239): unsure at all Xaa locations
  Clone ID: PAT_TA_78.pep
MTDFDVSTLELQFVPSPPVEEPDITLFGRARFGSQAIDIMKEELCHQYIAAAEQTRFCAPEDLLHDSSKNVETYSAMDLITKQAPASQQDCVEAGDVAPSCQCAEAGDVAPSCQGKASPTLPEAFAVQPLPTVQHNISVVPDQPEKSDIIIEPISISTTESSSLRMVKNAEVTDCQTDHLCVIGSSKSLHASLKRLYRSRNVPVPHPLPSLVGLLEXTKRVKRRPGSDYSSLNSRHSLP

SEQ ID NO: 105661 - protein, 207 aa, Triticum aestivum
  unsure (1)..(207): unsure at all Xaa locations
  Clone ID: PAT_TA_79.pep
MDDPGFEIECEIPGVVRVHKSGRVVRLNGTETVPPSPSGDPANGVASKDVVLDPAANISAPLXRPPGKKLPVVVFFHGGAFMIYTAASPLYHKYAASLAAAVPAIVVSVHYRLAPANPVPAAYEDAFAALKAVVSSCRPRGAEPWLAAHGDASRVVLAGDSAGANMAHRTAARLRKERIEGYDDKVSGIALLHSYLWGKRPGGGETH

SEQ ID NO: 105662 - protein, 52 aa, Triticum aestivum
  Clone ID: PAT_TA_80.pep
PRVRPRVRPRVRPSKAFQDCINHYGSDISKCQFYLDMLNECRRGGAGAGATL

SEQ ID NO: 105663 - protein, 143 aa, Triticum aestivum
  Clone ID: PAT_TA_81.pep
MARRSGGGRSSRPAPRAAPVRNPPAPARQAPPPATTQNSGGGIMSGIGSTIAQGMAFGTGSAMAHRAVDAVMGPRTIHHETVVGEAAASMTPMDNAADDKCGNPSKAFQDCINHYGSDISKCQFYLDMLNECRRGGAGAGATL

SEQ ID NO: 105664 - protein, 147 aa, Triticum aestivum
  unsure (1)..(147): unsure at all Xaa locations
  Clone ID: PAT_TA_82.pep
MARRSGGGRSSRPAPRAAPVRNPPAPARPAPPPATTQSSGGGIMSGIGSTIAQGMAFGTGXVPMAHRAVDAVMGXPRTIQXHETVVGEAAASMTPNGQLLLMTSVATLAKALPMHWHQPPIGKRYHTSARFYLDMLNECLRWMVAIF

SEQ ID NO: 105665 - protein, 511 aa, Triticum aestivum
  Clone ID: PAT_TA_83.pep
MVSTGLSLEMTKKVLGLALWVWIAIGVVALLVAILLMICIWAASRRKTKRTMENLSQTQIPIYSKEIPVDRVGGGRSLAQTMHEREQPSFPTQDKHAVNREPGKTVGHMALSKSSDHDNVSQGSSVCNVDRVGSVHSGEDGGSGHGRKPYSPAAFVSASPLVGLPEFSHLGWGHWFTLRDLEFATNRFSKENVLGEGGYGVVYRGRLVNGTEVAIKKIFNNMGQAEKEFRVEVEAIGHVRHKNLVRLLGYCVEGVNRMLVYEFVNNGNLEQWLHGAMRQHGVFTWDNRMKVVIGTAKALAYLHEAIEPKVVHRDIKSSNILIDDEFNGKVSDFGLAKMLGSDKSHITTRVMGTFGYVAPEYANTGMLNEKSDVYSFGVLLLETVTGRDPVDYSRSSNEVNLVEWLKMMIANRRAEEVVDPILEVRPTIRALKRALLIALRCVDPDSEKRPKMGQVARMLESEEVPFREDRRNRRSRTGSMDIESITEGSTSAEFAIKVERTGSSRSDRSQT

SEQ ID NO: 105666 - protein, 110 aa, Triticum aestivum
  unsure (1)..(110): unsure at all Xaa locations
  Clone ID: PAT_TA_84.pep
RPGCNFPLDRSCARSTTILVGSSEKSSTLLNVEAHPWRRPCAHGWWWRRWRARXRWRCARRTRRRARRSRSRRRRRRRPRSPTALRAPPRRAAWARCATRRTRRRRGCSM

SEQ ID NO: 105667 - protein, 120 aa, Triticum aestivum
  Clone ID: PAT_TA_85.pep
KSAHNLGMHTWSGSRVSLQCCSWGVPRSIARPTKRMERVHSNVQQHRMNCYATHHYTRNGGPAMHDSFLQQCFKENWRVRRGMVHNLALLLSGQVEGTRKYHHHECAMSSYSPVLRFLGP

SEQ ID NO: 105668 - protein, 149 aa, Triticum aestivum
  Clone ID: PAT_TA_86.pep
AARSQPPVSSPNLGFHLSIRWCRPERPYRVVPRWPRGLRRAGARPMPPRIAPWWDAAALRRRGSRVRRVRRPHRRLLHQPACPQALVVLFAVDQLAFKFAVLRARRPSLLASCCARACSYGIRKAFFVPYISRVGNMPAPSPRRSMPTL

SEQ ID NO: 105669 - protein, 201 aa, Triticum aestivum
  unsure (1)..(201): unsure at all Xaa locations
  Clone ID: PAT_TA_87.pep
MQQARAAAGEDSSSSSSAHTVNAAAVVLAAAARSSDGLRPQLHHHHLHGHDHDPSAAATKKRWWSRLSSTLCFRPHFHAHPRRVIADAYADGDTPPRPLAAASHTASASAYVHQAPPAHPVFAFAAPPSSPASSLFQSEAPSPVLLDLHGTAGSSPGMFAVGPYARGPQQLVSPPVLYSXXTTEPSXGPGTPPGTTGPSLP

SEQ ID NO: 105670 - protein, 307 aa, Triticum aestivum
  Clone ID: PAT_TA_88.pep
RPGCYCRSPRGSSTGAGLGNSFLSHIRAVDAIFQVVRCFDDAEIIHIEGDVNPTRDLDIISEELRLKDIEFTEKALENQKKKTRMGGQSLEQKKAVQDQATLEKVLAWLNDGKDVRKGNWGPKEIEVINPLFLLTAKPVVYLVNLSEKDFIRKKNKHLPKIVEWINENAKGDPLIPISVSYESRLTLCETEAESKEEQKTAGADSVLPKVILQMRKTLQLGSFFTVGPDEVRQWTIRNGTKAPQAAGVIHNDFEKTFIQALVFNYNILKELGDESEVKAKGKIMTKGKEYVMEDGDIVHFKAGAAKG

SEQ ID NO: 105671 - protein, 177 aa, Triticum aestivum
  Clone ID: PAT_TA_89.pep
MRGSHLLLLLVAFSSFHGHLAARHGRRHAPAAVPVVGSVRPGDAAMDAASSGGATAVRCHDGAVCSEKGLFFPPIPLVPEPPNIGGVPIPPNPIMPAPPSLVPPVFPAPSPPSILPPLVPQPPPASLIPPVLPLPFLHPPPPPPPPPSILPPLPLLPPLIPGVPPASSSKNGRPVKP

SEQ ID NO: 105672 - protein, 133 aa, Triticum aestivum
  Clone ID: PAT_TA_90.pep
MIKVSRAIEIPNVYISAILSSLEMAPVTVNYHDLQLPAYIMGAVVAGGGIMGYAKSGSVPSIVAGCTVGLLYALGGYRIQNEESYGVELALLASAVLGGSAFPRALRLRKPVPILLSVISAFGLFTFGTALRR

SEQ ID NO: 105673 - protein, 236 aa, Triticum aestivum
  Clone ID: PAT_TA_91.pep
MFRNALRQSTRAVGAVSAAGRVAALRNAAPASINAARFYASDAKATPTEVSSILEQRIRGVQEESNLAETGRVLSVGDGIARVHGMANVQAEELVEFASGVKGMCMNLEAGQVGVVLFGSDRLVKEGETVKRTGEIVDIPVGPEMLGRVVDALGNPIDGKGPINTKERRRAQLKAPGILPRKSVNEPVQTGLKSIDAMVPIGRGQRELIIGDRQTGKTAVGLDTILNQKRWNDGND

SEQ ID NO: 105674 - protein, 174 aa, Triticum aestivum
  Clone ID: PAT_TA_92.pep
IKLRIQRRDGKVKRKAGIRAGTSCVRGGRVGAWLPARRAGDGRRDVRRRCSWTSPLAQVYLPPAAAPSPASARIPGARLAVAALLRRRAAPAALLPAFRRRPSIIPIVLSLAPYDRVPARAAFLPQPTMAGPATTRSRCSCLATRERDGWMDGNHYAMRFDFLPWWAYLWGIGY

SEQ ID NO: 105675 - protein, 132 aa, Triticum aestivum
  Clone ID: PAT_TA_93.pep
MKRCILPSILLMLSLEAALLVAGRPSVDGEVGAILLPSQGQDQQAAMAAPKRPWKCCDRARCTRSIPPICTCVDEAFECASTCKACVPSTRTPGPSRPHARQRRLPPAVTSTRVVSTPALLLQQPALCDYIK

SEQ ID NO: 105676 - protein, 133 aa, Triticum aestivum
  Clone ID: PAT_TA_94.pep
MAAPKRPWKCCDRARCTRSIPPISTCVDEAFECASTCKACVPSTRNPSLQVCEDQYVGDPGPICRPWECCDSAACTKTDPPTCRCGDEVERCAPTCKTCEPSTSDPSLNVCRDAYTGAIPPTSTPEAVAAGGN

SEQ ID NO: 105677 - protein, 178 aa, Triticum aestivum
  Clone ID: PAT_TA_95.pep
MKMKRCIVPSILLMLSLEAALLVAGRPSVDGEVGAILLPSQGQVMAAPKRPWKCCDRARCTRSIPPICTCMDEAFECASTCKACVPSTRNPSLQVCQDQFVGDPGPICRPWECCDSAACTKTDPPTCRCGDEVEQCAPTCKTCEPSTSDPSLNVCKDAYTGAIPPTCTPPEALAAGGN

SEQ ID NO: 105678 - protein, 134 aa, Triticum aestivum
  Clone ID: PAT_TA_96.pep
MAAKKRPWKCCDQAVCTRSIPPICRCMDQVFECPSTCKACGPSVGDPSRRVCQDQYVGDPGPICRPWDCCDLPLCTRSNPPTCQCMDEVDKCAPTCKTCLPSRSRPSLRVCIDRYFGPFPPACTPSEAVAAGGN

SEQ ID NO: 105679 - protein, 206 aa, Triticum aestivum
  unsure (1)..(206): unsure at all Xaa locations
  Clone ID: PAT_TA_97.pep
MHPSQHPADAFTGGSPPRRRPPLCRRRGGGHSPAEPRPSGRPRKQPWRRRTRPWKCCDRRAVXPRSIPPICTCVDEAFERAPTCKACVPSSGRQPVPPGLRRIRYVGDPGPICRPXGECCDSAAGAPRQHPPAPAAAGTEVXRCAPTCKTCEPSTSDPSLNRLQGRVHRGPSRPPCTPRRRLPPGGNYRRASSPTPCLAAAAACTL

SEQ ID NO: 105680 - protein, 114 aa, Triticum aestivum
  unsure (1)..(114): unsure at all Xaa locations
  Clone ID: PAT_TA_98.pep
QTANFDQKXGVQNIQTALKAPVYTIACNAGVEGAVVVGKLLEQENTDLGYDAAKGEYVDMVKVGIIDPLKVIRTALVDAASVSSLMTTTEAIIVEVPKEEKEAPAMGGMGGMDY

SEQ ID NO: 105681 - protein, 521 aa, Triticum aestivum
  unsure (1)..(521): unsure at all Xaa locations
  Clone ID: PAT_TA_99.pep
MKHPKLAHHLTSAPRPPSLYAPRLPRHLAAFAMYRAAASLASKARQAGSSARQVGSRLAWSRNYAAKDIRFGVEARASMLRGVEELADAVKVTMGPKGRTVIIGQSFGXAPKVTKNGVTVANRMEFKDRGKNVGXASVVKQVANVTNDCAXDGTICAAVLVKAVFTEGSNAVASGRNAILLWQGISDAGEDAMTHLKGIGRVISTSEXEIAQVGTISANGEREIGELIAKAMEXVGKEDVITIVDGNTLYNELEVVEGMKLDRGYISPYFITNQKTQKCELEDPLILIHDKKVSNMHAVVKVLEMALKKQRPLLIVAEDLESEALGTLIINKLRAGIKVCAVKAPGFGENRKANLQDLAILTGGEVITEELGMNLENFDPEMLGTCKKVTVSKDDTVILDGAGDKKNIEERADLIRSAIEQSTSDYDKEKLQERLAKLSGGKLVLKIGGASEAEVSEKKDRVTDALNATKAAVXYASKDLDKLPTANFDQKTGVQIIQNALKTPVXTIATNAGVEGAVISW

SEQ ID NO: 105682 - protein, 276 aa, Triticum aestivum
  Clone ID: PAT_TA_100.pep
MAQGTAPSAAGGGGGGVFSTPAAVATTPPGTPRAAAAAQPVPSGHYAVELYFDPALENQVLKAWNALARRQLSSRLIDTASRPHLPLLHLPAAALPDPLRLAPALRALASRIDPLPLALSSLASPPSSLDAGVLFLSPTPSAALLGLHAQLCELLRKDTGLEVPDGFRPDNWVPRCAVAVDVPRGRMAEAFCVLRELKLLPVSGYGMDIALVEVAPVVKRGRVVPAWWQRRCWEPIERCCCNLVQCEEPPGMGLSYLNKGIIMITWGISLSSLPNW

SEQ ID NO: 105683 - protein, 152 aa, Triticum aestivum
  Clone ID: PAT_TA_101.pep
RAPSRAVLALKRRPRIHAGVSRVEEIEELLDPALALACVDDPARLGAVDSPIVRLVSDEYGVGGDKAPFVCLGGFRNTRGVYELGEGEGQGRVLELDETHFDFGTNYELECETAEPDQAKEVLERLLTVAGVPYEYSRSNKFASFMAGKLLP

SEQ ID NO: 105684 - protein, 200 aa, Triticum aestivum
  Clone ID: PAT_TA_102.pep
MQQAMSLPPGAVGAVSSPAGITTEQIQKYLDENKQLILAILENQNLGKLAECAQYQAQLQKNLLYLAAIADAQPPQNPTSHPQMVQPGSMQGAGHYMSQVPMFPPRTPLTPQQMQEQQHQQLQQQQAQALSFPAQVVMRPGTVNGMQQPLQAAGDLQPAAAPGGSKQDAAVAGASSGPSRTPSRALARADEVGADVAEQS

SEQ ID NO: 105685 - protein, 188 aa, Triticum aestivum
  Clone ID: PAT_TA_103.pep
MIQLFLQVPTDDGNVDTDAVRARRSLLDKAESVIKSVVRSGGPTRPRRSLCSTVSSIHLLDPRDQRDLFLHLLEMKDLRRDVAARLLRMIFDKKPAKAGSVLAKKCHMLEKFFEGNPERILQWFSHFAATGESAHKKGARALAQFAFVNRDVCWEELEWKGRHGQSPAVCATKPHYFRELDVLQTGEK

SEQ ID NO: 105686 - protein, 108 aa, Triticum aestivum
  unsure (1)..(108): unsure at all Xaa locations
  Clone ID: PAT_TA_104.pep
PDPNAPPPXPSAAPPPPRSHPPSAAPLPPXPPRPDLRPPSGPRRPWILPTPPASLLHSGTQRPVRRAREGGGGGGLSPPPPPPKKKKGGGGGGPPPPPTNFFFFFLNL

SEQ ID NO: 105687 - protein, 241 aa, Triticum aestivum
  Clone ID: PAT_TA_105.pep
AGGPGPINRGVPTLSALSRPHSPIQSAAASAATPPPPGSSAPSPSPFPSPPLPSTRARIAPQISPPPAPPPILAEQPLGFRFASGSGSGPDRRPPSSSGGTIRRPPCFLARQEPFPGKDTAMEGHVLGGGNWGSSPYPGPNANINASVNENQFMFDAKAAPQQLQLFGSNAVGTSGYYNYNGNGNPYVMNQPRKTSNCAADEKKLKLQMSLNNFHAGDADRLACTGNSKCCVYWAETVLRG

SEQ ID NO: 105688 - protein, 222 aa, Triticum aestivum
  unsure (1)..(222): unsure at all Xaa locations
  Clone ID: PAT_TA_106.pep
MKSKLLFPLLSFVGQSLATNDDCPLITSRWTADPSAHVFNDTLWLYPSHDIDAGFENDPDGGQYAMRDYHVYSIDKIYGSLPVDHGTALSVEDVPWASRQMWAPDAAHKNGKYYLYFPAKDKDDIFRIGVAVSPTPGXFVPDKSWIPHTFSIDPASFVDDDDRAYLAWGGIMGGQLQRWQDKNKYNESXTEPGNGTAALSPQIAKLSKDMHTLGEKPSRHAH

SEQ ID NO: 105689 - protein, 109 aa, Triticum aestivum
  Clone ID: PAT_TA_107.pep
AGRASISLQQPQPKGLKRKKRVNNFVMALTRINTSVLCLMALLMVSITFLSCEASGRNIGLEDATCGGYQEPYDPSPCPNVNACDHYCKQDGKGSGTCRNGACCCSKRL

SEQ ID NO: 105690 - protein, 242 aa, Triticum aestivum
  unsure (1)..(242): unsure at all Xaa locations
  Clone ID: PAT_TA_108.pep
MGGGSGDLSPTGIPASPSSSSSEPLPREFADYVPVSDGDSEGGCICDAPEVEALLYGSQFQHRSLREAKDLIRRYKPGYWIEGVGDTKAGDCLLPDTTTLLLVGPRGAGKSTLVNRITRVFDKDDDPFAPERAQVSYNSKSNGTSFIREYKIPRNSNGICICDTRXLSRNPEKDFKMLQRWMMKNVSNVGMTNGGYPWGRWGHGASGRWRWHYGPPPRWARQVNFGLFVAVGASFGGSWGCG

SEQ ID NO: 105691 - protein, 172 aa, Triticum aestivum
  Clone ID: PAT_TA_109.pep
WRVSSNCSCCNLRRDPTVKKRSNQRGQAKVGGIILRRKKRSGRAKGKKWQLREGIKIPSALNPQIGPGISISLFPSPSFSTYGRRRGQASVAARQLVPPPLHHAPPAPLSIIHTPPPAPTSRAPLAASSLNLLLLHLPSSCADLLLLCFLHSSCYSFFPRDLLLLLLLRSLG

SEQ ID NO: 105692 - protein, 232 aa, Triticum aestivum
  unsure (1)..(232): unsure at all Xaa locations
  Clone ID: PAT_TA_110.pep
MEKDDDGGDGLRHHAIRLPLTAMEGSDSEVTSNGDSEITSNGGPSVSLRQKASSLMASSAAAYRSKPASFWALLALSGGAMLTAFPAASLLSRLYYNGGGQSKWILSWSAVAGWPIPALLLLPCYLFGDASPTWPPSPWLCFWYALLGLLSAADNLMYAWAYEYLPASTASLVAASSLAFSAVFGRLIVGKKTXIGLSTLNAIVVITXGVVIIALDSGSDRYPGVTGRQYAL

SEQ ID NO: 105693 - protein, 191 aa, Triticum aestivum
  Clone ID: PAT_TA_111.pep
AGPLPAPPNAPATPPLPHTRPGHPPLVAAGGDGAQGRGEQAAAKRPAEEEPVTEKGAEKAPAAKKPEAEKRRPAGKTAPKEAGREAKTRGRKKGSKAKKGVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 105694 - protein, 237 aa, Triticum aestivum
  Clone ID: PAT_TA_112.pep
INHSLAAGLRNSGGFFTDADVARIVAVAAARNATTVYVIEATLNYDDATAASVEQELSSVLATLRHEEGLAFVRDASYLEFLDRVHGEEVALDKIGLWRVPHPWLNVLVPRSRIADFDSAVFKGILQGTDIAGPLVVYPLNKSKWDDGMSAVTPAEEVFYAVSLLFSSVANDLKRLEAQNQKILRFCDLAGIGYKEYLAHYTAHGDWVRHFGGKWQRFVEMKDKYDPKRLLSPGQDI

SEQ ID NO: 105695 - protein, 307 aa, Triticum aestivum
  unsure (1)..(307): unsure at all Xaa locations
  Clone ID: PAT_TA_113.pep
MAPAEDAGDAGGGRSTARKLVPWSSWAEWRFVRDAIFSPYPDPGAALRRIAAWRSRGCLPIPVEVTAALFEIRLAGSLLPXEWLRMISWKSDEMLPLLYSMAINQDFVNGFMEKPAQRXTGPSISLFAASVRVPRILVDIRHESSHRGIPSLRLLHLAAIKAFDWLKCNYWDSQTSAIPDVRLELNSVLHDIAQSLKGKDSENAKSGSKRKRSQKHILNAIRYVRRLYYTCPSEAVSVLLEFCQLDAPEISENSDVHQSDSLDVNHSSDVQIRNQISNGDMKTIITKLSEKEPRVLLGLLKSVIEMI

SEQ ID NO: 105696 - protein, 133 aa, Triticum aestivum
  Clone ID: PAT_TA_114.pep
MAATSGLTATVTSPPAALRTSPPPVLFLRPISRCSRLHSLKAKAAAKDQDEKKPEATKKKAYSLVCTACEGNGAIACTQCKGGGENLEDHFGGRFKAGGLCWLCRGKREILCGSCNGAGFLGGFMSTADDTSE

SEQ ID NO: 105697 - protein, 95 aa, Triticum aestivum
  Clone ID: PAT_TA_115.pep
PAARGYIDLSRNDFDFDLSGVVLPEQLYFVDVSHNAIHGSIPAQVASLSNLQFFNVSYNRLCGPVPTGGNMARFDLYNFQHNKCLCGAPLTACKK

SEQ ID NO: 105698 - protein, 116 aa, Triticum aestivum
  Clone ID: PAT_TA_116.pep
LLAGAKEAEKQGQGALKHNACKEEEEYVFFELQHAHYSPIQWNARIIVSGLSKLTTTMVEGDGMKKIGEYEANGWHMLFIFQKVMLHQNLFMESRHLPRKTRTSKAETSRKHRPRR

SEQ ID NO: 105699 - protein, 115 aa, Triticum aestivum
  Clone ID: PAT_TA_117.pep
QALLVSQTKEQIISDQSEFASASCANGGENCSLFPRRARASRKPCSRRTQVLQGALLLHDMHEVALRHGVRQPEPGPGAQVGPLHHQARHHALLQLRDVYQGVDCSVYSGRLVIS

SEQ ID NO: 105700 - protein, 183 aa, Triticum aestivum
  Clone ID: PAT_TA_118.pep
MSPPRRLAVLCSHLRPDGAEPPAENERPAGQKTVISTSPCGDDGRGAAAGRVGDREAESCVFCRIIRDEAPAFKLYEDDVCVCILDSHPLALGHSLIIPKCHFSSMEVTPPHVIAAMCSKVPFLSNAIMKATDCDAFNLVVNNGEAAGQVIFHTHFHIIPRRSGDKLWPTESFRRSSIEPNET

SEQ ID NO: 105701 - protein, 194 aa, Triticum aestivum
  Clone ID: PAT_TA_119.pep
RGLRPGSGGPARNLPPGPPPSFVLPQAPPSPEDESPPARAPAAVSCGACGPPLRPAGIKESGLDMLIQVAATQLSDQLPESREAARNLSLELQAFYEKSQASGLGEDDSAPAISPEAETWEAFCLSKLSALSAQAILRVTVGVPVTPKEGGISAALKEGAIPAALKEGGISVVVAPKEGGAPVATKEGAAAVGC

SEQ ID NO: 105702 - protein, 198 aa, Triticum aestivum
  Clone ID: PAT_TA_120.pep
MVSFWSFLLSYPEVFLAIACFFCLSLFRLVRHCHKSDLPVNWPVIGMLPFLVRNLYQIHDSVTDMLREAGCTFRIIGPWFLNMSFLATCDPATVNHCFNTNFNNYPKGSEFAEMFDILGDGLLVADSESWEYQRRVAMQVFASRAFRSFSMSTITRKAGTVLLPFLDHMAKHGSQVELEGVFMRFSLDVSYSTVFATD

SEQ ID NO: 105703 - protein, 67 aa, Triticum aestivum
  Clone ID: PAT_TA_121.pep
LARLLPSQSHPDSETIMLPNTRHLIRLLTILFFVICFCRLSSSRDSHCTGVHDPRKPPMLFCPPCCS

SEQ ID NO: 105704 - protein, 270 aa, Triticum aestivum
  unsure (1)..(270): unsure at all Xaa locations
  Clone ID: PAT_TA_122.pep
HEGQGQEVAQEENPKSCELEYGSYCLWSVEHKEEMKDAIVKRLKDQLFMARAYYPSIAKLKHQERFTRELKQHIQEHERMLSDTIADADLPPFFTKKLEKMEGTIEKIKSCEVGCSNVERKLXXLLDLTEDEAYFHTRQSAFLYHLGVQTMPKTHHCLSMRLTVEYFKSVSPQRELLNKQKFEDPAFYHYVMFSRNVLAASTTINSTAMNSRDSGSIVFHVFTDTQNFYAMKHWFDRNSYLDANVHVTNIEDHNKLSKDVESLERQQLWP

SEQ ID NO: 105705 - protein, 232 aa, Triticum aestivum
  unsure (1)..(232): unsure at all Xaa locations
  Clone ID: PAT_TA_123.pep
MAIEKKGMSAYEAERERTVEENKRKMEALNLRHLSAAVAPKTPSPMKHKRRRIIEAATPVPSPPRRSRRLAHIPEVKYADACAEVGEDSERVGRWSPRRRSGSIYLAGGGGGPISMKARMEAASKAEELESQLDPEFPSFMKRMLHSHVVRGFWLGLPSHFCDTYLPKNDCTITLVDEKDEEFESKYLAYKKGLSGGWAGFALDHVIRDGDSTVFQLIKPTTFXVHIIRAAV

SEQ ID NO: 105706 - protein, 597 aa, Triticum aestivum
  unsure (1)..(597): unsure at all Xaa locations
  Clone ID: PAT_TA_124.pep
MAGGGVAHSYGAHRASEEQLITPWSFSIASGHQVXRDPRQSQGLAFSEAERDAHYLRGLLPPAIVSQEHQEKKIMHNGRRYAVPLHRYLAMMDLQERNERLFYKLLIDNVEELLPLVYTPVVGEAGQKYGSIYRRPQGRYISLRRMRERRGGVQNXPESSIQVXVVTDGERILGLGDLGCQGMGIPGGKLSLSTRTASXRGSACLGLPIDVGTGKETLLNDEYYIGLRQRRATGEEYHELLQEFLLNDEYYIGLRQRRATGEEYHELLQEFMNAVKQNYGEKVLVQFEDFANHNAFDLLAKYSKSHLVFNDDIQGTASVVLAGLLAALKMIGGGLVDQTYLFLGAGEAGTGIAELIALEMSKHTELPVDDCRKKIWLVDSKGLLVESRKESLQHFKKPFAHEHEELKTLLEAVQSIKPTVLIGTSGVGKTFTQEVIEAMASFNEKPVIFSLSNPTSHSECTAEEAYTWSKGTAVFASGSPFDPVEYEGKTYVPGQSNNAYVFPGFGLGVVISGAIRVHDDMLLAASEALAEEATQENFDKGLIFPPFTNIRKISASIAAKVAAKAYDLGLASRLPRPDDLVKYAESCMYTPLYRSYR

SEQ ID NO: 105707 - protein, 78 aa, Triticum aestivum
  Clone ID: PAT_TA_125.pep
MAVSSKLFPAAVLLLLLLLATEMGPVREAMACEHARCKKCTGACFDPDECAITCRNEGYDSGDCTGSGAYRCTCSKNC

SEQ ID NO: 105708 - protein, 252 aa, Triticum aestivum
  unsure (1)..(252): unsure at all Xaa locations
  Clone ID: PAT_TA_126.pep
IPRLLPSCIHTSDPIQSSPPSDLAGKSLRSKRGEGSLVLLLKMQIFVKTLTGKTITLEVESSDTIDNVKAKIQDKEGIPPDQQRLIFAGKQLEDGRTLADYNIQKESTLHLVLRLRGGMXIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTPCG

SEQ ID NO: 105709 - protein, 261 aa, Triticum aestivum
  unsure (1)..(261): unsure at all Xaa locations
  Clone ID: PAT_TA_127.pep
FGTRRIRRXAEPVELVQAVKKLRKVFAREEKRRKELPLELKLRVSYELVGRLNGLGDNGTAIQQREALESWRVETLKDAKSASTRNSSNLGLSSEEARLLKRALEFNWHALLEDIGLWISPEIPHTEHDDKPENEPEEEEIIAGPPLHPQCNTELHADYGGAAVRWGLTHHKESAADCCQACLDQARNAKPGELKCNIWVYCPSEFGCYSPDKYEHKHQECWLKQADQPKLNFKDKYSESYRDSHPRAPVVVPWMSGVTSA

SEQ ID NO: 105710 - protein, 242 aa, Triticum aestivum
  unsure (1)..(242): unsure at all Xaa locations
  Clone ID: PAT_TA_128.pep
MSAALLRSRAAVSGTRIASSARPALPKSNLVQRRSASSSSSAGDGAGLRLALYGSAAAAVLYGSYLYTTDTRAFFYRWVVPPLLRWAYPDAEDAHHAGTTALKVLHELNLNPRERDTTLNSSDLAVNVFGTEVQNPIAISAGLDKDGEVADALFDLGAGIVEIGGCTPLPQAGNPKPRVFRVRSLDGMVNRYGLNSRGADDMAIRLRDRLRRFARSLGLTERDVLXETPRSPPGSLREGRLL

SEQ ID NO: 105711 - protein, 174 aa, Triticum aestivum
  Clone ID: PAT_TA_129.pep
SRRRQRRELLGFWEQRGGRGRWRRGVPAGIPIQLQPASPIVAGETTPPQGAYLLLSSLRIFSSAGTHQWGSRDRGNEQPAAGARPTPTIETLAGEIDGGDRMRRGKVDRRGEASRARPGAAVCVLGGTKARRSGRNRSANEAATVGIERVGRRGVTGGREMGCASAPTRPPTRP

SEQ ID NO: 105712 - protein, 127 aa, Triticum aestivum
  Clone ID: PAT_TA_130.pep
MSMAEEQYYGGPRGAPHGLLLAVVAGLVVAGPLFLGDGGEAVTDAIAELLSPVGLLLLPVGLLLLIRLLSSDRGAAAFADVFAFGGSPDAVHRVGGSPIGVALMLLLILALLYYRSALFGGGGDDDE

SEQ ID NO: 105713 - protein, 139 aa, Triticum aestivum
  Clone ID: PAT_TA_131.pep
MMEPASRKRRASSPPPSGPVTLPPPGFVADREEAAARVERLLRYQFNNRSLLEEALTHQSFAGGAAASYQRLEFVGDAALGLAFSTFLYLTNPTVGPGALSTLRAANISTEKLARVAVRHDLYPLLRRNCPRLDLLVGQ

SEQ ID NO: 105714 - protein, 243 aa, Triticum aestivum
  Clone ID: PAT_TA_132.pep
MVSADAARNVVGIIGNVISFGLFLSPTPVFWRIIKAKDVEEFKPDPYLATLLNCMLWVFYGLPIVHPNSILVVTINGIGLVIEGSYLIIFFLYSTNNKRLKMIGVLAAEAAFMVAVVLGVLLGAHTHEKRSMIVGILCVIFGTIMYASPLTIMGKVIKTKSVEYMPFTLSLVNFLNGCCWLAYALIKFDLYVTIPNGLGAFFGLMQLILYGCYYKRTPKEEKSVELPTSNPAGAGNVSVTVDR

SEQ ID NO: 105715 - protein, 143 aa, Triticum aestivum
  Clone ID: PAT_TA_133.pep
MGTVAIYSLFIINKSGGLIYYKDYGSAGRMDTNDSLRLASLWHSMHAISQQLSPTTGCTGIDLLQAHNFDLHCFQSLTGTKFFVVCETGAQNMEILLKTIYELYTEFVLKNPFYEMEMPIRCELFDLNLAHVIQKDRVALLGR

SEQ ID NO: 105716 - protein, 239 aa, Triticum aestivum
  Clone ID: PAT_TA_134.pep
LPVKNSPTSVPYTDSHKFTYICKISVISISNYKGKNNEEQRGRGILGCVKRLTSDIRESEAKKKKKSNDNLWRARRGISGDRSDSGGDSGRVQRGSGRDQNSLPIQIRTRSRSSCSRRARDTAGERGPRGRPPPESCWVEGARQQGAPTSVEVAGRAQIRGKAGHRAPDPATTSVSGDEQQDFKRGIRAEGRRRVERCSGEGNGGRGGVRSPATAEGGAAWGREWAERASARGAETRGG

SEQ ID NO: 105717 - protein, 447 aa, Triticum aestivum
  Clone ID: PAT_TA_135.pep
SDNLLYALEGVSSRLSQLEGRTHHLESSVDDFKLTIGNFNGSTDGKLRQLENMLREVQAGVQIMRDKQEIVETQLHLAKLQIPKTETQSSENSGVGQADSRHQSVAAQQAGVQPQHQPQTFPALPAPNAPPTPPTLQSQPPAQFLGHSSAPSVPALPQEPYYTPSAQTTEAIHQQYQAPPVPQPQAPPAPQQQYQAPPAPPQQYQAPPVPQAHAPPAPPQQYQAPPVPQAQAPPAPPQQYQTPSQFSQYSQQPQPTNVNPSSPLAPPAPQQTEYAPSHSYTPNVRTPSAYMPPPNESALPFYGQNPSMYEPPAVRPNSGPPPSYGAPGYGPQGGSSFSESYGYTGSPSYRGNAGMKSTPFAPSGPSSGGSGNSYGTRLPTARILPQAEPVSSSPTAASGNRVALDDVVEKVATMGFSREQVRATVRRLTENGQNVDLNVVLDKLMNG

SEQ ID NO: 105718 - protein, 209 aa, Triticum aestivum
  Clone ID: PAT_TA_136.pep
MAASLGLTGHETSYPAHPAASSLYNFQAGDPFAAAAGGAAELSFPELVDAARPSDYSLLPAFGAAGGEAMNMYERSVVFPVTTSYYCDGAGMFDGDASARARGGGIGAMAGRPSGRIGFRTRSEVEVLDDGFRKRKYGNKASNDGCGVNNYYRCARDDPRYVLTTYDGVHNHVTPGSTSSRAAPAYSAPTAPAWTWSELHAAAHSSESY

SEQ ID NO: 105719 - protein, 101 aa, Triticum aestivum
  Clone ID: PAT_TA_137.pep
DSYNSIGSPPSRPELWAGPAYSNSPPPSSLPIPKFSLHQKRSVSLELPPADRPEHVEVLVHAKSAPSTPTAGSGLGFFGDNDTAIATENLRRILNLEITED

SEQ ID NO: 105720 - protein, 219 aa, Triticum aestivum
  Clone ID: PAT_TA_138.pep
SPHHSRDGAVALLVPVQLPPWRWRYHGDRRSPRREPAVGVEGAGLGRHRHLHRVWPISRWRVRAVQGAAGRGRGLESAGSWVGGSGGMPGGAKAREGKAEILVAEWSSPCWPYCHRTARAWAARARRCPSEPGRSAPRFSRPSLTACGARARALRSDEPPAGGEGSVCGESAGGTSRGRRADGSGSRCGCRWRRGERCAPRERGGRGAVRGRCGWGGEW

SEQ ID NO: 105721 - protein, 139 aa, Triticum aestivum
  Clone ID: PAT_TA_139.pep
MVVRIRLARFGCRNRPFYRVMAADSRSPRDGKHLEVLGYYNPLPGKDGGKRMGLKFDRVKYWLSVGAQPSDPVQRILFRAGVLPPPPLLAMGRKGGHRDRNPIHPMTGRPLDLEGVTIVDDPNAAEGDAEAPTEPSLEA

SEQ ID NO: 105722 - protein, 123 aa, Triticum aestivum
  Clone ID: PAT_TA_140.pep
MIPRRRSNPSIPMARTSSQSQSSVAGAAGASRPATVGPRGTAAATAGMRRRPGRTSSSGAGGGGGFSGGGNNMLRFYTDEAPGLRLSPTMVLVMSVCFIGFVTALHVFGKLYRSRTAASSASA

SEQ ID NO: 105723 - protein, 155 aa, Triticum aestivum
  Clone ID: PAT_TA_141.pep
MRLFFRSAGDPDEKAKAKPAAQPKPLMARSSSQSQSSVGGAGAAGSRPATAGPRGTPAATAGMRRRPGRTSSSASGGGGFSGGGGNNMLRFYTDEAPGLRLSPTMVLVMSVCFIGFVTALHVFGKLYRGSPPPPPRPPDQSGSLLLFGLRFRSVS

SEQ ID NO: 105724 - protein, 207 aa, Triticum aestivum
  Clone ID: PAT_TA_142.pep
RPVIARTKDKEKMADLQKEVDMYDDFLFIDADEGKKPPEKMLAYFKAAYDMFHAEFYVKADDTIYLRPDRLAALLAKDRLHHRTYIGCMKKGPVVSDPNMKWYESSYGLLGNEYFMHASGSLYALSSEVVGAIATTNNDSLRMFDYEDVTIGSWMLAMNVNHEDNRAMCDSTCTPSSIAVWDSKTCSGSCNPIEKIRELHNTTLCSK

SEQ ID NO: 105725 - protein, 133 aa, Triticum aestivum
  Clone ID: PAT_TA_143.pep
MRHTSITAAVAVAFAVLAVAAAASTGLTAAGRGKQQRAPGPASGSSVYIGMVKPPAVAADSAAYHMGILIAAVGSEDKAKAVLVYSYKSAISGFAARLTPAQVAVLRKNPTVIRAQPDVKYSLHDDNNNNNLN

SEQ ID NO: 105726 - protein, 281 aa, Triticum aestivum
  Clone ID: PAT_TA_144.pep
MTDAPSAPAGDSPPPPQKPESGGSISSMVASSASSAAAAAADYTRRGEAFGADLAAAARTAVDTAHAHAYSSAIAASDAANAAMAGALAAVPTLTQAAKEEFEWVKKEYFAREQMALGKIKEGVIMAIEHPGIAAGSATVAGIVLLKRPRSYLIQRVRRVFVSKETLLSGIQAEVNHMRQTVNLMSNESQKLMDRAATAEKRFQKGWNTLREEGRAIQSELKQISDIENQAVGLKGILDQLPRAHASEFRSEISGLASQVKKEKRVLNSALTKIVNYGVPI

SEQ ID NO: 105727 - protein, 111 aa, Triticum aestivum
  Clone ID: PAT_TA_145.pep
QHRTVVKGSICHMKRALYDLVKEENNPVGYGMNLMQVKIASEKGSSGIGWQGKCYWDPTWRLGRSILLLCLALSHTTVPEKIWHRSVCGVVICPCSFLSRGHATPTAIGVS

SEQ ID NO: 105728 - protein, 110 aa, Triticum aestivum
  Clone ID: PAT_TA_146.pep
AARRCTRAPATCSRRLATTPTAAHSRSTLQRPCPCRTTPAWPGGTTRVAVTREAAATWRRRWRQRSGLVGRSPGAAGRRTARCRRRRRRRRYGTEVVLQRFGSGPWSWRQ

SEQ ID NO: 105729 - protein, 148 aa, Triticum aestivum
  Clone ID: PAT_TA_147.pep
IFGPHGNYEAVNWFFLIGAAGPVIVYIFHRIFPSQRWILMINLPVLIGATANMPPSTAVNYNSWVLIGTIFNFFVFRYRKKWWQRYNYILSAALDAGVAFMAVLLYFTLTMENRTVNWWGTAGERCPLASCPTAKGVDLGPDSVCPVF

SEQ ID NO: 105730 - protein, 188 aa, Triticum aestivum
  Clone ID: PAT_TA_148.pep
SQGKDSVYQIIDQRKADCNTTKSKKSNRWGIKSHDGRSKLGRGRSRTAESGRRSRRRGRGRSRASGSGRIRSSGGRSVGGASIRRLEENMRSRTVEGSRIRTDLVRWRQIRRRLDLVGAAASCVQQQTRERQMLVEEEPQGKEGRRGRQRSSMAGDGDGELLEGSCLGTSREMEEALGEGEGETRWED

SEQ ID NO: 105731 - protein, 151 aa, Triticum aestivum
  Clone ID: PAT_TA_149.pep
AGRVGNAALWEESEAEEDDDGMSESPAAERIRALASPPSAFPDWDSDEGWIDVLSDSREARDAAAEDERASSGEVAFEAEAEFFVSAYVEDADRVGTVGLTALSVSAEQQNDFCSGLLSDPPVFPLSSAFLDESGITESLLHRKKKKKKAP

SEQ ID NO: 105732 - protein, 141 aa, Triticum aestivum
  Clone ID: PAT_TA_150.pep
RHLYICYNPINKATNVLPLSLPFSKRGVPRSLHHQLPLAGFCRLSGAPVIWAPGRARGFCPWLPLQLLEIHLPDESDDGVSGAPFLSCQRPRRAEHRREHQGHHDHRQNELCNHGGHDSSPVISETLSTCVSLSLFSLPLN

SEQ ID NO: 105733 - protein, 128 aa, Triticum aestivum
  Clone ID: PAT_TA_151.pep
QSNKCTTTFFAFFFPKREVPRPLHDLLPLAGFCRLSGALVIWVPGRARGSCPWRPLQLLKIHLPDESDDGVSGAPFLSCQRPRRAEHCREHHDHHDHRQNELCNHGGHDSSPVISEYVSLSLFWLPLN

SEQ ID NO: 105734 - protein, 80 aa, Triticum aestivum
  Clone ID: PAT_TA_152.pep
PAGSGPDRPTMFYAGDGVSDLSAAKETDLLFAKADKDLVTWCENENVPFVTFRDWSSITQTVKDIAAGTVSVKDAARGRI

SEQ ID NO: 105735 - protein, 106 aa, Triticum aestivum
  Clone ID: PAT_TA_153.pep
MEFEMMSQQGALLKVGLFVLVQALVYLILAQSSSVFSTTKTLGLPPARSLSARRMVALISDLPLLLGGEPSPRAVSVEPSSPVPLAHQKKDSLLTKRDWRQGHGPS

SEQ ID NO: 105736 - protein, 193 aa, Triticum aestivum
  Clone ID: PAT_TA_154.pep
RDKQLKTVGTNESSEIIRMLNAEFNDIAENPGLDLNPAHLQGSIDEVNGLVYDAINNGVYKCGFAKKQGPYDEAVTTLYEALDKCEEILGKQRYMCGNQLTEADVRLFVTLIRFDEVYAVHFKCNKKLLREYPNLFNYTKDIYQIPGINSTVNMEHIRKHYYGSHPSINPYGIIPQGPNIDYNAPHDRERLFL

SEQ ID NO: 105737 - protein, 205 aa, Triticum aestivum
  Clone ID: PAT_TA_155.pep
LRENFNPVEIAQAYEKNGAACLSILTDEKHFQGSFENLETVRNSGVQCPLLCKEFVIDIWQIYYARSKGADAILLIAAVLPDLDMKYMLRICKNLGMTALIEVHDEKELDRVLRIDGVELIGINNRSLETFVVDTSNTRMLMEKRGDIIKEKGILVVGESGLFTPDDVAYVHSAGVSAVLVGESLIKEEDPGRAIAGLFGKELLS

SEQ ID NO: 105738 - protein, 140 aa, Triticum aestivum
  Clone ID: PAT_TA_156.pep
WRYLACSAIFRGRLSTKEIEDQMLKVQTKNSEYFVDWIPNNVQTSVCSVPPRGLDMSATFVGNSTAVQEIFKRVDDQFSAMFRRKAFLHWYTSEGMDEMEFTEAQSNLHDLVSEYQQYQDADIDDEAEEYEEGEPEEYEG

SEQ ID NO: 105739 - protein, 139 aa, Triticum aestivum
  Clone ID: PAT_TA_157.pep
MFRFRKTLDIVTVFHKASSPASVRVANLLKQVSANASSGATLDQASDHSAQTAPIREEFELNITEDAPTEDQVKTILEYVGTGGIHKVINGANTEKDALKKFKESKENFVRPVVVDWNNGKAIAGENESEILKLLKQQQ

SEQ ID NO: 105740 - protein, 122 aa, Triticum aestivum
  unsure (1)..(122): unsure at all Xaa locations
  Clone ID: PAT_TA_158.pep
PNGIVLXDYVIEYGDDDTGDDYEVLHRVRRKWWSFICCKAFCRYPRSRRRGRGRDSRGSGRRNSNQAHLENFNLEVPTQAVDLRELRFDEIDDEYIVTGAVPSMATPGRMASFHYRDTRYGR

SEQ ID NO: 105741 - protein, 200 aa, Triticum aestivum
  unsure (1)..(200): unsure at all Xaa locations
  Clone ID: PAT_TA_159.pep
ELSGVKISEPEFQGTQVPMVAVVENGMDLDEAKVEKKRKKMKAKRAALVEGGEEEEVKALKQEKKVKKDKNKKEKKEKKKKNKVEDSDGGDSSEQSIDATSEDQQMGDDTDAITFDEALMSNLQKQFEKAAAEAGMPVTPVTAKVAKKRNRSKSSDRSSEVSGGGVGSQGNVPAQDGDKSGKKXRFSMKEYLVWNPPTLY

SEQ ID NO: 105742 - protein, 223 aa, Triticum aestivum
  Clone ID: PAT_TA_160.pep
WDEEKKSRLQKNKVEDSDGGDSSEQSIDATSEDVEMGDDTDGSEQSIAASSEDQQMGDDPDAITFDEALMSNLQKQFEKAAAEAGMPVTPVTAKVAKKRKRSKSSDRSSEVSGGGVGSEGNVPAQDGDKSGKKVRFSMKSNLVWNPPTPLPPQCLRLPPSATPRGSALKSGVRPGPIKESSTPVKKAKAKANSAKKLLKKIPSSAVEPSRKLQTLSRVNPLPV

SEQ ID NO: 105743 - protein, 206 aa, Triticum aestivum
  Clone ID: PAT_TA_161.pep
MLRHAVRRLASRAAAAGSGSMSRRALATAQAPAEAGEDPAFLEAWKKVTTIIEPPQTPMSAMKPRPPTPASIPSKLTVNFVLPYKSEITDKEVDMVMVPATTGLMGILPGHVSTIAELKPGVMSVHEGNDVTKYFVSSGFAFIHANSIADVVAVEAVPLDQIDQSLVQKGLAEFTAKLGSASTDLEKAEAQIGVDVHSALSAALTG

SEQ ID NO: 105744 - protein, 212 aa, Triticum aestivum
  unsure (1)..(212): unsure at all Xaa locations
  Clone ID: PAT_TA_162.pep
MLRHAARRLASRAAAAGSGSMSRRALATAQAPAEAGEDPAFLEAWKKVTTIIEPPQTPMSAMKPRPPTPAPIPSKLSVLFVLPYKSPTRRXQVDMVXVPXTTGMLPGYFAPGHVYHNCRSSSLAVMSVHKGQIMLQEYFLTIXFIHANSITDVVAVVGLSPLDXIDHSLIHQSLASIQKVLLNSLPKLSLEKAEAQXSEVDVHSALNAALTG

SEQ ID NO: 105745 - protein, 76 aa, Triticum aestivum
  unsure (1)..(76): unsure at all Xaa locations
  Clone ID: PAT_TA_163.pep
TNIGPAEATYHLVVEAPAGIDVSVEXATFMVTFTTRQRVQGGYTFGSLTWSDGSTHSVRIPIAVRTVIQDFVADTA

SEQ ID NO: 105746 - protein, 133 aa, Triticum aestivum
  Clone ID: PAT_TA_164.pep
MAATSIGVFAARPSPALGLPRLRLARAEGLRCRVSKKASSALAPMVAKGAPLLSKASGMASAAPMLASALALVDEGMSGERAGQSNDLLGWALLLVLGLVLCFYAVYSTTFDDDDDRSGGGGIMLCSLDTTTI

SEQ ID NO: 105747 - protein, 166 aa, Triticum aestivum
  Clone ID: PAT_TA_165.pep
QQIAQEATTLGERTRNTHTHTHRGRGRGRVAEVMMWSSSKQQGGDREEWKQHKMVKEVKKSETPIFTYQLPFHSLPLNKVKNIEVDRLRLSFTTPKNSTLVPVDSGSDEESDEDQGCSDIDSDKPMDEVLDHICCGLHAIPRKNKARSAKKRSHKLSSRKFYKIFS

SEQ ID NO: 105748 - protein, 160 aa, Triticum aestivum
  Clone ID: PAT_TA_166.pep
QQIAQEATTLERGPNTHTHTHTQKERVPEVMVWSTSKQQGGEREESKQHKMVKEVKTPIFTHQLSFHSLPLNKVKNIEVDRLRLSFTTPKNSTLVPVDSGSDEESDEDRGCSDIDSNKPMDEGLDHICSGLHAIPRKNKARSAKKRSHKISSRKFYKIFS

SEQ ID NO: 105749 - protein, 127 aa, Triticum aestivum
  Clone ID: PAT_TA_167.pep
MARIGVALLALLVAAAAVACLPAPASAGEQDSMLLTRAATCDGAVGECGVDEDEEMGTGAYGTGEALRRSLARKPTARYISYAALRADQVPCNKRDKSYYTNCGSMQQANPYTRGCSAITRCARNMN

SEQ ID NO: 105750 - protein, 291 aa, Triticum aestivum
  Clone ID: PAT_TA_168.pep
PPPRWRPLLAACVVRPARITPVHRFVAEFMMDDLRYPMKPNTIPVWAVPIYAVILPMLIFAAIYVKKKNAYDLHHAILGLLFSVLITGVLTDAIKDGVGRPRPNFYYRCFPDGVPNYEAVTRQVICHGDAKVIKEGHKSFPSGHTSWSFAGLGFLSWYLAGKIRVFDRGGHIAKLCIVILPLLFAAMVGVSRVADYWHHWQDVFAGGILGLVVASFCYLQFFPHPASKHGLWPHAFRHHNPNPETENQGTTDTHQSVPPHDLSMVQYVASMEMRTNGRALDNMEAGSGRAW

SEQ ID NO: 105751 - protein, 102 aa, Triticum aestivum
  unsure (1)..(102): unsure at all Xaa locations
  Clone ID: PAT_TA_169.pep
AGLPPPELPPPKPHPRRPPPEQPPRRRRXPESFPEGQGEGWASSTTTGRGRTGATPRCRTPTRSGSSPPGPAPSPSAPPPASTTTSPASPPTSSPFPTAGKT

SEQ ID NO: 105752 - protein, 261 aa, Triticum aestivum
  unsure (1)..(261): unsure at all Xaa locations
  Clone ID: PAT_TA_170.pep
MRATLALTALLGLSNAAAIEPRQSRETKLYKIELGPDDVRTVTEAEKWALRAEGKHFIDVTNLDEPGFSLQFLASFPSAVAQSSAVKALLPKLSQANLRTTLTTFSNFYNRYYTSAYGEQSADWLFQQVESIISASGAKGVKVAKFKHTWRQPSIIATIPGKSDSTIVVGAHQDSVNTRSPSAGRAPGADDDGSGTVTILEAFRVLLSDSRVASGEAPNTIEFHWYSGEEAGLLGSGAVFXQYKREGRPVKAMLXPDMTGY

SEQ ID NO: 105753 - protein, 244 aa, Triticum aestivum
  unsure (1)..(244): unsure at all Xaa locations
  Clone ID: PAT_TA_171.pep
MASVAAVEGAAAALRSVLSRAQQAAARAGRAPESVRVVAVSKTKPVGVIRGVYDAGHRCFGENYVQELIDKAPQLPEDIEWHFIGNLQSNKAKALLAGVPSLDMVESVDDEKIANRLDRVVADLGRKPLKVLVQVNTXSGEQSKFGVDPSGCVGLANHVKLSCPNLVPSGLMTIGMLDYSSTPENFKALTSCRKEVCDELGIPEEQCELSMGMSADFEQAIEMGSTNVMVGSTIFGAREYPKKN

SEQ ID NO: 105754 - protein, 278 aa, Triticum aestivum
  Clone ID: PAT_TA_172.pep
MGNDQKMGAYYAPKGGLPPQTQILTDRAMFTESYAVIPKGCFSDIVTSFLPFWEQTRLWVIARPLSGFAETFSQYIMEVSPGGGSDRAEMDDTAEGVLFVVEGEITVTVAGEAHTLDAGGYAFLPPKCGWTLRNNSSENASFHWVRKAYEYVPGLDAPEAFFANEKDIQAREMPDTNGAWSTTRFVDPTDVRHDMHVNIVTFQPGGLIPFAETHVMEHGLYVLEGKAVYRLNQDWVEVEAGDFMWLRAFCPQACYAGGPGKFRYLLYKDVNRHAKFLR

SEQ ID NO: 105755 - protein, 235 aa, Triticum aestivum
  Clone ID: PAT_TA_173.pep
MATLATASRLCLRAAAKPVAPAVRALSTTAIRPDSASASGYSSPFKFQGESKGSQIPDFGKYVSTGSEGKNKLYSYFMVGALGAVSAAGAKSTVQEFLVNMSASADVLAMAKVEVDLASIPEGKNVIIKWRGKPVFIRHRTQDEIDQANKVNISSLRDPEEDSARARQPEWLVMLGVCTHLGCVPIGEAGDYGGWFCPCHGSHYDISGRIRKGPAPLNLEIPEYDFPEEGKLIIG

SEQ ID NO: 105756 - protein, 109 aa, Triticum aestivum
  Clone ID: PAT_TA_174.pep
MGGGNDGHGYPPGGQGGYPPAGYPPQQGGYPPQQGGYPPQQGYPPAPGAYPPAPGAYPPAPGAYPPAPGAGGPDGEKGLLSNIMHGVAGAHGGGHGCRIWGIWVPNWWS

SEQ ID NO: 105757 - protein, 156 aa, Triticum aestivum
  unsure (1)..(156): unsure at all Xaa locations
  Clone ID: PAT_TA_175.pep
MGGGNDGHGYPPGGQGGYPPQGYPPQQGGYPPQXDYPPAPGAYPPAPGAYPPAPGAYPPAPGAGGPDGEKGLLSNIMHGVAGAHGGGHGYPSGGHGYPSGGHGYPPQQGYPPQHGYPPQQHGYPPQQHGYPPAGYPGSSGHSGSHGGRKAWAWAAC

SEQ ID NO: 105758 - protein, 187 aa, Triticum aestivum
  Clone ID: PAT_TA_176.pep
MGGGNDGHGYPPGGQGGYPPAGYPPQQGGYPPQQGGYPPQQGYPPAPGAYPPAPGAYPPAPGAYPPAPGAGGPDGEKGLLSNIMHGVAGAHGGGHGYPSGGHGYPSGGHGYPPQQGYPPQHGYPPQQHGYPPQQHGYPPAGYPGSSGHSGSHGGGGMGMGGMLAGGAAAAGTEHTRSLTAATVEVDT

SEQ ID NO: 105759 - protein, 234 aa, Triticum aestivum
  Clone ID: PAT_TA_177.pep
MGGGNDGHGYPPGGQGGYPPAGYPPQQGGYPPQQGYPPAPGAYPPAPGAYPPAPGAYPPAPGAGGPDGEKGLLSNIMHGVAGAHGGGHGYPSGGHGYPSGGHGYPPQQGYPPQHGYPPQQHGYPPQQHGYPPAGYPGSSGHSGSHGGGGMGMGGMLAGGAAAAAAAYGAHKISHGSHGGGGHMMGGMMGGHGGYGGGYGHHGGKFKHGKHGHGKFKHGKHGKHGMFGGGGKFKK

SEQ ID NO: 105760 - protein, 273 aa, Triticum aestivum
  unsure (1)..(273): unsure at all Xaa locations
  Clone ID: PAT_TA_178.pep
MGGHTDGHWVASSVARAQNPLALSSAAAVPRHPWEEATTLLGHHLLALGLTLPKRTRGQHGGYPPRHGHPPAPESLPAYTWGISSCTSGRTLLLLERVAVNGEKGLLSTIMHDAAGAHGGGHGYPXGGHGYPPAGSMAYPQQGYPPQHGYPPQQHGYPPQQAXGYPPAGYPGSSGHSGSHGGGGMGMGGMLAGGAAAAAAAYGAHKISHGRPTVGGGHMMGGMMGGHGGYRRRVRATSGGKFKHGKHGHXKFKHGKHGKHGMFGGGGKFKKWK

SEQ ID NO: 105761 - protein, 128 aa, Triticum aestivum
  Clone ID: PAT_TA_179.pep
MAASAPLAGVALLLLLLHAAHDGGMAGLASTGGARMASSEGYAPVQTVVYRSAALEASEAFEPFQLCMGCRCCPAGNNGSSCVDTQCCYGINCNLPGKPFGTCAFTPRTCGCGANNCTAAPAPPPPTS

SEQ ID NO: 105762 - protein, 129 aa, Triticum aestivum
  Clone ID: PAT_TA_180.pep
LSKIPEKHIMKRWTRDANDVLPAHLVRYQKDRGPPSSDTFRHHTMYTKALECVLLGDSNVKCYDVFMTMMKEVQATLLPLSAEKDGMGLAEREHRNQVRVEEHTGELQVEGGSTRPDCDGRMRSSGIIG

SEQ ID NO: 105763 - protein, 98 aa, Triticum aestivum
  Clone ID: PAT_TA_181.pep
MGMRGNFCRSKSNQYESTSLVQVEGVNTKEDVAWYAGKRLAYVYKAKTKSNGTHYRCLWGKITRPHGNSGVVRAQFKSNLPAESMGRKVRVFMYPSSI

SEQ ID NO: 105764 - protein, 114 aa, Triticum aestivum
  unsure (1)..(114): unsure at all Xaa locations
  Clone ID: PAT_TA_182.pep
MVKGRTGQRVRLYVRGTVLGYKRSKSNQYETTSLVQIEGVNTKEDVAWYCGKRMAYIYKAKTKSSGTHYRCIWGKXARPHGNSGVSAPIKSNLPPESMGRKXKVFMYPTTSKDI

SEQ ID NO: 105765 - protein, 184 aa, Triticum aestivum
  unsure (1)..(184): unsure at all Xaa locations
  Clone ID: PAT_TA_183.pep
HHDWSGKSDHVDSPTHSRVGSQRTRGRPTRQXPPXRPRQPFSFPMRXQXAPLPTAVNSXLPVPLRKPVLANPSGRSRSHPGSDHRAQDGLMNRHRSLTRGEPRFLPTARGRRTHHAARHGLGGAEGGGISERAPRAEERVLEHGRGGGGGGGGERHGCRCCFAGDGEVADARGGVAARTSVGAR

SEQ ID NO: 105766 - protein, 112 aa, Triticum aestivum
  Clone ID: PAT_TA_184.pep
MVKGRTGQRVRLYVRGTILGYKRSKSNQYETTSLVQIEGVNTKEDVAWYAGKRMAYIYKAKTKSNETRYRCIWGKVTRPHGNSGVVRAKFKSNLPPESMGRKVRVFMYPSSI

SEQ ID NO: 105767 - protein, 283 aa, Triticum aestivum
  unsure (1)..(283): unsure at all Xaa locations
  Clone ID: PAT_TA_185.pep
GVXXWRGFTLQEFANQLFGNKLDYGKGRQMPIHYGSNRLNYFTVSSPIATQLPQAVGAAYSLKMDKKKACAITYFGDGGTSEGDFHAALNFAAVTEAPVIFFCRNNGWAISTPTAEQFRSDGVVTRGQAYGIRSIRVDGNDTLAVYSTVHTAREMAITEGRPILIEAMTYRVGHHSTSDDSTKYRPADEMEHWRTARDPVSRYRKWVQGNGWWCDTQESELRNNVRQELLQAIQVAERMPKHGLAELFTDVYDQMPSNLREQERSLLDTIKKHSAEYPADVPV

SEQ ID NO: 105768 - protein, 112 aa, Triticum aestivum
  unsure (1)..(112): unsure at all Xaa locations
  Clone ID: PAT_TA_186.pep
MVKGRTGQRVRLYVRGTILGYKRSKSNQYETASLVQIEGVNTREDVAWYGGKRMAYVYKAKTKSNGTHYRCIWGKVSRPHGNTGVVRAKFTSNLPXEAMGKKVRVFMYPSSI

SEQ ID NO: 105769 - protein, 112 aa, Triticum aestivum
  Clone ID: PAT_TA_187.pep
MVKGRTGQRVRLYVRGTILGYKRSKSNQYETTSLVQIEGVNTKEDVAWYAGKRMAYIYKAKTKSSETRYRCIWGKVTRPHGNSGVVRAKFKSNLPPESMGRKVRVFMYPSSI

SEQ ID NO: 105770 - protein, 112 aa, Triticum aestivum
  Clone ID: PAT_TA_188.pep
MVKGRTGQRVRLYVRGTILGFKRSKSNQYESTSLVQVEGVNTKEDVAWYAGKRLAYVYKAKTKSNGTHYRCLWGKITRPHGNSGVVRAQFKSNLPAESMGRKVRVFMYPSSI

SEQ ID NO: 105771 - protein, 469 aa, Triticum aestivum
  Clone ID: PAT_TA_189.pep
MAAWLARRAARRLAGELCSHGPGPWPLSLSTVPVLGVPSGDQSRGFCSVRRFAGDSTAAAAVEEPENGLAAGDLQFVDFPGGKLSFVGEMNFLPESQRERINCYRVLDDDGGTIYSSRFQEVSKELALKMYSNMVTLQIMDTIFYEAQRQGRISFYLTSNGEEAINIASAAALSAQDIVLPQYREPGVLLWRGFTLQEFANQLFGNKLDYGKGRQMPIHYGSNRLNYFTVSSPIATQLPQAVGAAYSLKMDKKKACAITYFGDGGTSEGDFHAALNFAAVTEAPVIFFCRNNGWAISTPTAEQFRSDGVVTRGQAYGIRSIRVDGNDTLAVYSAVHTAREMAITEGRPILIEAMTYRVGHHSTSDDSTKYRPADEMEHWRTARDPVSRYRKWVQGNGWWCDTQESELRNNVRQELLQAIQVAERMPKHGLAELFTDVYDQMPSNLREQERSLLDTIKKHPAEYPADVPV

SEQ ID NO: 105772 - protein, 112 aa, Triticum aestivum
  Clone ID: PAT_TA_190.pep
MVKGRTGQRVRLYVRGTILGYKRSKSNQYETASLVQIEGVNTREDVAWYGGKRMAYVYKAKTKSNGTHYRCIWGKVSRPHGNTGVVRAKFTSNLPAEAMGKKVRIFMYPSSI

SEQ ID NO: 105773 - protein, 256 aa, Triticum aestivum
  unsure (1)..(256): unsure at all Xaa locations
  Clone ID: PAT_TA_191.pep
MALASTSATASAAVLKNPFLGARRALANAASLGAAKPVTRRVVVVAAAVGKKSWIPAVKSDAEFINPSWLDGSLPGDFGFDPLGLGKDPAFLKWYREAELIHGRWAMAAVLGIFIGQAYSGVPWFEAGAQPGXAVAPFSFGSLLGTQLLLMGWVESKRWVDFFNPDSQSVEWATPWSRTAENFANFTGEQGYPGGKFFDPLGLGGETKDGVYIPDTEKLERLKVAEIKHSRLAMLAMLIFYFEAGQGKTPLGALGL

SEQ ID NO: 105774 - protein, 112 aa, Triticum aestivum; identical to SEQ ID NO: 105770
  Clone ID: PAT_TA_192.pep

SEQ ID NO: 105775 - protein, 260 aa, Triticum aestivum
  unsure (1)..(260): unsure at all Xaa locations
  Clone ID: PAT_TA_193.pep
MALASTSATASAAVLKNPFLGARRALANAASLGAAKPVTRRVVVVAAAVGKKSWIPAVKSDAEFINPSWLDGSXLPGDFGFDPLGXLGKDPAFLKWYREXAELIHGRWAMAAVLGIFIGQAYSGVPWFEAGAQPRRXWAPFSFGSLLGTQLLLXGWVESKRWVDFFNPDSQSVEWATPWSRTAENFANFTGEQGYPGGKFFDPLGLGGETKDGVYIPDTEKLERLKVAEIKHSRLAMLAMLIFYFXEAGQGKTPLGALGL

SEQ ID NO: 105776 - protein, 304 aa, Triticum aestivum
  unsure (1)..(304): unsure at all Xaa locations
  Clone ID: PAT_TA_194.pep
MALASTSATASAAVLKNPFLGARRALANAASLGAAKPVTRRVVVVAAAVGKKSWIPAVKSDAEFINPSWLDGSLPGDFGFDPLGLGKDPAFLKWYREAELIHGRWAMAAVLGIFIGQAYSGVPWFEAGAQPGAVAPFSFGSLLGTQLLLMGWVESKRWVDFFNPDSQSVEWATPWSRTAENFANFTGEQGYPGGKFFDPLGLGGETKDGVYIPDTEKLERLKVAEIKHSRXAMLAMLIFYFEAGQGKTPLGRARPIRRFLACARGGRGVVALHQIGRTDCMGSAGGRRSSSNVSVSVSSLGWCV

SEQ ID NO: 105777 - protein, 112 aa, Triticum aestivum
  Clone ID: PAT_TA_195.pep
MVKGRTGQRVRLYVRGTILGYKRSKSNQYETASLVQIEGVNTREDVAWYGGKRMAYVYKAKTKSNGTHYRCIWGKVSRPHGNTGVVRAKFTSNLPAEAMGKKVRVFMYPSSI

SEQ ID NO: 105778 - protein, 112 aa, Triticum aestivum; identical to SEQ ID NO: 105770
  Clone ID: PAT_TA_196.pep

SEQ ID NO: 105779 - protein, 112 aa, Triticum aestivum; identical to SEQ ID NO: 105777
  Clone ID: PAT_TA_197.pep

SEQ ID NO: 105780 - protein, 189 aa, Triticum aestivum
  Clone ID: PAT_TA_198.pep
KHDCHDHEHSHHQEPNSSHSADEHDCHDHKHCEEPISLLCATEHACHDHEQNHEHHCCDEEQTVHVADTHSCHDHKHDDSAADPVPELSISIESALPDHHEQEIQCIKEHKEKACGHHLKVKDHVPAPTDCSRGNCHSTVSSKGCESKGKEVCSSWPVGRTGIIRRCCRTRARSCCSHSMLKLPEIIVE

SEQ ID NO: 105781 - protein, 174 aa, Triticum aestivum
  Clone ID: PAT_TA_199.pep
MSPSHCRRLLAVALVCVLLLWRPAGAAEYPVGDGINGWDTGTNYASWAQSRSFAPGDVLVFEYVKSQHNVYQVTEAAYRTCDASAAGAVLATYDTGFDKVPLPEAKSYWFICEISGHCMGGMKLAVNVSAGPSGGGAPAPDAPPSPSAGAACRSSWVAWAAGLVVLAAVHVLVN

SEQ ID NO: 105782 - protein, 83 aa, Triticum aestivum
  Clone ID: PAT_TA_200.pep
PINPLPPISSRNLVVMAMPICHVHKNQEINNPASRSPPRSLHFLMLPSATILCVCFLLQATVPKEPKRQAPCYLQVVSVHPSV

SEQ ID NO: 105783 - protein, 195 aa, Triticum aestivum
  unsure (1)..(195): unsure at all Xaa locations
  Clone ID: PAT_TA_201.pep
VERWVAVRPWENRLLDSNAKENVPIGDDKEAEENGDRDVKQXKRKIXSFRAFKXNXXKPRPREAKHKKSHSDASGSSSGQSAAVPPTASLGSSKLKPKPSDQTSEGISTQTTDPAPRSTSNPKERPAQVNAPTRKRLSLPNNATASGGARKGQASSSEKTRSVGSKNTAKGASKSEPKQRPSPGSATAKRVQAQA

SEQ ID NO: 105784 - protein, 255 aa, Triticum aestivum
  Clone ID: PAT_TA_202.pep
MADSYAKIPSGALVQPTPFRVSIEDERVEELKLLVKLGKIANPTYESTQKEHNYGITHQWLTDAKDAWMKFDWRAAEKRINSFNHWKVPVHDTKGDFDMHFTGLFSTKPNAIPIVMVHGWPGSFLEYLGVLSILKDRYTSETLPYHIIIPSLPGFAFSSKPPMERDFCIEDASRIINTLMVQLGFGSGYVIQGGDLGSIVACELATNYKECKALHLNMCMVPEPSTVTSEVTEAEKQALERGKDFFTRGSAYAFT

SEQ ID NO: 105785 - protein, 253 aa, Triticum aestivum
  unsure (1)..(253): unsure at all Xaa locations
  Clone ID: PAT_TA_203.pep
MAFKIQLDTLGQLPGLLSIYTQISLLYPVSDSSQYPTIVSTFEQGLKRFSEAVPWVAGQVKAEGISEGNTGTSFIVPFEDVPRVVVKDLRDDPSAPTIEGMRKAGYPMAMFDENIIAPRKTLPIGPGTGPDDPKPVILLQLNFIKGGLILTVNGQHGAMDMVGQDAVIRLLSKACRNDPFTEEEMTAMNLDRKTIVPYLENYTIGPEVDHQIVKPDVAXGGDAVLTPVSASWXAFFTFSPKAMSELKDAATRL

SEQ ID NO: 105786 - protein, 263 aa, Triticum aestivum
  Clone ID: PAT_TA_204.pep
MDSDRDYLLSLRAVRIHANKVFEAAKRGELKHFDYDESRMSEVADYVSKVIDRDFGPDKYDTIPPHGRWQHFDVGGVTRVDSLIKQWTSESDVDKTEITRRLIDLFFVSVLLDAGAGDVWRYKESDSGQEVVRSEGIAVASLHMFQAGAFSSDDSAKTRVDGNGLVQLHESAFNTHFQVSADNLMVGVPSRVHFLQAVGSSLLKQPEVFWRVRPPGPTLVDYLMTKSSGLQDVGIRAALVLLAIPSHPLPGRQQDPSSWTPIG

SEQ ID NO: 105787 - protein, 188 aa, Triticum aestivum
  Clone ID: PAT_TA_205.pep
MAISKSFVLAALLAYAEARFGQEQEPVAAVQALDGTFGNPGVAATIAGSIPSALLAAASPCDKLTIADQMITELGDDQAVIDAAIGLVAAETNFNPSAVDKPFVCADPALPATAALRGIIPLVDPAVDGAATENANSATSVQTPFDAAGLSQAEVMIAQGFTTFQAVDGSGANVQLAGQDAAAGGGAA

SEQ ID NO: 105788 - protein, 238 aa, Triticum aestivum
  Clone ID: PAT_TA_206.pep
MKASFGFLAAFLAPVTLAQSLCDQYSYYANGGYEFNNNRWGQGSGSGSQCTYIDWTNSNGAGWHTDWTWSGGQDNVKAYPNSGLQISNKRLLSSISNMQSAAAWSYSGTNVRANVAYDLFTASDPNHVTYSGDYELMIWLGRYGGVQPIGSKVGNANVEGRTWELWSGMNGSMRVYSFVAPNPVTNFNSDVKQFWNYLANTQGYPASKQYLLTFQFGTEPFTGSGAQFKVTNFHAHIN

SEQ ID NO: 105789 - protein, 237 aa, Triticum aestivum
  Clone ID: PAT_TA_207.pep
RPLSDFLAAFLAPVTLAQSLCDQYSYYANGGYEFNNNRWGQGSGSGSQCTYIDWTNSNGAGWHTDWTWSGGQDNVKAYPNSGLQISNKRLLSSISNMQSAAAWSYSGTNVRANVAYDLFTASDPNHVTYSGDYELMIWLGRYGGVQPIGSKVGNANVEGRTWELWSGMNGSMRVYSFVAPNPVTNFNSDVKQFWNYLANTQGYPASKQYLLTFQFGTEPFTGSGAQFKVTNFNAHIN

SEQ ID NO: 105790 - protein, 257 aa, Triticum aestivum
  unsure (1)..(257): unsure at all Xaa locations
  Clone ID: PAT_TA_208.pep
MIDQDWIKSLLNIPVSHVAGIFAASTVIYFLSSCFYNLYLHPLRKIPGPKLAAIGPYLEFYHEVIRDGQYLWEISKMHDKYGPIVRVNAREVHIRDSSYYTTIYTAGSRKTNKDPATVGAFDVPSATAATVDHDHHRSRRGYLNPYFSKRTITNLEPFIHERVTKLLTRFQQHLDDDQVLSLDGAFCALTADVITNRFYGKHNDYLSLPDFHFVVRDGFLGLTKIXHLARFLPGLVTILKRLPYSCIRMIAPSVCDL

SEQ ID NO: 105791 - protein, 305 aa, Triticum aestivum
  Clone ID: PAT_TA_209.pep
APNPVDHASAHASAHRSTNLTFDEQLTQMVLWSMAKSPVMYGGDLRHLNDDTFDLITHPTLLKINHHTKNNMEFGYIHSERTSERNEHSGRSDLTNNGGTVLGLATCNDKNTGGWHSSSKDHICRGFGIQNDNASFCMSKAKLLPTSDGVTMSGVEDQAKFHLVGIDTNDGCRPASVSPMFSTCEQHSKQVWEVTENGQLKSSYSGLCATLKSSKEGESETTGARAWTATGDKGEIYLAFFNLDTASRKIAVRVPDLEKVAGRKLARKHLCTCTEVWSGKSRSLMKGDISAVVSSHGSILFEIQC

SEQ ID NO: 105792 - protein, 395 aa, Triticum aestivum
  unsure (1)..(395): unsure at all Xaa locations
  Clone ID: PAT_TA_210.pep
MALAASPRILSTVLVLFVSSLIWGSSGAAAAGDGRRRLAMLPPRGWNSYDSFSWTIDEAAFLHNAQIMADKLLPHGYQYAVIDFLWYRKNVNGAGEDSYGFDSVDQWGRPFPDPERFPSSAGGEGFKHVADKVHAMGLKFGIHLMNGISTQAVNASTPILDVDTGKAYVEDGRQWTASDIGLTHRTCAWMSNGFMSVNTDAGAGRAFLRSLYHQYADCGVDFVRLGCIFPALFRPXGAAAGSVALRRVGRPVILSISPGTEVTPALAENITQHVDMYRITGDDWDSWKDVRPHFDVARSFADANKIGATGLQGRSWPDLDMLPFGRLTDAGVNQGPHRSTNLTFDEQLTQMLLWSMAKSPLMFGGDLRHLNDDTLDLITHPTLLKINHHTKNNME

SEQ ID NO: 105793 - protein, 216 aa, Triticum aestivum
  unsure (1)..(216): unsure at all Xaa locations
  Clone ID: PAT_TA_211.pep
MGSSASCLWSGSKSGPGPNGLAAAAASPRSGHVLSRSGRNIQVFSLKELKSATRNFHMMNCIGRGGFGPVYKGDLRDGTQVAIKRLSAESKQGTNEFLTEIDVISNVRHPNLVKLIGCCVEGNNRLLVYEYAENNSLSNALLGPKSRCIPLNWQTRAAICTGTASGLAFLHEEAQPRIVHRDIKASNILLDKTLAPXIGDFALAKLFPDAITHIST

SEQ ID NO: 105794 - protein, 104 aa, Triticum aestivum
  Clone ID: PAT_TA_212.pep
MRPTQMLRSGAADPKNGHYIGNWGHFGGEKQRGIITYGLSANRQNPWAGSFNDAIFNTFRRTKGQIFFWLPPMVAGYWMMSWAIERSEYLNSKAGRAEFGDEEE

SEQ ID NO: 105795 - protein, 301 aa, Triticum aestivum
  Clone ID: PAT_TA_213.pep
MLMLAIIVSAPAQPARRRSAAMTRTLTSASPAPASRASSAGTRTPPSSSSPSLPSAASAATSRATAPSSGPAPFLTRTRGSSIETASRPAGVDRAHTSTMATRRSSTGGSHVSSLLVLLFLASASASLLGARAKGPVVDVKASCAKTDGPITCNSFLGPEPDTKTADARGLAEIAMRVTAKLGGLVGAYARRELDLVKDNPTWQCLDECAEDIEDALSHLDDALGGVNDAQFDQVRQYIDLSEQDTWSCDETCRDTPPSPVRTELLRKNLEFERMMNVTRQLIKLADGGASPVLPKPAILP

SEQ ID NO: 105796 - protein, 283 aa, Triticum aestivum
  unsure (1)..(283): unsure at all Xaa locations
  Clone ID: PAT_TA_214.pep
MKSLLALSLFAGLSVAQSSAWAQCGGEGFSGSTSCVSGYKCTVVNQWYSQCQPGTAEPPSTTLKTTTGGGSTPTGTPGDGKFLWAGVNEAGGEFGEKNLPGTWGKDFIFPDPAAVDTLISQGYNTFRVQLKMERANPSGLTGAYDQAYIKNLTSIVNHITGKGATVLLDPHNYGRFFDKIITSTSDFQTWWKNFATLFKSNSRIMFDTNNEYHTMDQTLVLNLNQAAINGIRAAGATQYIFVEGNQWSGAWSWPDVNDNMKALTDPENXLIYEMHQYLDSDSS

SEQ ID NO: 105797 - protein, 70 aa, Triticum aestivum
  Clone ID: PAT_TA_215.pep
INKNTNAVFFFFFFFFFFFFFFFFFFFFFFLPFFFFFFFFFFFFTTQPWKHLLITIFALRHQYKLQLRDK

SEQ ID NO: 105798 - protein, 119 aa, Triticum aestivum
  Clone ID: PAT_TA_216.pep
MPPPSQLAIATGSVNRLLKEEASYHKELEQEEASIEALKKKIDSGAGDSDENAPYILKQQQTALEQTKGVFGPLREKIALAIEKLEEQLAVSDQLNVPEEQVQQAKETLAKAKATQTDA

SEQ ID NO: 105799 - protein, 288 aa, Triticum aestivum
  Clone ID: PAT_TA_217.pep
MEGKEEDVRLGANKYSERQPIGTAAQGSEDKDYKEPPPAPLFEPGELKSWSFYRAGIAEFMATFLFLYVTILTVMGYSGATSKCATVGIQGIAWSFGGMIFALVYCTAGISGGHINPAVTFGLFLARKLSLTRAVFYIIMQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPFKTKS

SEQ ID NO: 105800 - protein, 326 aa, Triticum aestivum
  unsure (1)..(326): unsure at all Xaa locations
  Clone ID: PAT_TA_218.pep
MEGKEEDVRLGANKYSERQPSGTAAQGSEDKDYKEPPPAPLFEPGRGSKSWSLLPRPASPKFMATFLFLYVTILTVMGYSGATSKCATVGIQGIAWSFGGMIFALVYCTAGISGGHINPAVTFGLFLARKLSLTRAVFYIIMQCLGAICGAGVXVKGFQQGLYMGNXGGRRQLLVAPGYTKGSGLGAEIIGTFVLVYTVFSATDAKRNARXDSHVPILAPLPIGFAVFSVPLATMPTXGTGVPPGRAXAEAVIYSGPWPLXDHYTSITGTLVGTARATVGAPVHLRTIEYASNQTTGSFWARTLHPGAAEDRRPTTRWFMRELYLF

SEQ ID NO: 105801 - protein, 325 aa, Triticum aestivum
  Clone ID: PAT_TA_219.pep
MKFLNNDLLASSTLLLATLGGASAQCSLPTSYRWTSSGPLAQPANGWNSLKDFTVAPYNGQQLVYATAYGQGGWKSMGFSPVSDLNNLGSASQTLQTGTAVAPTLFYFRPKGIWILAHQWGPTKFSYRTSNNPANINGWSQPQPLFTGEIANAPFGPIDQTVIGDSRNMYLFFCGDNGRIYRASMPIGNFPGNFGSNSQIILQDTEDNLFEAVQVYTVQGQNKYLMIVEAKGRNGRFFRSFTANSLDGQWTVNAGTESNPFAGKANSGATWTNDISHGELIRTANDETFPIDPCNLKLLYQGRNPSINVDYNLLPYRPGLLTLRR

SEQ ID NO: 105802 - protein, 225 aa, Triticum aestivum
  Clone ID: PAT_TA_220.pep
MAAASPPLLPVSVLPAATTATTTIVLPVPDTSSAADQRAYLSRLLDSAKRSLSGARPWAELLDRAALSRPESLADATARVRRNLAYFRVNYALLVAFSLAASLLAHPFALAALLALLAAWCALYLLRAADAPPLEAFGKTFSERETLGGLLAASAFVVFVTSVGSIVFSALAAGAALACAHGAFRVPEEQLFLDDDIQPGRWRKSGLLRRPGLLLHQRRRRRTLD

SEQ ID NO: 105803 - protein, 260 aa, Triticum aestivum
  Clone ID: PAT_TA_221.pep
MSVPDKFQGFQSPSAEHWTDFQKNSFEPRPFGEYDVDIKVECCGVCASDRHTISGDWGACPYPLAVGHEVVGKVLRVGDKVTLAKVGDRVGAGAQVWSCMDCRQCKNDNETYCKDQIDAYGADYLDTGFKTQGGYSSHSRVHEYWVYPIPEALSSTQAAPMLCAGITVYSPLKRLGAGPGKKVGIVGIGGLGHYGVIFAKALGAEVWAISRSRAKEEDARKMGADGFLATGEKNWTEGHKMTFDIIINTATSFDGFALSE

SEQ ID NO: 105804 - protein, 165 aa, Triticum aestivum
  Clone ID: PAT_TA_222.pep
PAAAARLWKRAASLLLARRTALAAQRAPAISGSAAGATRRAPAFFSTLDAGQARTRVEDVMPIATGHEREEIEAELQGKKRFDMDAPVGPFGTKEDPAIIQSYFDKRIVGCPGGEGEDEHDVVWFWLKKGEPHECPVCTQYFKLEVIGNGGNPDGHDDDDDHHHH

SEQ ID NO: 105805 - protein, 162 aa, Triticum aestivum
  unsure (1)..(162): unsure at all Xaa locations
  Clone ID: PAT_TA_223.pep
MWKHAASLVLARRSALAAHRAPAISGSAAGAIRRAPAFFSTLDAGQARTRVEDVMATATEGERREIXAALQGKKRLDMNPPVQAFRLARRVKVSFSHAVEKRIVDXSVADGWEEHNHVWFLGVMRDKRHECPVCTQXLTLEVIRNGGNTDEHDNGDHVPLHH

SEQ ID NO: 105806 - protein, 221 aa, Triticum aestivum
  unsure (1)..(221): unsure at all Xaa locations
  Clone ID: PAT_TA_224.pep
MRSSPWMVFASAAVVLLALAASSAVVDASPPSKSLEVGFYKHTCPQAEDIVRDAVRRAFGRNPGLAAGLIRMHFHDCFVRGCDASVLINSTPGNTAERDSPANNPSLRGFEIIDEAKAALEASCPRTVSCADVLAFAARDGAYLAGGIAXGVPPGRCDGPAYNSHELLVNNVPLPTDGVDELAMSFNASQXSADVILTLCSSLTIRISHCSSFTQRIHNFL

SEQ ID NO: 105807 - protein, 294 aa, Triticum aestivum
  Clone ID: PAT_TA_225.pep
MSAQKTSAIADQEPVDVLFAIHEKFDLLDFAGALEVFTSACHNFQDPENSKAFEVTIVGPEAKVISDQGVVVGAQITYKEAHDRLEDFDILVVVGGNSKEVVAKELQPLSLITDFSELQKRDPARERTILSICTGALFLGKQGILSGLSATTHPDYLTSFENICSDAATVNLQERTDVVEDARYVVNNLRFDLGEDESPYIRRKSDAGQGRRPSAARKGSMSFKDSNTRRESIVRRAAMRLGVLRVVTSGGVSSGIDAALYLVSALIDDATSLEVARRLQWTWNKGVVVDGLDV

SEQ ID NO: 105808 - protein, 132 aa, Triticum aestivum
  Clone ID: PAT_TA_226.pep
MSQLARASLTAMAMLLLLAAAAAAAGPAAGGAAVADPAGCQDDVVALNEACYKYVQKGAPTVPPSQECCDAVKSVDVPCVCSYLGSPGVRDNISMEKVFYVSQQCGVSIPGELRRIEGLKQEQAAEWQAWIM

SEQ ID NO: 105809 - protein, 108 aa, Triticum aestivum
  Clone ID: PAT_TA_227.pep
MSQLARASLTAVAMLLLLAAAAAAEGPAGCQDDVVALNEACYQYVQKGAPTVPPSQECCDAVRRVDVPCVCSYLGSPGVRDNISMEKVFYVSQQCGVSIPGNCGGSKV

SEQ ID NO: 105810 - protein, 130 aa, Triticum aestivum
  unsure (1)..(130): unsure at all Xaa locations
  Clone ID: PAT_TA_228.pep
TRPTAAADRPTIHETHNHRTAAARQQRTGKTTQIAQLARAAVTVILLLAAAAAAGPAGCQDDVVALNEACYQYVQKGAPTVPPSQECCDAVRRVDVPCVCSYLGXPGVRDNISMERKVFDVSPRCGVSIP

SEQ ID NO: 105811 - protein, 353 aa, Triticum aestivum
  Clone ID: PAT_TA_229.pep
MDDPDVAWPAWKFGMKRDDLFTNLHQQYNTFTFNLQDPEAFHHDVYEISHDADTVDEFHRLMAERKQQRLCELHESLESLAVEIIANPKLMDSEHWQHALQLFRTKSFDSIVRYFASYLPANYVDRNERDHDTISIASSSYSEANSVKTDSTTASSVDGVSSFFDDEPVMKKKSPLSIHTDMRSSSIVQAPPSPPHSVVAHSDESSASSPMESHRYSSNPPSRSMSFSGSVSRPFLPDLPRLLVHDDDETSQSDDNDEAVISDLDCAESQSSLDTMDEGEQPQEYEDDLEDEDEFPTAQFPEDASDAFDFCNDTPESNDTPTPRQETTASCYVEYKSVAAWENPSPRRSTSPS

SEQ ID NO: 105812 - protein, 230 aa, Triticum aestivum
  unsure (1)..(230): unsure at all Xaa locations
  Clone ID: PAT_TA_230.pep
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITVFWLFIIFINVFGTLGYXEEGVWSSCFKLAAIIIFMIVAV

SEQ ID NO: 105813 - protein, 196 aa, Triticum aestivum
  unsure (1)..(196): unsure at all Xaa locations
  Clone ID: PAT_TA_231.pep
TTLLLWFVFYANSFAYYGLVLLTAQLSNANRSCASGLKYVKSETDASLYKDTFVTSLAEIPGXLIASALLVEWFGRKATMWCLLFTCCGFLGPLVFYQSELWTTGLLFGARACAMGSYTVVCLYAPEVYPTSVRSTGVGIATAMGRVGGIICPLVAVGMLRSCHQMEAIIVFEVVLFLAAIACMLFPFETKGRAMN

SEQ ID NO: 105814 - protein, 287 aa, Triticum aestivum
  Clone ID: PAT_TA_232.pep
ISPGAIRSSLHSANLFDGAAGQETGGSSSHTVNHFRSAIKRKNVAGSLGESSANGSSRNHRQNNDMLLPSLSSHESTANLNMTSVNYGFSYPPMEQLDQNTDTSEDDIFSDPYTLSGHLHENQRFLRNTRMRISANEYEQSLTNLLPEESFRCSAHQPARQQSSFTPVQPRGASSSASSQNRPHVPAVAQFSQSLQRHPSNGNFGSRVGSSADTINPTPASQDPGAARARRSPPAPLLLRPASSAPHSSYRLPAPGSRSNQQNPSSSSTLRAAANVGPQQVPGLNSS

SEQ ID NO: 105815 - protein, 246 aa, Triticum aestivum
  Clone ID: PAT_TA_233.pep
MAMWMSAATRAMRVHARRTPASFLLRDSARPDPNRALLQGQAPAPRWYSGAAAGADPPSIPFPAHLGVATVPDLHVFVVERFGHYHKILPSGVHFLLPVVDRIAYVHSLKEKPIRIPDYPAVTKDNALIQFGGLLHLQISDPFLASYAVDGNPIHAVTQLAETVQMREIGKMTLEQSFEQRDQLDRNIMKSMNDAACEWGVECIKYEFCIQWERSKSLYEVLSTSDDMGGVLSDDKQEPVPHTKQE

SEQ ID NO: 105816 - protein, 92 aa, Triticum aestivum
  Clone ID: PAT_TA_234.pep
GKRRSGIGDVVAVLTGHLAERAVVALLVATGGAGGADDNHASTLAAVLVGRHSGDVVGFGFWCCCFSCGVSWKDCLDVEAGDEKTDEPQPGR

SEQ ID NO: 105817 - protein, 325 aa, Triticum aestivum
  Clone ID: PAT_TA_235.pep
MASSKGSWAALALLLFAAVASTAVNGDHKLSARYYDETCPNVQRVVRAVMAYKVASEPAVAPALLRLFFHDCFVNGCDGSVLLDGTHFSESEKDALPNASLRGFEVIDEIKSVLEHDCPATVSCADVLALASRDAVAMLGGPAWSMPLGRMDSRTADRDAAENLPSPHDNYTSLVSTFRERGLDARDMTALSGAHTVGMASCVNYRARVYGSDGDTNIDPSFAETRRQSCPAGDNEDGGMAPFDEQTPMTFDNAYYKDLIARRGLLSSDQALYGSGGRQDDLVEMYSRDGKKFAKDFAKAMVKMGNIRPSKGTTVEVRLNCKMVN

SEQ ID NO: 105818 - protein, 597 aa, Triticum aestivum
  Clone ID: PAT_TA_236.pep
MSQPAAAAVAAQPQGQAPAGRQGGGLGQSLAGIVRMAVFWYFASKFFGPKRAPTEPGLLMSNLFQKGEPMDMWMYLSENDKFSDFGNEDALIWHETNIPYAVWTPTSTRTHTLTYYPTEALKHNGSLYAHVYFSRSGYPVDPTDPEYEQKSAFGRTHPIVAYLRKSKAGHKKSLLGDSDESEEKLPPKENKESEDKEEGPVEYISYWKPNVTINLVDDFTRYPQNNIPPNVAPYLNVDPTTNSYYPTVFFNEFWLLRDKLTALNETVKELTLNLEVSPISMTKWQLFLQIEQSFQVHRSYGSMLEGEADELKRVFLEGNPYLLGLTMIVSLFHSLFDFLAFKNDIQFWNKNKSMEGLSAKSVVLNFICQLIIFLYLLDNDTSWMILASSGVGVCIEFWKIGKAMHVEIDRSGKMPMLRFRDRESYAQNKTKEYDALAMKYLTYVLLVLMAGFAIYSLKYDKHKSWYSWILSSLTSCVYMFGFIMMCPQLFINYKLKSVAHMPWRQMTYKFLNTIIDDLFAFVIKMPWLHRLSVFRDDVIFLIYLYQRWVYPVDKKRVNEFGFGGEDEPAAPQTLEGAAAAQQIEAKAETSTEDKKTK

SEQ ID NO: 105819 - protein, 140 aa, Triticum aestivum
  unsure (1)..(140): unsure at all Xaa locations
  Clone ID: PAT_TA_237.pep
MSASPEFYXPAPAFSPCRSPLAPRGDVAPRAAGGAGVAGGVDQQAGASEEQCCRTPTGKGSELKQASATCPPAPRKPRAPAAPCRKRLFEVEVFSLRLDELERLFWRPHAPPPPPEKKAKLKRRRVAPPSASPSPGPSKS

SEQ ID NO: 105820 - protein, 226 aa, Triticum aestivum
  unsure (1)..(226): unsure at all Xaa locations
  Clone ID: PAT_TA_238.pep
MGGAVKVYGVGASPFVATVLLCLEETGADYELVPLDMAAREQRTEHHLSRNPFGKIPVLEDGELTLFESRAISRYVLREYAGTRATDLLGESSVEESAMVDVWTEVEAHQYQPAIEHIVQQCVILPFIGGSRDQXLVDESVGELEKVLDVYEARLWTHAYLAGDFFSLADLVHFGITYYLVAGIEYATLLESRANVWAWWGRIMARPSVKKVAPLIHLWLKPSSSA

SEQ ID NO: 105821 - protein, 252 aa, Triticum aestivum
  Clone ID: PAT_TA_239.pep
MADQGAAAPPVTTIVPFNNQQILPACAAACGPLYDANGACVPPQVAADAGPKAYTSCFCLDQRVAAFKTATQGVCDDACGAEGLSSIAGWFRSMCGTATKTNAGSTQQTGQGSTASTAGDSSSTSGSRVSNEGGGDWISNHWQWVIMIVVLVVGITAIWVGACIWRRRYLKKKDRQSHLIQKHSGSASRPSGPGMEASEGGIPYDDESNRNSHGLMLAGAAAAGTVEENPKRRSDGSSATEHDDGHRHHLTL

SEQ ID NO: 105822 - protein, 53 aa, Triticum aestivum
  unsure (1)..(53): unsure at all Xaa locations
  Clone ID: PAT_TA_240.pep
TACXCAVLLSKIVRRVGVXPEVAITIPKRCDLADRPIGYKCGDYTMPSLQLKD

SEQ ID NO: 105823 - protein, 125 aa, Triticum aestivum
  Clone ID: PAT_TA_241.pep
MRYLVSASAAALVLAAVLAAAPRLAGAKDECGATPPDQEALKLVPCVAAGKDPDSKPSDRCCAAVKEIGERSPACLCAVLLSKIVRRVGVKPEVAITIPKRCDLTDRPIGYKCGDYTMPSLQLKD

SEQ ID NO: 105824 - protein, 128 aa, Triticum aestivum
  Clone ID: PAT_TA_242.pep
MGRTTMLLMALALALTAVAHATPPALRRSRFLADKTPPPLSYYDCVRKPPSVCLEPGSPGNTCCKGTCTNTLSSVEHCGNCNRKCKYGDTCCDGKCVDLLKDKKNCGECSNQCANSVKCEFGMCDYAG

SEQ ID NO: 105825 - protein, 139 aa, Triticum aestivum
  Clone ID: PAT_TA_243.pep
MAKCFLLLAFLAFLLPAAYATCHPDDLQAPRGFAGKSNRRTLQQQQPNTITGTNNSVRSGSGNIVSGSGNTVVSGDNNNVSGSNNTVTSGSSNVILDTNHVVIGSNNTVSGNNNRVTGNNNVVSGSNQVVSGDNKVVTG

SEQ ID NO: 105826 - protein, 207 aa, Triticum aestivum
  unsure (1)..(207): unsure at all Xaa locations
  Clone ID: PAT_TA_244.pep
MSLPADFKWGFATASYQIEGAIDKDGRGPANWDTFCAQAGKIADGSSGVTACDSYNRTAEDISLLKSLGSKAYRFSICWSRIIPLGGRNDPINQAGIDHYRKFVDDLLDAGITPFITLFHWDVPDELDRRYGGLMNREEFPLDYERYARVMFEAIPRCKNWITHNEPWCSAILGYSTGSNAPGRCSDRNKSDVGDSSXSPWIVGHNL

SEQ ID NO: 105827 - protein, 225 aa, Triticum aestivum
  Clone ID: PAT_TA_245.pep
MAVMSKLLNFPSLTLAACIEGFFAIKLFPNYYSTQSHLAAVVTILLINYAFGVVFWAVLYPRLFSPLRRIPGPKAYLSAAHHSLVVKGRPSGDLFLDLAKEYPGKDVIMLNSFRNQLCIMNPQLLADLLVHNCYDFAKPKRISGFLRHVLGDGLIIVEGEQHKFLRKNSTPAFHFRHIKELYPMMWTKSETLTKAIAQDITASRSPVVELNGWASKVTLDISALL

SEQ ID NO: 105828 - protein, 110 aa, Triticum aestivum
  Clone ID: PAT_TA_246.pep
TRAKRISLLTFHIQYTPGVLDMDRRQATTCILLLIVLLGNFASAADDDYCWEEYNESALCFGFVCKAECWLNAKLEYAGTKPSVKGYKGTGTKLRHGSPRSEHSWSVRYG

SEQ ID NO: 105829 - protein, 138 aa, Triticum aestivum
  Clone ID: PAT_TA_247.pep
MAAIIKAANAKIRSNPVSDYICSTHFWGPVSNFGIPLAAIMDTQKSPELISGQMTGALIIYAGTFMRYSLAVTPKNYLLFACHFVNAGAQLTQGYRYLNYHYWGGKQSMPKEQLVQAAEAAKGKVEKAAEKVQSAVSK

SEQ ID NO: 105830 - protein, 102 aa, Triticum aestivum
  Clone ID: PAT_TA_248.pep
RPGLGQVYNQKDKRERTLNNFIMALIRINTGVLCLMALLMVSTTLLSSEASGRKIGKEANIGVEGHREPYTPCTDPSFCNDICNRDGYGGGTCRDGHCECIR

SEQ ID NO: 105831 - protein, 301 aa, Triticum aestivum
  unsure (1)..(301): unsure at all Xaa locations
  Clone ID: PAT_TA_249.pep
MIANKLTIVTAAAALLEPALALGHRHGHQHKRGDTVVATIDGQVVSWENNYYGPGGAAPAATQVASKPEAPAAPAPAPAQPTTIIKVAKPSQAAKAAYEAPKAKEFKEAAAPKKAEKVEQVKQVKAASAPKKTKPSSGGSSGSAGLSHKRGVCYNNVDLANTFYKDCSNCGWGYNWDSESGGLDSGLNFIPTLWSDDAVHVDRFASNCAKSLANGAKAIFSFXEPDNGGQAHMTPEAAAAAHIKYLNPYAGKALIGAPSISNSGLAGEGREWLSAFVEACGDKCHFDFCNIHWYSEVEYGE

SEQ ID NO: 105832 - protein, 258 aa, Triticum aestivum
  Clone ID: PAT_TA_250.pep
MLSRAARPALRAAVAANARATAVPSTAATYATLREIEDRLKSIRNIEKITNTMKIVASTKLNRAQRAMNNSRTYGQTSNEVYESAETKALETEEKKTLIIVCSSDKGLCGGIHSGLSRYIRRLSANGEKFDLVLVGEKAKAQLSRTNAKSIQLTFAGIGKDVPTFADAQAIADQVIQLPTEYTDVKILYNAFVNAQTYEASLIEAFSEEAIQQSPNFSAFEVDDEVLGSLREYGLANSLYWALAEGHACEQSARRNAM

SEQ ID NO: 105833 - protein, 162 aa, Triticum aestivum
  Clone ID: PAT_TA_251.pep
MEGRMFGLETPLMTALQHLLDVPDGESGGAGNAGGERQGPTRAYVRDARAMAATPADVKELPGAYAFVVDMPGLGSGDIKVQVEDERVLVISGERRREEKEDARYLRMERRMGKLMRKFVLPENADMEKISAVCRDGVLTVSLEKLPPPETKKPKTIQVQVA

SEQ ID NO: 105834 - protein, 180 aa, Triticum aestivum
  unsure (1)..(180): unsure at all Xaa locations
  Clone ID: PAT_TA_252.pep
MAWALLGLGASGSLTVGDGAGGAPGTLRRASAFTSQPELAPTFAPCGAPGATTAGPWSPPSPPSPRSPLLPSPPPPRPPPPTSMPPDPCPGPTTAPPAXPPAAPSPRGRWPPSGARGGRRRAPGPAARGRRPPPRGPXARPAVPGGRDGGVPPERPARPTPPPDLALGPSHRAALRWSAC

SEQ ID NO: 105835 - protein, 239 aa, Triticum aestivum
  Clone ID: PAT_TA_253.pep
MSSEQLVLFDLPSKDGGAWSLNPWKTRFLLNFKGIDYKTEWLEYPDIKATLESHISANPATGTWTIPTVKFPDGTYIMDSAKILERIEKDYPEPSVHKDSPVLTKLFEIMPNIMGALRPIYFTHVPKHILNENSVPYWHETRTETAGEPLDELYKRDGGKAWDKAKPHVQDVEALLKENSEGPFFLGKTPSYADFVWGGFLIFMQRNQVIDEVYKISGDAQLHKDLLEALAPWHKRNNH

SEQ ID NO: 105836 - protein, 264 aa, Triticum aestivum
  Clone ID: PAT_TA_254.pep
MLQLRMIIPRLRPTQLASLTRQATPIQSSALPRSFRRSLQKSLQQAQLRCYAAKPTAAPTKSTKIEDELKRQARAVAKGGKEFELPEKLIIYHGGTGRITFMAMLKITTLFLGAFFCFIVAPSYVKAEKPEWVTASIVLCGIVPIFFVAYITSPFVTHIHIHIPPYARTSRALLERFVKALPPSTPLTLTTMSAISKPRYSSIQAGDLSPVRRRLGLINYVRDTKEENAKRSWYMFRAVGKFYIQDKKPQARVRYQKKTDKVDG

SEQ ID NO: 105837 - protein, 483 aa, Triticum aestivum
  unsure (1)..(483): unsure at all Xaa locations
  Clone ID: PAT_TA_255.pep
GCRQSGDPVTQPEPVGKGDGYAYLSGLGNSFTSEAVPGALPADGHNSPLLCPLGLYAEQLSGTSFTTPRHRNLRTWMYRIKPSVTHDPFHPRXDPPNPRLLADFHDPRAALATPTQLRWRPADLPPPDGPPELDFIDGLYTVCGAGSSFLRHGFAVHMYAANKSMDGCAFCNADGDFLIVPQQGKLLITTECGKMLVPPGEIVVIPQGFRFAVDLPDGPSRGYVSEIFGAHFQLPDLPPFGANGLASPRDSLHPTRWCEQAHRTGGVYEAKSRWLPPPTPQAAQLLDAPAGRGTYVPDKSVRSLGCPEDNVPLGLGGPLAFMFESALIPRVVPLGPRVAVPPPRWLPAVDTVRPPFFHRHCWRVTDRRIQGVYEAKADGFLPGXASLRSCMTPHGPDTKTYEATISKLGGPEANTPTRLSGSRALVFEPALIPRGCRWALESPSRDLDYYQCSIGLKSHFAHGIDGGYDGPATTGGDDKDGEK

SEQ ID NO: 105838 - protein, 264 aa, Triticum aestivum
  Clone ID: PAT_TA_256.pep
MHSKTLGVVLGSAALANAANLFVADYGGNLSTLKLTEAQNGYNLAVSSVSRDCQPGPSWLTLDKKNNVLYCLDRGGQTGSLNSFTIGNNGALKTVARVKAPSGGVAGEIITGNKGKRGYFSAAYDSGTAAVFAVGEQGALPGTEQLQQVSSKIDKIGPIPSRQEAAHLHHVIIDPTGKYVITPDLGGDVCRVWSFDKDKLAPIAEVGALKAPAGSGPRHGFFKVMKSGETFFIFNGELDQKVYSYRVTYTRMGLSFHKVFEIHL

SEQ ID NO: 105839 - protein, 216 aa, Triticum aestivum
  Clone ID: PAT_TA_257.pep
MALARRSPTSLLVIAAVLSVHGLLPAPAAATGKTGQLTVFWGRNKDEGSLREACDAGLYTAVIMSFLNVYGHGKYRLDLSGHPLAGIGDDIRHCQSMGVTVSLSIGGFGGDYALPTNRSALDLADHLWFSYLGGRRRGVRRPFGRARLDGVDLFLERGGPAEHYDALARELARRKARGGKAPRLTATPRYAFPDRLAAPALSTGVFERIHARVYEY

SEQ ID NO: 105840 - protein, 234 aa, Triticum aestivum
  Clone ID: PAT_TA_258.pep
PPLHHIQTAHIPHWTLIFIMRGIQITEYLKGPDQLQVTDLPDPKPSDDQYLIQVHAAAANFFDILQIQGKYQNQPPFPWVAGAEFAGTVIATPTDGPKPKFPVGSRVFGASQGAFATKICAIEDTLLPVPDGWSFKEAAGLFVTAPTSYGALVVRAGIKKGDYVLVHAAAGGVGLAAVQVAKAFGATVIATASTQHKLDIAKSYGADHVISYNDASWPSQVKKLTPDSRGVDIV

SEQ ID NO: 105841 - protein, 242 aa, Triticum aestivum
  Clone ID: PAT_TA_259.pep
MKTTSYVSALLGLASAVSAHYTFDKLTLSGQQEGTDNQYIRKHQNGYMPTKFKGIPDGSISPNDKDFTCNKGSTASPDVFKVKAGDEIGLKQAFGGTGMQHPGPIQVYAAKIDDATKADPSNLDWYKIHQALVCKAGTPEQLRGPSWCSWDEDSVHFKIPSTLPDGQYLVRGEHIALHGAHGGEAEFYYACAQLEISGNSASSIPGTSVKIPGVYKQDDPAVNFSLWGSSTGYDVIPGPDVI

SEQ ID NO: 105842 - protein, 182 aa, Triticum aestivum
  Clone ID: PAT_TA_260.pep
AGRASDSHSLTLTNKQTITITTYTQTTSPNTQSMPYLSSGNNYLFSPYTSQNHATMAPSVYILLQRDTESTVIISSVYLDLQDANAALLHLAQEAGIDPATAKPTADAGSEQPSLVKEPLLWEAADGTAAWVERHAVTNRKTHASGSAGAADKPGLKRNDSRLYVNDDDDVIEVTDHDGHYD

SEQ ID NO: 105843 - protein, 284 aa, Triticum aestivum
  Clone ID: PAT_TA_261.pep
RPVRELLFNCTAKNDRLKAPLPADHIGSLIRPEALSRTQEQADAGQVSAEQLVATQKAAIADIVKKQQEHGVRAISSGEFDRKYYFGGFFERLGGFKEYEPVPWDLVRLSAPPIAALKKAGKQYPMAAICESKIEYKQSPYLENWKMLRECVPREQWAECKFTMPPPCYFHLRLASGKCYSPEAYSNDEDFFADLAKAYRQEFQTLYAEGVRNIQIDDPTLAYFCSDEMLQSLRDEGVDPDKLFDTYLKAHNDAIADRPEGLHVGLHVCRGNFSKSMHFSEGSY

SEQ ID NO: 105844 - protein, 178 aa, Triticum aestivum
  unsure (1)..(178): unsure at all Xaa locations
  Clone ID: PAT_TA_262.pep
MMDDYVSESDSDYTSYWRDWFISSRGNEYFCEIDEDYLTDRFNLTGLNTEVQYYQYALDLVTDVFDLECDDEMREAIEKSARHLYGLVHARYIVTTRGLSKMLDKYKKAEFGKCPRVMCHSHPLLPMXLSDVPNLKPVKLYCARCEDIYNPKSSRHAAIDGAYFGTSFHNIXFQVYPA

SEQ ID NO: 105845 - protein, 349 aa, Triticum aestivum
  unsure (1)..(349): unsure at all Xaa locations
  Clone ID: PAT_TA_263.pep
MNSGDAAGSSSGGSGDAGAPRRASRKPKYSKFTQQELPACKPILTPKWVISVFLLVGVIFVPIGVASLLASNKVVEIVDRYDDACVPSNVTDKLAYIQNSTISKTCQRTLKVPKDMKQPIFVYYQLNNFYQNHRRYVKSRNDQQLRDASKANETTLCDPEKTRDGMAIVPCGLIAWSTFNDTYTFQHNTNNLTIDKTDISWKSDRDHKFGSDVFPKNFQERSLLXVGKTLNESIPLSEQEDLVRPPRPAALPTFRKLYGRIRVDLKENDTITVTLDNNYNTYSFDGKKSLVLSTSTWLGGKNDFLGLAYLTVGGLCFFLAFAFTLLYLIKPRKLGDNNYLSWNRNSAGH

SEQ ID NO: 105846 - protein, 111 aa, Triticum aestivum
  Clone ID: PAT_TA_264.pep
LYDTTFICLSVATLAGFDHYAGFCQLCRADAVAIKNSLERYQEIDFLFSGTREYKLIAELAASMDDGDIAKFTDAIKEFDGMTRLDPWKTTLLLRAKNELKKQEDDEDDLT

SEQ ID NO: 105847 - protein, 293 aa, Triticum aestivum
  unsure (1)..(293): unsure at all Xaa locations
  Clone ID: PAT_TA_265.pep
MGDHEARGDDXERKADKKLSGWGLFXGSKYEDAADLYDKAANFFKLSKNWNRAASVYIKIXNCHLKXDSKHEAASAYVEAANCYKKFSPQEAAQALDQAVNLFLXQIGRLSMAARYCKDIGEIYQQRIRKKRRLHVYLASDLFDIEEXNNSIXTPISRKLQEVEIAAKWEQYPKATEIFEEIARQSINNNLLKYSVRGILLNAGICQLCRADAVAIQNSLERYQEIDPTFSGTREYKLLADLAASMDDGDVAKFTDAIKEFDGMTRLDPWKTTLLLRAKNELKKQEDDEDDLT

SEQ ID NO: 105848 - protein, 84 aa, Triticum aestivum
  unsure (1)..(84): unsure at all Xaa locations
  Clone ID: PAT_TA_266.pep
ATRRTRGTRYYYDVETDKYGYGXESNPVRTAPPRARGQRLRVRPAPGRQRSYGEAAGYENDNGVAEKQNDDGGVQENQNGQYNP

SEQ ID NO: 105849 - protein, 196 aa, Triticum aestivum
  Clone ID: PAT_TA_267.pep
ALPAKSSAMASSSKPCAASVLLLLLALAVATAADAAKKSIASEPKHIFSRPSGPIISRPAAKDIIASEPTIPRPAAVDVSATCMGSLLELSPCLAFFRDAGNVQGRRRGAAKGLGSRIVRRPGRRACCHIFNHTLGSGPSGVGIPVNRALALIRDVLRPHAAQGCQLRQRRSPCRRWTCARRHRPDLCLSTSKCVS

SEQ ID NO: 105850 - protein, 212 aa, Triticum aestivum
  Clone ID: PAT_TA_268.pep
PGGEGRHCKATQATAISHVSAPPVLHYLPCSHRQCTRVSGAISFLSTSSLKLQAVCSEPKVNPSSSSSSGATVPFRHGPGPCSPAPEGKCLTFEVLRRRPRFRAGYVQRQFSTNQPGGGLQQSEELKVPNELGSSLDTLVYIIIVGVGSPGVQMTWTRDTCSYVSGMHSNAVSPAAATPFDPAKSAPYAAFPCGNPACTCIMSVGNACSNSQ

SEQ ID NO: 105851 - protein, 231 aa, Triticum aestivum
  Clone ID: PAT_TA_269.pep
MKLDPSQLTAFLAANSTGVGVLVCPGGGYSMMARGHEGHDPARYLNTLGIDAWVLEYTTASNMTPPLYPKPMEEALGALDLIRQEAPDLKKLGIWGFSAGGHLAGNTLTNPTTNLDFGILGYPVITLEDDYTHENSRYNLLGNNPTKQQIDELSVQKRVSDKTPPTFLFHTSNDGLVPVQNTYLYAEAMAKHGRLAHVVVLPDGPHGIGLAQNDPVRDWTPELKRFLTYSI

SEQ ID NO: 105852 - protein, 247 aa, Triticum aestivum
  Clone ID: PAT_TA_270.pep
MHISLSLLCTAALAAAHGYVETATIGGQTYQFYNPYQDPYMNPLPKRISRAIPGNGPVEDVTSIDMQCNGYTAGGIKGSQPAALHAEAAAGSTVNLKWTLWPDSHVGPVLTYMARCPDSGCDAWMPGTEKVWFKIQEAGRDGTSNNWASSVIMKAGNSGVNYTIPQCIKPGYYLVRHENIALHSAYGYPGAQFYPGCHQLKVTGSGSTTPSNLVAFPGAYASSDPGGTYNAYQAATYKIPGPAVFKC

SEQ ID NO: 105853 - protein, 270 aa, Triticum aestivum
  unsure (1)..(270): unsure at all Xaa locations
  Clone ID: PAT_TA_271.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGRTITLEVESSDTIDNVKAKIQDKEGIPPDQQRLIFAGKQLEDGSTLADYNIQDDAALXLISQATLTGKTITLEAESXSDTIDNVKAKIQDKEGIXPPDQQXFIFAGKQ

SEQ ID NO: 105854 - protein, 138 aa, Triticum aestivum
  Clone ID: PAT_TA_272.pep
MSFSTVFRRAAVAPAFSARAFSTTAARPLAKITIVGNLADTPEVQPTSNGRDIVRYSIASNSGNRENRKTSWFRLTSFAEGPSRDYLMSLPKGATVYVEGDATMRSYTDASGQNRTSLSIVQRQIEVLRRPQAPEQGE

SEQ ID NO: 105855 - protein, 347 aa, Triticum aestivum
  unsure (1)..(347): unsure at all Xaa locations
  Clone ID: PAT_TA_273.pep
PEPGSRAAVRRRAEAGVRARAMDVDSVECLSLPDAAMDADDVGLALHPHGGILAAAAPARXAYPKAGAGAGGIVAPGSSVHELLECPVCTNSMYPPIHQCQNGHTLCSTCKARVHNRCPTCRQELGDIRCLALEKVAESLELPCKHYSLGCPEIFPYYSKIKHEAMCSFRPYSCPYAGSECSVTGDIPYLVNHLRDDHKVDMHSGCTFNHRYVKSNPREVENATWMLTVFHCFGQYFCLHFEAFQLGMAPVYMAFLRFMGDENEARNYSYSLEVGANGRKMVWEGTPRSVRDSHRKVRDSHDGLLIQRNMALFFSGGDRKELKLRITGRIWKETQTPDGACVPVLCS

SEQ ID NO: 105856 - protein, 382 aa, Triticum aestivum
  unsure (1)..(382): unsure at all Xaa locations
  Clone ID: PAT_TA_274.pep
MASISKLLLLLLCTYHTLVAHAGDDLRSYKPVGSPESATVNCSQPKAATPSSGGVTVPLHHRHGPCSRLPSTKAPTWEEILRHDQLRAAYVTRKFSGVKGGAGDVEQSDVTVPTTXLGTSMGTLEYVINVGIGSPAVTQXMSIDTGSDVSXWVQCKPCFQVPVPWRTRSFAPSSSRTYSPFLXNSGAPAQVSQAGQGNGCSGSQCQYIVTYGDQSSTAGTYSSDTLVLGSTAVKNFQFGCSQSNSGLLLTQQTAGLMGLGGGAESLVSQTAGTLGRAFSYCLPPNPGSRGFLTLGAPTSTSGFVTTPMYRNRRAPTFYAVRLQAIRVGGKELNIPPXVFSAVSIVESGTYQRVPPTPIRAGSPFRRLTGPNPAPQVLQYGIK

SEQ ID NO: 105857 - protein, 270 aa, Triticum aestivum
  unsure (1)..(270): unsure at all Xaa locations
  Clone ID: PAT_TA_275.pep
MYRAIATASALIAAVRAQQVCSLTQESKPSLNWSKCTSSGCSNVKGSVTIDANWRWTHQVSGSTNCYTGNKWDTSVCTSGKVCAEKCCLDGADYASTYGITSSGDQLSLSFVTKGPYSTNIGSRTYLMEDENTYQMFQLLGNEFTFDVDVSNIGCGLNGALYFVSMDADGGKAKYPGNKAGAKYGTGYCDAQCPRDVKFINGQANSDGWQPSDSDVNGGIGNLGTCCPEMDIWXEANSISTAYTPHPCTKLTQHSCTGDSCGGNYSXRRY

SEQ ID NO: 105858 - protein, 133 aa, Triticum aestivum
  Clone ID: PAT_TA_276.pep
AGRAGTPTVSHFNFNYLLLLYSSKCLPSSTLLLLWLPSWPSPALRPLLYPAPQSAPPLEKLASNPRLSTTSSPALPTSRRRRLASTSRHTTTPPKSSSFSFSRISLQTPRTAASAGPRASDRSAPLSSRAAML

SEQ ID NO: 105859 - protein, 270 aa, Triticum aestivum
  unsure (1)..(270): unsure at all Xaa locations
  Clone ID: PAT_TA_277.pep
MVNVPNIKLNSGFDMPQIGFGLWKVDDNCAEVVYNAIKAGYRLLDGACDYGNEKACGEGVARAIKEGIVKREDLFIVSKLWQTYHDKKNVEPITRRQLADWQIDYFDLFLIHFPVALEYVDPEVRYPPGWHYDDAGTEIRWSKATNQETWEGMEDLVEKGLAKSIGISNFQAQGIYDMLKYAKIRPATLQVELHPYHQQSELVSLAKAEGIALTAYSSFGPTGFIELDMDIAKSASPLMQHEVFTXLASKYNKTFRPVLLRWATQQGLAV

SEQ ID NO: 105860 - protein, 259 aa, Triticum aestivum
  Clone ID: PAT_TA_278.pep
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGTPSST

SEQ ID NO: 105861 - protein, 90 aa, Triticum aestivum
  Clone ID: PAT_TA_279.pep
EKNPSSEGVQANQDQNLSRLCDGSHLICEPTSAPARTPFPAPRRRRTTSPSSPAARGPATAPARTPGSPPWAPQWAWSRAGTGATTGTAT

SEQ ID NO: 105862 - protein, 196 aa, Triticum aestivum
  Clone ID: PAT_TA_280.pep
MNTNSPPHRRGPWSQQEDHHLMTLVHEHGPLNWVRIAQSLSSRTPKQCRERFHQNLKPTLNHEPISPEEGALIEQLVAQIGKRWAEIARRLHGRSDNAVKNWWNGSQNRRLRSDRRRATQGHDDFYSANRHGLTISTTPCHQIPGSHLSPISGPITRHPVGSWVEAPLPSPCSSESAESETGSNYTTSPGHHSVNL

SEQ ID NO: 105863 - protein, 223 aa, Triticum aestivum
  unsure (1)..(223): unsure at all Xaa locations
  Clone ID: PAT_TA_281.pep
MTLYYTLVFMLLVFEMGMFVLLIFPMPFGVRRKIFTFISENPVVAKIQYWMKITFIFILILFVDSVNRVYRVQLELAAASEQAKHGGGAAVMGHERLEVQARKFYSQRNMYLCGFTLFLSLILNRTYVMIIEVMRLEDKVRSYEGTKDNTKEAEKLAAAGKPGELARLRKELELKGQDLKTXQKQSEQLPQSYDELSDXYAATQQTGGGQEGHLRVYHDTLLL

SEQ ID NO: 105864 - protein, 147 aa, Triticum aestivum
  unsure (1)..(147): unsure at all Xaa locations
  Clone ID: PAT_TA_282.pep
MRRPSASSPPARGPVLAAAAAVVLLPAIFPALFSPLGRAFPSLFSEWNAPKPMHKSLLNASLRWTIPDEQKREIWTPLPDQGWKPCIRSSITRGLPSEPSGYIQVFLDGGLNQQRMGICDAVAVAKILNATLGIPHLEXNPVWKDSS

SEQ ID NO: 105865 - protein, 267 aa, Triticum aestivum
  Clone ID: PAT_TA_283.pep
TAYATKMLERAGMKDCHAVHAPMEARLKLSKDSSEKAVDATLYRSIIGSLRYLVHTRPDITFIVGYLSRFMEAPASDHLAAVKHLLRYIAGTLTHGCVYHRGDGESLVGYSDSDHAGDVDSRKSTSGILFLLGNSPVSWQSVRQKVVVVSSCEAEYIAAATAACQGIWLACLLGEMLNQDTAPALIFVDNKSAISLCKNPVLHDRSKHIDLRYHFIRDCVEKGSVIVEFIRTGEQKADILTKSLGRVRFQELRDKVGIIDTKLLLQG

SEQ ID NO: 105866 - protein, 180 aa, Triticum aestivum
  Clone ID: PAT_TA_284.pep
VVLLNPLSSSARTEQDCMYKDCYRDSENKHDEQTHIQANSGESSCNSSFTRDPSLDLKDLLTELNSGATGASVHRRFAGETERSRRRPWRTSSIYRWMESVPHVGPSISSARHRIPAAARDPRMPCGNHHPIQKRQRGTPRTASVFVSVDLSGVAAYSGLVRRRTCGRRPCRACGASGPC

SEQ ID NO: 105867 - protein, 284 aa, Triticum aestivum
  Clone ID: PAT_TA_285.pep
MVYGGEEALRRQYSIGDEIGHGRFGTVRRCHSNATGEALALKTTPKAPLRDALDLALAEQEPKLHLLASSPPCSPHLVALHAAFDDADAVHLVVDLCAGGDLLSLLSARGGRLPEREAAGLAAQLASALAACHRRGVAHRDVKPDNLLFDAATGALKLADFGSAEWFGDGRRMSGIVGTPYYVAPEVVAGREYGEKVDVWSAGVVLYMTLSGAVPFYGATAPEIFEAVLRGNVRFPPRAFAGVSPEAKDLMRRMLCKDVSRRLSAEQVLRHPWSASCGGNAVPG

SEQ ID NO: 105868 - protein, 155 aa, Triticum aestivum
  Clone ID: PAT_TA_286.pep
MIIYKDFLTGDEMMSDSYPIKEVDDVIFEVDCDAIYPESVAGDDEPVEFNNVIYSFRLQPTTYDKKTYVSSLRSYLKIVKNRLKKIGKNPEYIANFEKNAQDFLKTKLLPNFDDLEFYTGESMDLDGMIAVMGYREDGTTPYFMFWKDGLKEMRI

SEQ ID NO: 105869 - protein, 281 aa, Triticum aestivum
  unsure (1)..(281): unsure at all Xaa locations
  Clone ID: PAT_TA_287.pep
MSSYLEKQANAFRGTLSSAATKISNPSTNKAASLAVPSSLAPSSPSPSAASDPNTPTTKRKRDAAPDVPYSQPQLTGYGAEVKTQMTFAVEYLKKKGDTKTITEIIDHLSLRGYDEEHKRQLAEGLRGHPRVDWKPDANLSEQTWKTGTYAHRPIIPGVKNATTLLGHLQAKTDASGVSVKDLKDGWPDCEDTISALEREYKILVVRTKKDNLPRYVWPNDASLHYKVQPEFQSMWQRVQLPPIDEMHRXLTSVGQKPTSEDPRKTKDGQATSPRCRSDAR

SEQ ID NO: 105870 - protein, 118 aa, Triticum aestivum
  Clone ID: PAT_TA_288.pep
MLEFKHYAAGSRRRPGDHFKIQWRKNEDFPYGFYYGVVGHLEPCNANEHLCRCHEDDTIMLELKHYAAGSRWRQTTVSRKDHREKGDETDGFYGGIRKLQTKDEISTWRRFWPVDVLS

SEQ ID NO: 105871 - protein, 104 aa, Triticum aestivum
  Clone ID: PAT_TA_289.pep
MSLASRILSSSSRALASRTFSTSARRMADASPLPARKPLGAFRGGLFGFLLGSFLSGSAAYSYLLKEYKTANDLLTEDIYTLQASITRLSNHVQALETRMQGKK

SEQ ID NO: 105872 - protein, 227 aa, Triticum aestivum
  unsure (1)..(227): unsure at all Xaa locations
  Clone ID: PAT_TA_290.pep
QCPTRPPPPFFARSNPPTPSSPSPLPAPARKSPSSRRXSASSRPRSRRPLPPPRPRRRRRRRLPPRPSPSPPSPRRPRRSTTASSPRSGPPRCPSPGSTGLASPRPPRAAPAPATSPVPRRYPSRRRSSPTTRWSPSTPSAPTARTPSSLRRQGSASSSGGGRAEPTPVVHEVARLPRRLRPATAPAPVLALGLAGEPASTNTYCRGLVCVFRPVRILRSDWVCVCP

SEQ ID NO: 105873 - protein, 88 aa, Triticum aestivum
  Clone ID: PAT_TA_291.pep
SSLKVLQIQSLKKLEAGVVGDYHGSGLSGQHIAAQRPRRARPDEERYDRHHHDHRGNELRSHHHHILNSGQFTQTNFANSAMRRYSLA

SEQ ID NO: 105874 - protein, 200 aa, Triticum aestivum
  unsure (1)..(200): unsure at all Xaa locations
  Clone ID: PAT_TA_292.pep
MASPVASAALKARVRNPALLKKLARPEDLMHHFPNGSYIGWSGFTAVGYPKKVPAAMADYVEQNNLQSKMKYSLFVGASAGSETENRWAALDMINRRSPHQVGKDIAKGINSGRINFFDKHLSMFPSDLVYGFYTKDRQNSNLDVTVVEATDILEDGSFVPDPPVQRTPELMQTHXFIIEVNTAIPSFKVSRYTFTTSLP

SEQ ID NO: 105875 - protein, 165 aa, Triticum aestivum
  Clone ID: PAT_TA_293.pep
MEPTTTNMSIGTKTEISASNFETDVESVRAEPSFRLYRLIDSARLGLTVLALAAGLTILGLSADTIAVYHATYVPEDWFLQLWPSNFDMGPSIALVVGGALVVVANLVSLIADKIQTVRGNAVIKAVITFTPPAIALIAAIISMSYFYGVNASTTNDSLQSWTCR

SEQ ID NO: 105876 - protein, 112 aa, Triticum aestivum
  Clone ID: PAT_TA_294.pep
QKHQCIFVYAYVCSMCKRENPIAVAPKLLVFFLLSNENRKKGGITEETRIEREDCHHKLLHQDLNRPNLFSTVCYVFCCAFSYHHTIFTRILVNISPRHNLYRSHVENPALR

SEQ ID NO: 105877 - protein, 453 aa, Triticum aestivum
  Clone ID: PAT_TA_295.pep
MMSAKLGAATPSVLLPPSPRLHGVRPSPTAASCLPDTGTGPPLSAGPDQEHSGAPGQEEAAVSSPSQPRSRASSQLSRWSRARALRSGRRLELPAIRASAALSVRTKSPPPTEQEAAATEDDDDGDEAVGVGSEAAGNSIYMVSDGTGSTLEHSVNAVLGQFEHCLVDRRCATSTHLFSGIDDMDNLIEIVRQAAKEGALLLYTLADPSMAEATKKACDLWGVPSTDVLRPTIDAIASHIGVAPSGISRSSASRKGQLSEDYFQRIEAIDFTIKQDDGAQPQNLARAHIVLVGVSRTGKTPLSIYLAQKGYKVANVPIVMGIDLPKALFEIDQDKIFGLTINPVVLQAIRKTRASTLGFHGQKSNYAEMEHVRQELDHANQIFVRHPTWPVIQVTGKAVEETAAVIVRIYHDRKQKCSMPRISKRVAPIRVYDSLSEKVNTPVEPEKVLAMDV

SEQ ID NO: 105878 - protein, 204 aa, Triticum aestivum
  Clone ID: PAT_TA_296.pep
MARRQHLTLTFILVLGVFFTLSYFFSGPTRSVLLPKLQNDVELPLKDASRSEFVADLNAMPAGLLQGESIAPKLENATLKAELGHATWKFLHTMMSRFPDKPTKDDRMALETFMHLFARLYPCGQCAEHFRKLLAQYPPQTSSRNAAAGWLCFAHNIVNERVHKPLFDCENIGDFYDCGCGDKDKKGGVEGVAGEGPDQELHKH

SEQ ID NO: 105879 - protein, 306 aa, Triticum aestivum
  Clone ID: PAT_TA_297.pep
MEGWLTLCFIAVSTLVAVWFSGGKSKPKKHLPPGPWTLPVIGSLHHVLSVLPHRTITELCRRHGPLMLLKLGEVPTVVVSSAEAVEQVMKTNDIAFSYRRTTELQDIVGFGGKGIIFAPYDNRWRQMRKVCIMELLNSKQVKRMEDIRAEEVGRLLRSIITATAVGATVNISQKAAALSNAVVTRAVFGGKFARQEEYLREINQLLELLGGFCLVDLFPSSRLVRWFSTCERRTKKSCDLIQHIITGVLDERKVVRAAGDGACSTDDEDLLDVLLRLQEEDSLAYPLTTENITTVLFVSIFHSVIS

SEQ ID NO: 105880 - protein, 108 aa, Triticum aestivum
  unsure (1)..(108): unsure at all Xaa locations
  Clone ID: PAT_TA_298.pep
PTIXGIARVLRARRVPPRESXVRCAPTRDRASSADATVLFRQRNXRLLAAGARGSRRGSTGCGSSRRSSRRTAEDSGSSSRRPGGSQPTLFIRGFFPTALFMRFARRG

SEQ ID NO: 105881 - protein, 265 aa, Triticum aestivum
  Clone ID: PAT_TA_299.pep
MAPPISADVVVEAAPAPASMAVLNQMVCASAPAPIITVVSKQLVLPEGASPVGDLKLPVSDMPMLSCHYIQKGLFFPPAGMPNARLVSSLALSLSRALGVFPALAGRLVTLPDDRIVIRCDDGAAVEFYHAVAPALSLADFLVRDADVPTRLTKDLFPMDRTVSYEGHRRPLTSFQVTVLGDGAVFVGLVANHAVVDGTSFWHFFNTWAGLCRGEPVQPPDFSRNFFGGSTAVLRFSGRDGPAVTFDASAPLRERVINFSAASIR

SEQ ID NO: 105882 - protein, 75 aa, Triticum aestivum
  Clone ID: PAT_TA_300.pep
LALLVHLMLLLMASFSRTATFSRAPMNNGLCCFVHHRRLSLSSCCTQARGQDYLLPHESSGLLVLLVLPGLRPGR

SEQ ID NO: 105883 - protein, 225 aa, Triticum aestivum
  Clone ID: PAT_TA_301.pep
WEFWAVCRRGEGEVEEDVEKYAEQLLVLAHAYRVPWLKLWCQEAIGSRLTPGTVVDALQLADLCDAPQLHLRCMRLLAKEFRAVERTEAWRFLRDNDPWQELDVLRQLHDADMRRRKWRRKRAEQKVYMELSDAMDILRHICTEGCTEVGPVGQAPTKSPCPAYATCRGLQLLIRHFSRCQSRATCPRCQRMWQLLRLHAALCRVPDGHCNTPLCTQFKLKENQK

SEQ ID NO: 105884 - protein, 214 aa, Triticum aestivum
  unsure (1)..(214): unsure at all Xaa locations
  Clone ID: PAT_TA_302.pep
MSMDHALACASSLVPCQEVVEEPLLNSLLSIKQGLNMFIIEDKGGAIAIMCASLFFLGTWPAVLTLLERRGRLPQHTYLDYSITNLLAAVLIALTFGQLGDAKHNMPNFFTQLSQDNWPSVMFAMAGGVVLSVGNLSTQYAWAYVGLSVTEVISSSMVVVIGTTLNYFLDNRINKAEILFTGVACFLVAVILGSAVHASNAADNEXKLSESTNT

SEQ ID NO: 105885 - protein, 231 aa, Triticum aestivum
  Clone ID: PAT_TA_303.pep
MKFSIAAALLAATASALPTAQDSALEARQLGGSTRNDLKNGNSGSCPGVIFVFARGSTELGNLGTLGPRVASALESKYGRNGVWIQGVGGAYTAGVGENALPRGTTTAAIREMVGHFNDANQKCPNAVIVAGGYSQGAALAAAAVTDVDAGIREKIAGTVLFGYTKNLQNRGKIPSYPEDRTKVFCNVGDLVCSGTLIVAGPHLLYQTDASGAAPRFLIQKADAALGAAKA

SEQ ID NO: 105886 - protein, 483 aa, Triticum aestivum
  Clone ID: PAT_TA_304.pep
MDATKRQQQQHDEEALSNSSPPASSSWASTSSSSCLPGSGDTDRAPLLPCKMADDEKVDRLDVSDDTAHQISVDPWYQVGFVLTTGVNSAYVLGYSGSIMVPLGWIGGTCGLILAAAISMYANALLGRLHEVGGKRHIRYRDLAGHIYGRKMYALTWALQYINLFMINTGFIILAGQALKAIYVLFRDDGLLKLPYCIALSGFVCALFAFGIPYLSALRIWLGFSTVFSLIYIVIAFVLSLRDGITAPAKDYSIPGSESTRVFTTIGAVANLVFAYNTGMLPEIQATIRPPVVKNMEKALWFQFTVGSLPLYAVTFMGYWAYGSSTSSYLLNSVHGPAWIKVVANLSAFLQTVIALHIFASPMYEYLDTRFGSGHGGPFAIHNVVFRVGVRGGYLAVNTLVAAMLPFLGDFMSLTGALSTFPLTFVLANHMYLMVKGPKLSAFQKGWHWLNVVGFSLLSVTAAAAALRLIILDSSTYHLFADM

SEQ ID NO: 105887 - protein, 106 aa, Triticum aestivum
  Clone ID: PAT_TA_305.pep
RRFKLSSLEPCFGSGPSKIEKKKKKKKTLRVLLEAVGMDESIVEVLGVALDVIPETHGVALQPQHGPPHPPVELPHGRWRLPPQPRPAVALPFRHIPAANASRHTQ

SEQ ID NO: 105888 - protein, 275 aa, Triticum aestivum
  unsure (1)..(275): unsure at all Xaa locations
  Clone ID: PAT_TA_306.pep
MGRGRGGRNRKPRNSATFRLCPRPGAADPSDRVLVRVDGNQYHVPGLDDDDDACYFEGALGDDGAEPSSSPSGAALPDHVRRAILELGLPDDGYNYLAHIREIRPSYSSTGGAGGSSRPWFPPHPPRRALRPPAEXFKAYDARGVDVGLDNVAAAGALIPVEEAIDPDVTDLLEESDVPPETSEDENEDEESEVPPGIVEDDNEESEGPSETSENEDSELEDDFVIIANQPEQEDQMDLEDDFVILANQPDGEEQMDMMGGRLARGSFAAALWAC

SEQ ID NO: 105889 - protein, 274 aa, Triticum aestivum
  Clone ID: PAT_TA_307.pep
MDMCMGMAKLLLLLLLVVTAGHGHAAAAAGKERNTITHVKGFDGPLPFALETGYVEVDEAHGAELFYYFIQSERSPREDPLILWITGGPGCSALSGLLFEIGPLKFDVAGYTEGFPRLVYFEDSWTRVSNVIFLDAPVGTGFSYAREEEGLDVSLTGTGTHLRVFLQRWIADHPEFASNPLYIGGDSYSGYTVPVAALEIADQPDKAGLNLKGYLVGNAGTDDKYDSGGKIPFMHGMGLISDELYEAAKGSCGGDFVTTPRNAQCANALMAITM

SEQ ID NO: 105890 - protein, 292 aa, Triticum aestivum
  Clone ID: PAT_TA_308.pep
PTRPHTQPQRQATRAVLPHAQSRPTSPPYRRASQKPRSPSARRRNARLIALVMAPPQERDYIGLSPAAAAAATELRLGLPGTEDAAGDGGGAASEAPLTLELLSKGGAKRGFAGAVAEEEDEKKKAQPPAAKAQVVGWPPIRSYRKNTMATNLSAPRSKDEAEAKQAPAPGCLYVKVSMDGAPYLRKVDLKMYKNYKDLSLELEKKFSGFTVGHGESTGKSGRDGLSDCRLMDLKSGTELVLTYEDKDGDWMLVGDVPWRMFTDSCRRMRIMKGSDAVGLAPRAAEKSKNQK

SEQ ID NO: 105891 - protein, 188 aa, Triticum aestivum
  unsure (1)..(188): unsure at all Xaa locations
  Clone ID: PAT_TA_309.pep
RWSFCPRGGAKRGFAGAVAEEEDEKKKAQPPAAKAQVVGWPPIRSYRKNTMATNLSAPRSKDEAEAKHAPVPECVYVKLSMDGAPNLRRTDLTMYKSXRDSSLALEIMLGSFTVGHDESTDKIPEWRDFQIADCWILIMRIEXCGWLLGGEVAMRMFADSYRRWRIIKGSDAVGIAPTGRRRRVRNQK

SEQ ID NO: 105892 - protein, 97 aa, Triticum aestivum
  Clone ID: PAT_TA_310.pep
RLSCDKFDTDVATLAFANFSEEMRVLGSGPADGEVVRLTVDYSTKPLSVDRTFRQKFGQRLAAVGQYLEQRFGSAQDVEGCMVGEDIYIVQSRPQPL

SEQ ID NO: 105893 - protein, 144 aa, Triticum aestivum
  Clone ID: PAT_TA_311.pep
PTRLLSLSLLRPEARLDPRLDPTLRLDLTPRPDPRPSTPALSRVLPRPLPVPPSLSRKSLTPSAPLPPLPPALLAPPSLTRSLRPHPRLVPLATVPVPLSAVLLMTTLVPCPPLLSLWVLSWAVQLSLSTCKMGFVRYDRIHSN

SEQ ID NO: 105894 - protein, 190 aa, Triticum aestivum
  Clone ID: PAT_TA_312.pep
STPYVIIIHVSMSYFYYISIERPTHHLLASRLLQLAVEADGVVLPRRPVYLYRRPAQRLEDFVGRPALCRLARRCLHATAATASPSRRQGNRRNGWQGQAPAAGLRRKRCLPAARSVGYGAMHGRRRGAMTRGDTGALAVKESSACRSIDVRDDVVKVLVSANGGGQVRRREAMAPDRRCGSLWATPHGT

SEQ ID NO: 105895 - protein, 197 aa, Triticum aestivum
  unsure (1)..(197): unsure at all Xaa locations
  Clone ID: PAT_TA_313.pep
LSFSFVEHAKTIIILNLTISILHHRYSQLPAFDLTDNNMDMATMAAPHQPRYSLEDPGSGFEPRNNARDAREAARAVRNGQSPRYRRTQSPEQLVDDYRFQSEEGSEMRSPTSDVALQDAMLAQAQQQQQVARNAGQRRQPPQGQQVPPNININGRGPQGLGPGQGQGQPMPATYNGPGSMDAQQQPNXPRGEAGRY

SEQ ID NO: 105896 - protein, 224 aa, Triticum aestivum
  unsure (1)..(224): unsure at all Xaa locations
  Clone ID: PAT_TA_314.pep
MVGAGTNTAMGPRKTRVVLYPSPGMGHLVSMIELGKLFAARGLAVTVALVDSPHDTSATGPFLAGVSAANPSISFRRLPQVKHLGSEPPEMLTFEVVRLSNPHLRDFLAGDSPAVIVLDFFCSAAIDVATELGIPAYFFCTSGAQILAFFLHLAVLHGKSTRSFGEMGQELVHAPGITSFPATHAIQRLMDRDSAPYKAFLXMSTNLFRSXGIIVNTFRSLEPR

SEQ ID NO: 105897 - protein, 319 aa, Triticum aestivum
  Clone ID: PAT_TA_315.pep
MRLSTILTGAALFSSSQALNILLNNDDGFGSGNLREMYRLFKEKGHNVWLVAPATKQSGKGGTSDFTAEGNLTGPSQYDLIPKGAPSVGSDPKDSQIWYYNGTPAACTFVALDYVLPRYANFSVPDLVVTGPNYGTNLGGFVWTLSGTAGAAYAATNRGLPAIAISASNQEVPYFDVKNRTNPATWAAQASVKFVENFIATAGKNGPLLPIGYGVNVNLPVLTEKDHDPEFVQTRFTGNAHVNEAVLDPKKGTFTWANIKPYAAGVNACINGNCSLPGETYVVENGKASVSFYTVDYSAPETEYTESLIDRVASFIGKK

SEQ ID NO: 105898 - protein, 398 aa, Triticum aestivum
  unsure (1)..(398): unsure at all Xaa locations
  Clone ID: PAT_TA_316.pep
TTGGASWARLAAKSYPFLAAHRLRAFSARLSRDKVARGLLPFHAQAGIAGSTDVDLHGVFLRLTFDMTCNLVFGVDPGSLQMYLPVVAFARAMDDVLESLFLRHIISPACWKLMYRYVFMCALNRKRTSGHHRPVRRGHIAKRRADHKLGDEGVTDSSDMLSSFICNXTRSEYSDDFLRDTTXTSSSPGRDTTGAALSWFFYLLSKNPRVEQKILDELAPIASRKKQKLAGDDGMAVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNLAVETVPGHVVEPKLSIILHMKNGLAVTVKRRNITGVHG

SEQ ID NO: 105899 - protein, 87 aa, Triticum aestivum
  Clone ID: PAT_TA_317.pep
MMQCMFGCFTSVMSCAFGCMGKGPDLPLCIISCNQKSIVCMIRCGLTPSPPSPKPPTPPAPPAPKPAPPKPAPGPPPYARQNTETSP

SEQ ID NO: 105900 - protein, 131 aa, Triticum aestivum
  unsure (1)..(131): unsure at all Xaa locations
  Clone ID: PAT_TA_318.pep
PRARPTARPPPGAGLPTARSPHTAAAWLPPAVPSSSPSSSWPASPTCRPPQPPRGPFTPRSTSPWRQXDGGAPNGGRGGPGPERDDAPTPRPPPTAGPPPPGPAPHPSRHPPSPAPRPPPYRRSKHIDPPR

SEQ ID NO: 105901 - protein, 307 aa, Triticum aestivum
  unsure (1)..(307): unsure at all Xaa locations
  Clone ID: PAT_TA_319.pep
RPVRDTSISLPYLIPLSPLLESSERFLSSQSLIPYLVPPALHNFNSPTSTTSSSSIFTMAAASSNSLSANDNIQRFTASSRPLSPLPDHALFTDKTRCLVYGLQPRAVQGMLDFDFICKRSKPSVAGIVYTFGGQFVSKMYWGTSETLLPVYQQVGKAMEKHPDVDVVVNFASSRSVYSSTMELMEYSQVKTIAIIAEGVPERRAREIAHVAKKKGVTIIGPATVGGIKPGSFKIGNTGGMMDNIVASKLYRKGSVGYVSKSGGMSNELNNIISQNTDGVYEGIAIGGDRYPGTTFIDHLLRYXGDP

SEQ ID NO: 105902 - protein, 160 aa, Triticum aestivum
  Clone ID: PAT_TA_320.pep
SHRYEGPEVNTRLAHSEAKLLHEKIEHKAYGDDEVIRILTTRSKAQLLATFNNYNDTFGHPITKDLKADPKDEFLKTLRAVIRCFTCPDRYFEKVARLAIAGNGTDENSLTRVITTRAEVDLKLIKEAYQKRNSVPLEKAVAGDTSGDYESMLLALLGKE

SEQ ID NO: 105903 - protein, 316 aa, Triticum aestivum
  unsure (1)..(316): unsure at all Xaa locations
  Clone ID: PAT_TA_321.pep
MATLSVPAAVPALADDCDNLRKAFAGWGTNEALIVSILAHRDAAQRRAIRRAYADTYGEELLRAISDEISGDFERAVILWTLDPAERDAVLAGEKAKKWHPGGRALVEIACARTPAXQLFAARQAYHDRFKRSLEEDVAAHVTGEFRKLLVPLVSAYRYDGPEVNTSLAHSEAKILNGKINEKAYSDDEVIRILTTRSKAQLLATFNSYNDQFSHPITKDLKEDPKNEFLSTLRAIIRCFTCPDRYFEKIIRLALGGVGTDENTLTRVITTRAEVDLKVIKEAYQKRNSVPLDKAVSKETSRDYEDMMLALLGAEY

SEQ ID NO: 105904 - protein, 318 aa, Triticum aestivum
  unsure (1)..(318): unsure at all Xaa locations
  Clone ID: PAT_TA_322.pep
MATLKVPSNVPALADDCDNLRKAFPGWGTNEALIISILGHRDAAQRRAIRKHYADTYGEELLRSIGDEISGDFERAVILWTLDPAERXAVLANETARKWHPGSPVLVEIAYARSAANASSFAVRQAYQDRFKRWLEEEVAAHVTGDFRELLAALVSAHLYDGPEVNTPLAHSEAXKLLHEKIAQKPNADDEDIGILTXRSKTQRITRSXHQNDVAFDTPADKECMLDPKEGFQXALRAVIRCFTCPDRYFRKVSRVCNAGGSPDRPCAPXVRTKRAEGDGRPMEEAYQERNHVPQENAVGGDTFRDDESMDPALGGKE

SEQ ID NO: 105905 - protein, 275 aa, Triticum aestivum
  unsure (1)..(275): unsure at all Xaa locations
  Clone ID: PAT_TA_323.pep
MGAPEVHHLFHNPIADHSFSADQSTLAVARDTSVELYGKVGSAFKLKDSLKGHDKTVTGVDIAPNSGRIVTCSQDRNAIVWEPSPEGYKPTLVLLRISRAATFVRWSPSENKFAVGSGDRVIAVCYFEEENDWWVSKHLKKPIRSTITSVAWHPNSVLLAAGSTDAHARVFSAFIKGMDARPPPGVWGERLPFNTVCGEYLNNSAGWVHSVSFSPSGDSLAFAAHDSSITVVYPSGPDQAPRAVVTVSTQQLPFQSLIWTQXDEIIAAGYDCEAF

SEQ ID NO: 105906 - protein, 199 aa, Triticum aestivum
  Clone ID: PAT_TA_324.pep
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAGHIVKQARVKPGDSVVVMGAGPVGLLCAAVAKAYGASKDVSV

SEQ ID NO: 105907 - protein, 95 aa, Triticum aestivum
  Clone ID: PAT_TA_325.pep
APTGPTKPASQQWPAQLSSSSPSSWSPSRWRHSPKPRARRPRPRRRPKRRRPPPARPRTRPPPTRQPPSPPLRMHRSPAAPAPPTEDPPDRDEMR

SEQ ID NO: 105908 - protein, 301 aa, Triticum aestivum
  Clone ID: PAT_TA_326.pep
PGEENSSRRTRPPCAPWPVPVAPSASSGSCRPGSAPSSRDRREPPARHGPFPSRPPLRPAPAGHPRRPPAAGRAAGPPKVSLALYYESLCPYCSRFIVTRLAGIFDSGLIHAVDLLLVPYGNAHVRGANNTISCQHGPDECLLNNVEACAIDAWPDLNVHFGFINCVEDLVMNRKREEWESCFQKQGLDPKPVMECYNSEHGHKLSLKYGKQTDALVPPHKYVPWVVVDGQPLYEDYENFEAYVCKAYKGHPPKICQGLGRDYPIVQQVVEAGNGVTYNSGDFELDEGVDDKIKMVQGDDN

SEQ ID NO: 105909 - protein, 244 aa, Triticum aestivum
  Clone ID: PAT_TA_327.pep
MSALAFAVLLASIGGTSGKTVRSPTPPMGWNSYNHYNCNPSEEIIKINAKGLVDLGFLDLGYRIVTVDCGWPSRDRDSEGRLQWNETLFPSGPKALGDYIHDLGLEFGLYSGAGYLQCGSQDIPASLGYEEIDAKSFAEWGGDTLKYDNCYATSKTDMVDSDSAEAKSPDRFIKMAAAINETDRDIKYFLCQWGIGEDVPQWATKVGNSWRMSNDIFNAWRAIWRITNQAVAHSKVHHLARSQT

SEQ ID NO: 105910 - protein, 407 aa, Triticum aestivum
  Clone ID: PAT_TA_328.pep
MSYFPGQGYNGGGGGGNGYGYGPPSGPPPPQQQYGGYSGDNSGSRRYPPPNYPPPPHLDAYGFPLPQGLNHHAQHARSGPPPPSVPQQFGHGAPEGYTFQYSRCTGRRKALLIGINYFNQEGELRGCINDVHNVSAFLVERYGYKREDMILLTDDQQDPVMIPTRENIIRAMGWLVSNAQPDDALFLHYSGHGGQVEDLDGDEDDGYDECIYPVDHSQAGPIIDDEIHFRVVKPLAQGVRLTAIFDSCHSATVMDLPYVYSTKGVLKEPNLAKEAALGLFDAFQAYSSGDVSGAAKSMFSMAKNAFNGGDEAYEKTKDTRTSPADVVMWSGSKDDQTSADATINAQATGAMSWAFISAIKANPKQSYVELLNSVRDILETKYTQKPQLSSSHPIDTDPLVCYVTRWS

SEQ ID NO: 105911 - protein, 335 aa, Triticum aestivum
  unsure (1)..(335): unsure at all Xaa locations
  Clone ID: PAT_TA_329.pep
AGRFGNNASVIFLDQPVNVGYSYSGGSVSNTVAAGKDIYALLTLFFHQFPEYAKQDFHIAGESYAGHYIPVFANEILSHDDRNINLKSVLIGNGLTDGYTQYAYYRPMACGDGGYPSVLSESECQSMDNALPRCQSLIKGCYESGSAWSCVPASIYCNNAMMGPYQRTGQNVYDIRGKCEDGNNLCYSGLGYIADYLNREEVKEALGAEVSSYDSCNMDINRNFLFAGDWMQPYHQLVPNVLDKIPVLIYAGDADFICNWLGNQAWTDKLQWSGQKDFSHADLKPLKHAGKEYGKVKSSGNFTFMQIYGAGHMVPMDQPEASSDFXHRWLSGEWF

SEQ ID NO: 105912 - protein, 224 aa, Triticum aestivum
  Clone ID: PAT_TA_330.pep
TNCKRGELLGDRQREYLSLGGEFFLALFLLLLLLVRGGKPKQRLEIDTETLAASIFQEMDREEMKMVILGQEQTFRQQVHEMHRVYHVQKQLMREMQIAGLNRAHAETKHKLEVWRDDKATDRQQLYSFSNSCIPASAAEECDLELTLATGSSRSHKGKQVGKSSNSDSGMAVSSTSTESDLAQFKEFDTRVVRLQIESKRFTIADETNRSPWPHQPVILRVAR

SEQ ID NO: 105913 - protein, 93 aa, Triticum aestivum
  Clone ID: PAT_TA_331.pep
AGRSGKLAACTSLWHSSSPAMARSLAILVIIFICCSLPPCSTATQVHLDGSRPSSGPPSPQPAGTHGCVGRCHNGRPDALTPHRKTLQQAILN

SEQ ID NO: 105914 - protein, 137 aa, Triticum aestivum
  Clone ID: PAT_TA_332.pep
SMVNFPRLLAEHFACVIYTHINLRIACCRVLRCGVRACRRRRCGVMGARYGSYQHSRAYPQAAAAEDQNSDGFHPDELVWPFEHGREQHMNMITRIAKERAMAGDEERSIVLYSTVYKLRHRLVDGARSRWNFELAV

SEQ ID NO: 105915 - protein, 45 aa, Triticum aestivum
  Clone ID: PAT_TA_333.pep
GNLDPSGRAALGVHLSAYEQDTVAVGGSNKPGVMNTVVPGVAIET

SEQ ID NO: 105916 - protein, 234 aa, Triticum aestivum
  unsure (1)..(234): unsure at all Xaa locations
  Clone ID: PAT_TA_334.pep
HQETCRKIKALHQYDCLRANKATSAWGLEVRVPFLDKEFINEAMSIDPEWKMIRPDLGRIEKWILRKAFDDEERPFLPXTFLYTSHILYRQKEQFSDGVGYSWIDGLKAHAESNVNDFFILTLYKMMSNAKFIYPHNTPTTKEAYCYRMIFERFFPQNSAILTVPGGPSVACSTAKAVEWDAQWSGNLDPSGRAALGVHLSAYEQEHLPATIMAGTSKKPRMIEVAAPGVAIES

SEQ ID NO: 105917 - protein, 372 aa, Triticum aestivum
  Clone ID: PAT_TA_335.pep
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVVKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETRATP

SEQ ID NO: 105918 - protein, 218 aa, Triticum aestivum
  unsure (1)..(218): unsure at all Xaa locations
  Clone ID: PAT_TA_336.pep
MAGSETTALQVPVAFKDADDGTIPVRPPTEYAAAVASLPLNPASKLKLRCYQGVWVLEDWVPGIISMQRSFSTRPGDVVLASFPKCGTTWLKALIFATMARAAYPPASPAHPLRRLNPHDCVILVDRLFAVGREAVLDKLPSPRLMCTHMPLSVLPPSISRGPDCKIVYICRDQKDMVVSMWHFANRVRPDISLQEVFETVCEGTXFAGPVWDHILGY

SEQ ID NO: 105919 - protein, 308 aa, Triticum aestivum
  Clone ID: PAT_TA_337.pep
MERGRGGRDGPFGGFGRLGGAPMPGLFGGGRDPFDDPFFTQPFGARMGGPGGMFGPMGGGPGMFGAFGPGDGFLEQAPARSGAVITEIDEDEEGGDGERGGREANRGAYVQEPDDGNDPTRPGMQGGQVQMRRDPSRANGGGQPRSRSFTYQSSTVTYGGINGAYYTASKTRRSGSDGITVEESKEADTTTKEATHRISRGIHDKGHSVTRKLKSDGKVDSTQILHNLNEDELPGFEESWKGSAGQHLPGWNQNAGISNGDNSGNRGANGTRQPAQNWALPGMQQQRDPRRHDNGQPKPKSSRIIPIS

SEQ ID NO: 105920 - protein, 242 aa, Triticum aestivum
  Clone ID: PAT_TA_338.pep
PDRSGDIIITTYGEIDRNNYLDPRTAQIATVDHVKQTCTKLRPATDEELPSGYIEEFRSAIDYEVSKYVGEAYPKGVSAVYCTNGKDLEEPGADFGLAVVISAARRSPRNFCNGSWRSIWTLEFSYAFQLVEIKGKIQVDAHYFEEGNVQLDTDVDCKDSTIMQSPEDTAHTVANIIRHHESEYFSSLEESYLNLSDATFKDLRRKLPVTRTLFPWHNTHAITLTRDLAKELGIGKGSHVTR

SEQ ID NO: 105921 - protein, 504 aa, Triticum aestivum
  unsure (1)..(504): unsure at all Xaa locations
  Clone ID: PAT_TA_339.pep
MAGGVFLLNGADAPDYGGALTVPVVVTCLMAASGGLIFGYDIGISGGVSEMESFLKKFFPGLLKTTRHASKDVYCMYNDQALTAFTSSLYAFGMVGTLVASRVTRRVGRKAIMVIGGSMFLVGSLVNAAAANLAMLIVGRMMLGLGLGFSGQATPVYLAEMSPPRWRGGFISAFPLFISVGYLVANLINYGTSRIPEWGWRLSLGLAAVPAAVMVLGAVLITDTPSSLVLRGKHDHARAALQRVRGKGVDVDAEFSDILAAVEHDRRNQEGAFRRILRREYRPYLVMAVAFPVFLNLTGVTVSAFFSPILFRTIGFGSDAALMGAIILGLMNIGGIIASGVAMDRYGRKLLFAICGALMFTCQVAMASIAGTHLGHGSKMPKGYAVAVLVLTCVFSASFSWSWGALYWTIPGEIYPVEVRSAGQGTAVALNLGLNFVQAQCFLAMLCSLKYGVFLFYAFWLVVMTAFAMALVPETKGVPLDSMGPLFXARHWXYWGRFVKDTIE

SEQ ID NO: 105922 - protein, 112 aa, Triticum aestivum
  Clone ID: PAT_TA_340.pep
MSIVQIDTKAQFDDLIKSHQLVILDASAEWCGPCKAMAPIFEKLSHENPDSEKVVFAKFDTDDVSDLAQELGIRSIPAFFIFRDGERVDNLNGANPPALTKLVKGAIEDVTA

SEQ ID NO: 105923 - protein, 147 aa, Triticum aestivum
  Clone ID: PAT_TA_341.pep
KTMKKKQATRTHERECPRARPPDFAAALALAVADACATSTEAIANPSLRRRPRARIKDRGLQSALNPCATSVRRRRSRRYVARHGQGSASRRRGAWQGREGWVRSAGQSSSGRTARWTTCTDTSTTCPLSMTRLGHQSCLADLLCLI

SEQ ID NO: 105924 - protein, 177 aa, Triticum aestivum
  Clone ID: PAT_TA_342.pep
PAGPGSLHPLLPHRKKTANLAQLISQSLTQLIPYGGLWLQQQQRQDAGAPGLLPPPAGVFPVSAWSRVLRRRGSDESGGSRRADADGWEHAGAGDGGAAAASAWPGFGRVCHLEQCCRWSLVGRAQADRGSQVAAGRSCGWSRPFVRLQRSPGLHPVPVRYIHGTLHSADTTTVFLP

SEQ ID NO: 105925 - protein, 191 aa, Triticum aestivum
  Clone ID: PAT_TA_343.pep
AVCGKVVCGAIRSDSKVLVMPSGELATVKIIERDSSRLSSARAGDNIAIGLQGIDPIHVMSGGVLCHPDYPVSVASSLELKILVLDITVPILPGLQFELHVHHAKVSASLVRIVSLLDQKTGKASARKPRMLTARQAAVVEVRLEREVCVEEFGTLKALGRAFLRSQGSTVAVGVVTRVVQVQGERAEQAS

SEQ ID NO: 105926 - protein, 175 aa, Triticum aestivum
  Clone ID: PAT_TA_344.pep
VPTAIAAMRLSLLIIAAMAVLRTASAAVYNVGEPGGAWDLTTNYGTWVSSRKFQLSDQIVFKYSPQAHDVLEVSKADYDSCSIVNPIATLNSGNDIVTLTAAGTRYFICGFPGHWTSGMKIKIDVVPSSFSPSPAPASGPNASNAPPTTPVSTATSVKATGFGFAILLAFIGFMA

SEQ ID NO: 105927 - protein, 189 aa, Triticum aestivum
  Clone ID: PAT_TA_345.pep
MDTAPAPAKPSLSKKPSPSFRLRNGSLNALRLRRVFDLFDRNGDGEITLDEMAAALDTLGLGADRASLEATVGAYIPPGAAGLGFEDFEGLHRALGDALFGPIVEEEPGKKGEAEDEDMKEAFRVFDENGDGFISAAELQAVFKKLGLAEARNLAAVQEMICNVDRDRDGQVDFGEFKCMMQGITVWGA

SEQ ID NO: 105928 - protein, 191 aa, Triticum aestivum
  Clone ID: PAT_TA_346.pep
MDTAPAPPPVKPSSARKPSPSFPLRTGTFNARRLRRVSDLFDRNGAGEITLDEMAAALDTLGLGADRASLEATVGAYIPAGAAGLGFEDFEGLHRALGDALFGPIIEEEPGKEGEAEDEDMKEAFRVFDENGDGFISAAEVQAVLKKLGLAEARNLAAVQEMICNVDRDRDGQVDFGEFKCMMQGITVWGA

SEQ ID NO: 105929 - protein, 223 aa, Triticum aestivum
  unsure (1)..(223): unsure at all Xaa locations
  Clone ID: PAT_TA_347.pep
NRYNSTHMTWAPPANLATDMDKPRRHMPPDDHTHKQPTAPTLTTSLTREICWTCADRAHRKRPPGACHRHHLDPLHRSSDFKATKQPTGEHLGHAGKNRLPKSTPRPELHSTPSSLPNKNQRPASPNHAAHAAKMPPSTAKMPQSTSLPVVAGFKTIPPRRRKTRSRLHRPIADLRFXXWSQTLGRRSTTQRRRFKKDHGTRGRRRRRXREDRSKVFXRRCAR

SEQ ID NO: 105930 - protein, 223 aa, Triticum aestivum
  unsure (1)..(223): unsure at all Xaa locations
  Clone ID: PAT_TA_348.pep
GFPPKPRPRGGRRSTTQQQRFQERARRPRTSPSPDPAKAGHRISPEDAQPPPAHINATNKPHPAKANLALVVGSHDPPRPDARTTPQPKLLPPNPGPPPRQPPPRRQPCWASKPASTAAPGREGGPPPXXPSHRAELPGRNPSTSATTTIAAGAAPPKSQEPPAAAPTAGSMLPRAARAPPPSGSTPSDRGPPPHRVARAPLPPPSRRTTTGHQAAAGPPPRQ

SEQ ID NO: 105931 - protein, 200 aa, Triticum aestivum
  Clone ID: PAT_TA_349.pep
RRIRVRFRRGSLRNGYHIQGRQQARKLPISIGQGNHNIYIARVHCGPGHGMSVGSLGRYVGEGDVTSIHVTDMTFQGTMNGVRIKTWENSPTKSFAARMLFENMVMKDVQTPIIIDQKYCPYYNCEHRYVSGVTIEDIKFKNIKGTSTLPVAVLLRCGVPCRDVVLQNVDLSYNGQAGTLSHCENANATYVGYQHPEPCI

SEQ ID NO: 105932 - protein, 218 aa, Triticum aestivum
  Clone ID: PAT_TA_350.pep
MERSTIQAKSKPLPPGVYTPVVTLYKADDPSQKVDYEAMHTQCQALIKAGMHGLVYLGTNGELVLLSREERKAIIKTAAQAAATVGGPNYPIVAGISAQSTQESIQNAKDAAEAGANSGLLLPPSYWAKALPSPAIVAYFKEVAAASPIPIVIYNFPAVTSGIDLDTDQLATLAAEPNIVAVKLTCGNVGKVTRLTALFSMKQSVYTVEVAIILCPPL

SEQ ID NO: 105933 - protein, 145 aa, Triticum aestivum
  Clone ID: PAT_TA_351.pep
YMVDPNTGVAMYESDDIINYLAKTYGDGSVPIMLKLGLLTTITAGLALSGRSGKGSSYTPAKLPSQPIEIWAYEGSPFCKIARETLVELELPHLLHSCARGSPKRQDFFKKYGLFQAPYIEDPNTGVKMFESADIVEYLRATYAA

SEQ ID NO: 105934 - protein, 71 aa, Triticum aestivum
  unsure (1)..(71): unsure at all Xaa locations
  Clone ID: PAT_TA_352.pep
HRPERPIDIYELDVXPFCRKGTQVLSVPDPDGXFYPCPQKASTFRPKVVEMGGKEXTLPYMVDPNTGVANV

SEQ ID NO: 105935 - protein, 194 aa, Triticum aestivum
  Clone ID: PAT_TA_353.pep
MGSRYEVEVTVGSARDLKNVNWRNGDLQPYAVLWVDDGPKCSSRVDLDNGESPEWDEKLTVPLPPSTTRLEDAVLHIDVVHANAAEGTKPLVGSARLPLRDVLDDAGLGGRASRSLRLKRPSGRPQGRVDVRVAVRETARYYDPAYPPPYGQSQSQSRDPYAAPAPYGSGGYGYGQQQQPYAAPAVRLPGRLRR

SEQ ID NO: 105936 - protein, 213 aa, Triticum aestivum
  Clone ID: PAT_TA_354.pep
PIVLLHQLIAVISPSVIMIPATILALLSIASVSQAAAAPKILSSDDIIVLKTDGTSQVMKAADLEALETAPAVKNIAGSAKKDIQRRDCEDSTEIQVLSDKEFVNWDVAMSPVISSLGGSKATVSVTNGYTITNSLKVGASFSIPLIKDILTTSLSIDYTETWSSSQTQSLSFTVPEGHHGIIVSQPYVRRIEGNVIDGCTGDAKGGIRVGFL

SEQ ID NO: 105937 - protein, 214 aa, Triticum aestivum
  Clone ID: PAT_TA_355.pep
MAPVVSALAKYKLVFLGDQAVGKTAIITRFMYDKFDATYQATIGIDFLSKTMYLEDRTVRLQLWDTAGQERFRSLIPSYIRDSSVAVIVYDVTDTQSFLHTSKWIDEVNTARGKDVLIVLVGNKTDLVDQRQVPTDEGEAKAKEHGALFMETSAKAGFNIKALFRTIATSLPGMDALPSAKQEDMVDINLRPASGPAGSGAPGQQEQKAGGCSC

SEQ ID NO: 105938 - protein, 197 aa, Triticum aestivum
  Clone ID: PAT_TA_356.pep
MSPGMTLFAVQAVLILSTEDGSRIFAKYFQPPHSAPNAPSSASANPYSDVKAQKAFVKGLIEKTAKQTGDIILYDNRIVLYKMESDVMMYVVGSVDENEILLYNTILALRDSLHLLFKQSVDKRTIVENYDLVSLAIDEIVDDGIILETDPTIIVQRVSRAPTQDMPVGRIDLSEQGVNNLAQLGKSKLADWLRQGL

SEQ ID NO: 105939 - protein, 122 aa, Triticum aestivum
  Clone ID: PAT_TA_357.pep
MEDGVSTYTVDEALVSMGFGKFQVFVLAYSGMAKISEAMEMMLLSFVGQSVHAEWGLSAQEESFITSVVFLGMLVGAYCWGLVSDNYGRRVGFNFTALVTGGAGLFSAFAPNYSSLIVLRFF

SEQ ID NO: 105940 - protein, 105 aa, Triticum aestivum
  Clone ID: PAT_TA_358.pep
WGGGRGAGGGGERALMDPMDRAATQRQKRMIKNRESAARSRERKQAYIAELEAQVTQLEEEHAELLREQEEQNEKRLNELKEQAFQVVVRKKPSQDLRRTNSMEW

SEQ ID NO: 105941 - protein, 277 aa, Triticum aestivum
  Clone ID: PAT_TA_359.pep
AARAAGGIPSPTFDIKLLQPTIFSTYNAMKDKSKNALLSDVCISTSAAPTYLPGHHFRTEQEDGKVREFNLIDGGVAANNPTLLAMTDVSKQILMGNPDFFPIKPADYGKFMILSLGTGTAKIEEKFDIAECSKWGLLGWLYNRGATPIIDSFSQASADLVDIHASVLFQAHHCEKRYLRIQDDELKGETASVDVSTPENLNRLVDIGKALLKRQVCKVNAETGKNEPDQHRGTNEEELVNFHHLSEEPKQTPKEAFELRDWGILHRICRRHILLYI

SEQ ID NO: 105942 - protein, 223 aa, Triticum aestivum
  unsure (1)..(223): unsure at all Xaa locations
  Clone ID: PAT_TA_360.pep
MKITSVFTAVFATLAVGSPLETRDAHIKRQAAEACSVGYCTQNGGTTGGAKGETITVTTLAALQEAAKRSGPLTIIVNGKFTGSDTIRPSSDKTIIGAAGSSLTGVGFYVRRQKNVILRNLKIAKVDASNGDAIGIDESTNVWVDHCDLSGDLSLGKDDLDGLLDISHGADWITVSNTYFHDHWKASLIGHSDNNASQDKGKLHITYANXYWKNVXQRQPLIR

SEQ ID NO: 105943 - protein, 269 aa, Triticum aestivum
  unsure (1)..(269): unsure at all Xaa locations
  Clone ID: PAT_TA_361.pep
MPQVRNPILPGFNPDPSIVRVGDDYYIATSTFEWFPGVQIHHSRDLANWKLVVRPLTRKNQLDMRGEPDSCGVWAPCLSHDGEKFWLVYTDVKRKDGSFKDAHNYIVTATSIEGPWSDPVYANSSGFDPSLFHDDDGKKWFNNMTWDHRSRPRTFEGIFLQEFDPKANKLVGPRKNIFEGTDLAFVEGSHIYKRNGWYYLSTAEGGTGYTHAITLARSRNIWGPYEVHPQKYILTSKDTPHAALQRAGHXQIVETQMARXYVVHLTGRP

SEQ ID NO: 105944 - protein, 172 aa, Triticum aestivum
  Clone ID: PAT_TA_362.pep
MRKYGVIDQSLVGHPDMATKILSDLFSSSGITIDANLPSKKIRAHLRSLKPGDACKLLENLADAWGSRSGSAELVLRWIYCLLVIHGRFIPSEKSRKLISDLEKMCAERYTATEDLLKLSGRLRLIMAQVDKDVKDVSAKAAVQSDEEEEDEIDEMDGEDVDLSENSDDDAE

SEQ ID NO: 105945 - protein, 53 aa, Triticum aestivum
  Clone ID: PAT_TA_363.pep
MAKNNSSATSVRLMLILLLLLVFVGGILANSGPSECSNPAAQRDCPRIPNGGS

SEQ ID NO: 105946 - protein, 168 aa, Triticum aestivum
  Clone ID: PAT_TA_364.pep
KPHHVPGRSASAPRPRRRRSRSRPPRILWRRTRGGPWPGTRRTYPDARSTRARAGRGAPCARPSPPPAMAEATGCRASGLGTGREGSTAASRRSGRPPPAAAATSSSPPESPPLLGDGPSYLRRNSRPSSWPSGNTRRKKSPPFVCQGRHTRRRPSVDLISAQLAGRC

SEQ ID NO: 105947 - protein, 267 aa, Triticum aestivum
  Clone ID: PAT_TA_365.pep
MASYEKQQPPPQPPANAAPYYAYPAPQQPYYAPPPPPPPAPRRSGPGCLLCFVFKVIALVIIALGAATLVLWLILRPGAVRATAVSATLSRFDLAEGVRGGEGVLQYNLTVDVRVRNPNRYRIHYEYAEAQASYDGERFGYDPVEPFYLERKGERTVTAAFGGSSVVDDRGALRSYRRERGDGFYYVKVRLYADLGFKVIQGHARRKSKISCTLRLPPPDASATQRETVPDDAGDEVRRGLLTRPDSSQRDMLPPAAVPKIIFCLTL

SEQ ID NO: 105948 - protein, 258 aa, Triticum aestivum
  Clone ID: PAT_TA_366.pep
MRFPSSIVLALATLTAAHPGEDHHDELQQRRSFETTAERLSLRHCAEKLKARGVTDRNIKRRSALIQEHRQKRGIKKRDLEDVLNTDHNKTDLGYTPNTPAETLFAGQNSCVLTPEVTIGPYYVSGETIRRNLKEDQEGVDLILDYQIINVETCEPVPELYLDIWHCNATGVYAGVNNPGNGNTDDKTNINTTFGRGIQQTNEDGVAQFETLFPGHYTDRTTHIHLLAHANATLFEKQTLGNDIYSSHIGQTYFDQDL

SEQ ID NO: 105949 - protein, 394 aa, Triticum aestivum
  unsure (1)..(394): unsure at all Xaa locations
  Clone ID: PAT_TA_367.pep
LQDCYIIRPPTRPHRRGRAVDVTHSLDVMLAAEXANVYHDLVKYLLMVRQKAREPKVDSELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFSELISLMESGLGLERAHMGIFTELGVLYARYRPEKLMEHIKLFSTRLNIPKLIRACDVXQHWKELTYLYIQYDEFDNAATTIMNHSPDAWDHMQFKDVCVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLE

SEQ ID NO: 105950 - protein, 134 aa, Triticum aestivum
  unsure (1)..(134): unsure at all Xaa locations
  Clone ID: PAT_TA_368.pep
XKKECFASCLFICYDLIRADVALELAWTNNMLDFAFPYLLQFIREYTSKVDDLVKDRIESQKEEKAKENEEKELVAQQNMYAQLLPLALPAPPGMMGGPPPMGGMGMPPMGGMGMPPMGPGPMPAYGMPPMGSY

SEQ ID NO: 105951 - protein, 390 aa, Triticum aestivum
  Clone ID: PAT_TA_369.pep
LVVLYARYRPEKLMEHIKLFSTRLNIPKLIRACDEQQHWKELTYLYIQYDEFDNAATTIMNHSPDAWDHMQFKDVAVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKEQEEKDVVAQQNMYAQLLPLALPAPPGMGGPPPMGGMGMPPMGGMGMPPMGGMGMPPMGGMGMPPMGPGPMPAYGMPPMGNY

SEQ ID NO: 105952 - protein, 111 aa, Triticum aestivum
  Clone ID: PAT_TA_370.pep
MATPLVAGLSVAAAAMGSRFMIQAWQAFRIRAAVPRVRKFYPGGFEREMSRREAALILGVRERAALDKIKEAHKRVMVANHPDGGGSHYIASKINEAKDMLMGKGKSGSIF

SEQ ID NO: 105953 - protein, 111 aa, Triticum aestivum
  Clone ID: PAT_TA_371.pep
MARRSAPLLRRLVSSAPPLPGHGGGARRTVTYMPRPGDGTPRPVTLIPGDGIGPLVTGAVEQVMEAMHAPVYFESYDVHGDMPAVPPAVIESIRRNKVCLKGGLATPVGGG

SEQ ID NO: 105954 - protein, 388 aa, Triticum aestivum
  unsure (1)..(388): unsure at all Xaa locations
  Clone ID: PAT_TA_372.pep
RRRGHPPSHPTRSHHGAPLRPSPPARPRPRRSSPPPRPRRPPSRHRRAASCGRPLPHRRAHPRRRVTYMRRPGDGTPRPVTLLPGDGIGPLVTGALDHVMEAMHAPVSFQSYDVHGHMPAVPPPVIESIRRNKVCLKGGLATPXVGGGVSSLNMQLRKELDLFASLVNCANVPGLPTRHQNVDIVVIRENTEGEYSGLEHEARPXGVVERIKVITRLYSERLAKXAFEIAYLNYRKKVTAVHKANIMKLADGLFLESCREIAAKYPSIEYNEIIVDNCCMQLVSMXPNEFDVMVTPNLYGNLVANTAAGLVGGKGLVPTGLVDQKKPNPVALFFSSAMMLRHLQFPSFADRLESAVKSVIAEGKYRTRDLGGTXTTQEVTDAVIAKLD

SEQ ID NO: 105955 - protein, 146 aa, Triticum aestivum
  Clone ID: PAT_TA_373.pep
MGKLIKNHWARLIVLSAAAYQVLAAIECFFWPKIFWDFLTRSLDGAVKPVPALQIINLIFGLSMLCLEWPLNFVAGSALHRSLEFRLAIIPLTALSAALIYQGTNSAIYYLIGMVVYFWGYSEGEMICAKPWTLPTRGRSGGQSRA

SEQ ID NO: 105956 - protein, 330 aa, Triticum aestivum
  Clone ID: PAT_TA_374.pep
AGRSGTLITTAHHQSRPPPAAMAREELSTEIVNRGVEPSGPDAGSPTFSVRVRRRLPDFLQSVNLKYVRLGYHYLLSHGVYLATIPVIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASAAMFAALDELFDKCRVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAG

SEQ ID NO: 105957 - protein, 356 aa, Triticum aestivum
  Clone ID: PAT_TA_375.pep
CSTCNFISAEASAAMFAALDELFDKCRVRPKDVGVLVVNCSLFNPTPSLSAMIVNHYKMRGNILSYPRPRLAPGPGVRARRRARHRRRAGRPGRPVAPRPAPPPRPRPPGTRPSCRCPTAFFRAGAAAVLLSNRRRDFRRAKYQLEAVVRTHAAADDRAFRSVYQEEDEQRIKGLSISRDLVEVGGHALKTNITTLGPLVLPFSEQLLFFAGVLFRHLYPSKTSTPPPPAANGDTSAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 105958 - protein, 298 aa, Triticum aestivum
  Clone ID: PAT_TA_376.pep
MLSKLILPALASILFQNTAVQAAGDIDYLITFGDSYSQTWFDVSGEKPSSKNPIGNPPFPGWTASGGPNWVGSIVTEQNNSLVLAYNYAYGGATVDANIIKPYQDTVKSMVDQVKQFSDSIASKPSYAPWNAQNAVAGVWIGVNDVGNSFYLGNMADITERAVSRYFELLKVMYNAGLRKFVLLSVPPTQLTPTMIKQGPDSNAMLVKSINLYNSKIASKLQAFKQANSGVKAIVVDTSVSFNKAIKNPTAYGAPDATCFNNNGKSCLWFDDYHPGIAINKLVAEQVATALENNGFGW

SEQ ID NO: 105959 - protein, 76 aa, Triticum aestivum
  Clone ID: PAT_TA_377.pep
MGDQEEQGKKIGGDGGGRTNKYAVACSVIGSIISILMGYDTGVMSGAMRFIKEDLRTNDTQVQVLAGILNVCALAG

SEQ ID NO: 105960 - protein, 245 aa, Triticum aestivum
  Clone ID: PAT_TA_378.pep
MAVRDSLGPVMVAFIAIDGVIVLARLGVRTKLTTLGYDDYVIVVAMLAFILMCAFTFVSLHYGFGVADPAVIAGMAHYNVMEAQRYFTIAQITYVAGFPIVRISVALVLHRIVQGWPRTQQLLVGSMVVIGIYALGCLLVDVFQCIPLKAVWGDGTGKCLSSKQLAGLGFAVAALDIASALFYAILPVFLLKGLQMGRRTKVAIIILLGLGASTVVISFIRMKSLIQICHAKNIPSMDKQLESFI

SEQ ID NO: 105961 - protein, 476 aa, Triticum aestivum
  Clone ID: PAT_TA_379.pep
MATSAAPASPHPHALFLPYPAQGHVIPFMELAHRFLDRGFAVTFVNTRFNHRRVVAAAAGATTAYSSEGGGRLRLVAVDDGIDDAGDHENLILLNAAMQEAIPPQLEALLDGEDATGEGLGKVTCVVVDSGMSWALDVVRRRGLPSAALWPASAAVLSVLVNAKRLIRDGVIDDDGAPVNLKNNSFHLNESAASMDATFLAWNYMGNRDAERLVFHYLTSTAQAAAEKADFLLCNTFSDIEPAVFTGPTPATILPIGPLRTWQRPTRHAPVGHFWHADDDACTSFLDGQPRGSVVYVAFGSISIMTAAQLQELALGLESSGRPFLWVVRPEQAGKLPAGFAGAIDGLGKGKVVGWAPQEQVLGHPAVGCFVTHCGWNSTLEGVRNGLPMLCSRHWSDQFTNQTYICDIWRVGLRVASAEGGGLVMKERVVELLDRIFEDEGAKERVLRLKEMAEKNMSEEGESLNNLNVLMESMGR

SEQ ID NO: 105962 - protein, 247 aa, Triticum aestivum
  unsure (1)..(247): unsure at all Xaa locations
  Clone ID: PAT_TA_380.pep
LENRYLFSRLYKMASLRSLTASLRWVAPARGVAAVRYSSSSTSAIAYKALRRRSAPLPVRDNPPAWSAQSAVSNILYETPVPSTVPPKRHILNCLVQNEPGVLSRVSGILAARGFNIDSLVVCNTEVEDLSRMTIVLTGQDGVVEQARRQLEDLVPVWAVLDYTAAALVQRELLLAKINILGPEYFEELLNHHCEIAAGEYDVHNAHEAIERSISDTAKDFHPXQLAVSQALRHKHEHLKFITYFAH

SEQ ID NO: 105963 - protein, 414 aa, Triticum aestivum
  Clone ID: PAT_TA_381.pep
FDLMGHIMKHTMMRAKAALQSLTRDAHGVDGSKIYLYGEGWDFAEVARNQRGINGSQLNMSGTGIGSFNDRIRDAVNGGNPFGNPLQQGFNTGLFLEPNGFYQGNEADTRRSLATYADQIQIGLAGNLRDYVLITHTGETKKGSEIHTFDGLPVGYTSSPIEIINYVSAHDNETLFDVISVKTPMNLSVDERCRINHLASSMMALSQGIPFFHAGDEILRSKSIDRDSYNSGDWFNKLDFTYETNNWGVGLPPSEKNEDNWPLMKPRLENPSFKPAKGHILASLDSFVDILKIRYSSPLFRLSTASDIKQRVRFHNTGPSSVPGVIVMGIEDARDEKPEMAQLDANFSYVVTVFNVCPHEVSMDIPALASMRLELHPVQVNSSDALVGKSVYEAATGRFTVPRRTVSVFVEPRC

SEQ ID NO: 105964 - protein, 71 aa, Triticum aestivum
  Clone ID: PAT_TA_382.pep
LSVVRAEILLDEAGDGEVAEIDAVLEEAAELVDDSQPKKPSYYSTYEVQYTLRRQDDRSWKICEAAVRDLS

SEQ ID NO: 105965 - protein, 326 aa, Triticum aestivum
  unsure (1)..(326): unsure at all Xaa locations
  Clone ID: PAT_TA_383.pep
SYAVPSGGVGRSSCPSWASQSWPLPPRCAPRRRPPSGASLRGAMPATTAQGPANAAAMIPTVWHRCFVEACNGPVPRDPTPATPSSEKPTAPIKPSLRGLPSIDARPHAPQAACPAVRSSAXPAAAFALIDAYQRRPRRGHVEVVVSCADIVASDACEPLWFLIPPTSNLSVPAGRFVGTCPNTAEPVILLGAPTIGRSDRSSFVADRLNTPSDMDGGLAAFLSGPAPGPXTPGGTDPTVMRDVVTPNKLDRQYYKNVLSHTVLFTSDAALMTSAETARMVVENAKIPGWWEGRVREGKGERARVQDKNGRPAQDQXRCRAIHYDH

SEQ ID NO: 105966 - protein, 231 aa, Triticum aestivum
  Clone ID: PAT_TA_384.pep
MRSFALLALVGPLAVSAASGSGHSTRYWDCCKPSCSWSGKAKVSAPALTCDKKDNPITNLNAVNGCESGGSAFACTNYSPWAVNDDLAYGFTATKLAGGTEASWCCACYALTFTTGPVKGKKMIVQSTNTGGDLGDNHFDLMMPGGGVGIFDGCTSEFGKPLGGAQYGGISSRSQCDSFPELLKDGCHWRFDWFKNADNPDFTFEQVQCPKELLAISGCKRDDDSSFPAFR

SEQ ID NO: 105967 - protein, 272 aa, Triticum aestivum
  Clone ID: PAT_TA_385.pep
MSSPKPPPSGVWAPAITFFDHDTDTLDTVSQAAYYSYLSKTGLAGLVVLGTNAETFLLTREERKELLQTARQACGPDFPIMAGVGGHSTKQVLEFIGDAADAGANYVLLLPPAYFGKQTTPEVINNFFNDVATKSQLPIVIYNFPVVCNGIDLDSATIATLAKKYSNIVGVKLTCGAVAKITRLSAELPEERFSIYGGQSDFLIGGLAAGSHGTIAGFANVVPKTIVHIYNLYQEGKFQEAMALHKKAALAEQPLQGGIAAVKYAATLSTAK

SEQ ID NO: 105968 - protein, 230 aa, Triticum aestivum
  unsure (1)..(230): unsure at all Xaa locations
  Clone ID: PAT_TA_386.pep
MDTVINMADAAHALDLARIRFQLIRLEDTITFHLIERVQFALNSTIYAPGAVELPESNLSFLDWYFREQEKLQSLIRRFESPDEYPFFPDALQKPILKPLNYPRILYENDVNVNDKIKAFYTEKFLPAVCPDFGREERGESQENYGSTATCDIACLQALSRRIHFGKFVAESKFRSEQEKYIRLIKAEDREGIAESITNAAVEKQVLERLRLKALTYXKDPVSQMGQKER

SEQ ID NO: 105969 - protein, 237 aa, Triticum aestivum
  unsure (1)..(237): unsure at all Xaa locations
  Clone ID: PAT_TA_387.pep
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEXGGVPPDIQTAEEALELITDAIEQAG

SEQ ID NO: 105970 - protein, 311 aa, Triticum aestivum
  Clone ID: PAT_TA_388.pep
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEGGVAPDIQTAEEALELITDAIEQAGYTGQMKIAMDVASSEFYKESEKKYDLDFKNPESDPPKWITYEELANMYSELCKKVPIVSIEDPFAEDNWEAWSYF

SEQ ID NO: 105971 - protein, 224 aa, Triticum aestivum
  Clone ID: PAT_TA_389.pep
RPLSRPAGSGDTFALTYNTEWLDEPFRDLEEASSALRRLDVETVELIAQMPCDDGVSGGFENLDVVEKALMEASWDQLEQRFHAWSRRFELTKKHIATWEYQEWTSPHLMYLNLQQQFWKMSMTLELDDDSEPDPRTVEAYLDAAETFAQKLIIPGQPSFSLDGDLISSLSFVIWCCSESHHRYRALNILRGLNRREGIWDSKDLTELHEAALEMENPRSGIIR

SEQ ID NO: 105972 - protein, 236 aa, Triticum aestivum
  unsure (1)..(236): unsure at all Xaa locations
  Clone ID: PAT_TA_390.pep
MTSIGTGYDLLNSIFSPDGRNFQVEYAVKAVESGGTSIGIRAKDGVVLAIEKVVSSKLLKPGANKRIATVDSHVGAVSSGMVPDGRHFVDRARDEAQSWRQNFKTPIPTSDLASRMGGYLQAYTMYGSVRPFGITAILGGYDTPEETPVDGEVGSGPKVGAGGKVEGKHGGPFLYMIEPSGMYWGYYGAATGKGRQVAKAELEKLDLAXXHMSLEDAVKQAXRIIYIAQKDNKDKD

SEQ ID NO: 105973 - protein, 215 aa, Triticum aestivum
  Clone ID: PAT_TA_391.pep
MSSQSTAQYFPKIYSLTSVDHARSVYDEWAKTYNEEITGKGQDYVGPAIAAAHVPQALGTPTISPDVEILDAGCGTGLVGIFLARLGAKKLDGVDLSPGMLDEARNTGAYRNLDVTDLSRPLSAKNDSYDVVTCVGTLTQSHVGPEALSEFVRVVKPGGYIVATVIREIWQTGGYESHVKALAEQNKVKVLSAEVQDYRRGAGAQAYYLVLQVSA

SEQ ID NO: 105974 - protein, 300 aa, Triticum aestivum
  Clone ID: PAT_TA_392.pep
VRKKKKTRKAHAHTAEPNRSAPPLTRPDRASAEGMGGAGDGEGAGSESPPSGARATLNIRCANGAKFTLQADLGETVGAFKEVVAGSCDVPAPQQRLIYKGRILKDEQTLESYGVETDHTIHLVRGVAQPAASGAPAAASPQASTTPTSGPAGGLGGLFPGLGATGAASGRPAGLFGAGLPELDQMQQQLSQNPNLMREIMNMPMMQSLMNNPDLIRNMIMNNPQMRDIIDRNPDLAHVLNDPSVLRQTLEAARNPEIMREMMRNTDRAMSNIEASPEGFNMLRRMYETVQEPFLNAQQW

SEQ ID NO: 105975 - protein, 155 aa, Triticum aestivum
  Clone ID: PAT_TA_393.pep
SADPQSMNQLLSMNPNARSLMESNTQLRDMFQNPEFLRQMASPEALQQLLSFQQTLSSQLGQNQPSQAGNLGGNGTGTRGNVGLDTLMGMLSGLGAGGGLGVPNASNVPPEELYATQLGQLQEMGFFDTAENIRALMATSGNVHAAVERLLGNFG

SEQ ID NO: 105976 - protein, 567 aa, Triticum aestivum
  unsure (1)..(567): unsure at all Xaa locations
  Clone ID: PAT_TA_394.pep
VRSEEEPVVYATKLEAKNAFKSLLESANVQSDWSWDQAMRVIISDKRYGALKTLGERKQAFNEYLNQRKKIEVEERRVKQRKARDDFLTMLEECKDLTSSLRWSKAITMFGHDERFNAVERPKEREDLFENYLVELQKKEKAKAAEEHKRRIAEYREFLESCDFIKANTQWRKVQDRLEDDERYARLEKIDRLDVFQDYIRHLEKEEEEQKRIRKEQLRRQERKNRDEFRKMMEEHVADGTLNAKTYWRDYCSQIKDSRAYLAVASNLSGSMPKELFDDVMEELDKQYQDDRALIKDEVKSGKIPMLASWTLEDFQAAVTEDEKYKGVSNINIKLIYEDQIERLKEKDLKEAKKRQRLGDNFLDLLYSIKEITAASTWDDSKSLFDDTQEYRDLGGETYAKELFEEYIARLKERLKEKERMREEEKAVEEIGIDVHTYQXSKDTARHVDLVPDMEKEKDRSRSDEMDIDDDVEIHASKDKKREKDKEKKHKRRHHDTTDSERDEKDESRKSRRHSSDRKKSRKHTHASDSDSENRHRRHKKDRDSSRKNGGHEELEDGELGEDGEIH

SEQ ID NO: 105977 - protein, 115 aa, Triticum aestivum
  Clone ID: PAT_TA_395.pep
MATGAQSFYELYRRSSIGLALTDTLDDLISEERINPQLAMKILGNFDQAITEALQKNVKARLQFKGSLDTYRFCDEVWTFLIKNVTFKMDSGSQSITANKVKIVSCNAKKPGEGQ

SEQ ID NO: 105978 - protein, 100 aa, Triticum aestivum
  Clone ID: PAT_TA_396.pep
YAHSCVFKIKAFISSYSLIILSRNRNNFCRTINISFVRTNHHSKPWPSTYAPIGVSPALSSLGRSEESSHVPLSRKTEGAYRRPHSGQFGEGKLEQPVGF

SEQ ID NO: 105979 - protein, 484 aa, Triticum aestivum
  unsure (1)..(484): unsure at all Xaa locations
  Clone ID: PAT_TA_397.pep
MKEAGMVGVLPCLLLLLFLKPRAIAAAAAAYSEYSCNGTTGNYTARDAFGANLARLTAELPADASTSPSLYASAAIGASPDKVFALALCRGDITDARTCSGCLDNAFTQLRALCAGERDATFFHDLCTLRYSGEDFLARPDDNNPVINAMDVNGSTYAAWDSRNATSRSFFLSLVGTLFGEMSMYGAYNSSVRRFASAVMYINPQLPTVYGLAQCTPDLSPGQGWHCFQGLQEQTRQWYDGREGGRIVGVRCNIRYEGYQFYDGMANVRIGTPGGSSSPTESNGSKHMQTLIIVLCVSVTVLCSMLVGCLLLIRRLRKGAGNTKLEQGHKRNNSKTEEALKLWKIEESSSEFTLYDFPELAAATDNFSDENKLGQGGFGPVYKGKFSDGAEVAVKRLAAQSGQGLVEFKNEIQLIAKLQHTNLVKLVGCCVQEEEKMLVYEYLPNRSLDFFIFDQERGPLLDWQKRRHIXEGIAQGLLYPAQHS

SEQ ID NO: 105980 - protein, 231 aa, Triticum aestivum
  unsure (1)..(231): unsure at all Xaa locations
  Clone ID: PAT_TA_398.pep
MAGGGGKAKPLEFTPTWIVALVCSVMIIISLLFERLLHRLGKRLIRSRKKPLYEALLKVKEELMLLGFISLLLTVFQGPMGKLCVSPSAMLHLQPCKPPPHEXTTSAAPCSPAGGRRGRGLMAGGPSSSDEYCLKKDKVPLLSSDAIHQLHIFIFVLTVTHFLLSAITVLLGIAQTRNWRHWETKIQENNDSAPQMIKHVQEFKFIQDHFKSHRKTARIFGWMXFLLQQFY

SEQ ID NO: 105981 - protein, 258 aa, Triticum aestivum
  Clone ID: PAT_TA_399.pep
MLNRSIMPALRPFANLRVSLAHPAPQYRRFSATPTRCLSAVFAETENPELNKVLIDVQEKIILPAYLPETQRKIVYNTSKGDYMRRNPIVIELDGLEHTFSPIDIKKDIPNSKTALTDATKLMKTKEEWDNIGTFLAGYQKAGIKLDQEHYMSLIRRACASQQEYSIIECAKQADKTGLTLHRDSSIALLLSSINQKIYNSAREDGDTLQAFKWNRLIWDIIQRPEHVQRRSSDSKLACGSPVTRGLLLFTQAHAIQA

SEQ ID NO: 105982 - protein, 118 aa, Triticum aestivum
  Clone ID: PAT_TA_400.pep
PACPGSRPDRAAARAGQSERRHHHSTPASPTAAATTRALHHIWRTHPFHPLLTFSPPTTTSSPLPRHRSTSGSGSDAGSDPAHPQRLFHLRTSWTWCSSTGAAVMDKEIITLYLSVLN

SEQ ID NO: 105983 - protein, 107 aa, Triticum aestivum
  Clone ID: PAT_TA_401.pep
IKQKKKKSVTHIDQHVRIISLLQLIDRGKETMATDGWIIHLSPASGHAGRAIIDQSEVLLLLLGSGASAAEGSEAGESAAGASAGALAEGAGASAFFSAFFLPLASA

SEQ ID NO: 105984 - protein, 119 aa, Triticum aestivum
  unsure (1)..(119): unsure at all Xaa locations
  Clone ID: PAT_TA_402.pep
TPPPPSPSLKPTSIHPSIHRQAVRLPAASKLPPDQPSQPANNGPRRCLHRRPPPGXPSPWRHSPTPRARRPRPRRRPKRRRPPPARQPTRPPPTPQPPSPPLRMHRSPAAAAAAPPTDR

SEQ ID NO: 105985 - protein, 116 aa, Triticum aestivum
  unsure (1)..(116): unsure at all Xaa locations
  Clone ID: PAT_TA_403.pep
TPPPSPSLNPTSIHPSIHRQAVRLPAASKLPPDQQSQPAHNGPRRCLHRRPPPGRRRGGAIRRSQGQEGQGRRRRPKRRRPPPXRPPTGPPLTPQPPSPPLRMHRSPAAPAPPTDR

SEQ ID NO: 105986 - protein, 192 aa, Triticum aestivum
  Clone ID: PAT_TA_404.pep
DPSVHSNSINSTPHHSHYPASIMSYADIAAKGPKQSPEDAAAPQPPQILTDESASTASLVDVDMPSVHTVPNDFLEQEIQTETQAARIEREEEAKQEKRKRDSAASKAKQTDNWLIQQFSKLSDGEATGLTVANLATVVSLGAFLGYKGWGLYEKGRLDWKAVSYGVGILASAAAAQGAVGRYLYKGKKGGS

SEQ ID NO: 105987 - protein, 57 aa, Triticum aestivum
  Clone ID: PAT_TA_405.pep
PIISMIRSSGRSWWMALMAKPSVVDSSSGHVVLSTPGMSLSLHCRERKKGAVPDRPA

SEQ ID NO: 105988 - protein, 175 aa, Triticum aestivum
  unsure (1)..(175): unsure at all Xaa locations
  Clone ID: PAT_TA_406.pep
MVHQAQGLLVQEVAADGELPSRYVLKEQQGRPAAATAAAAQRAAPSIPTVDVSRLADADPGEADKLRSALGSWGLFAVTGHGMTDPFLDAILGAARGFFHLPTEAKQEYSNVVDADDGGRKFXPEGYGVDRVNTDEPVRRSSHRRRPPRNRSATPRTASKSEAQISTHAVLTMSA

SEQ ID NO: 105989 - protein, 143 aa, Triticum aestivum
  Clone ID: PAT_TA_407.pep
MTESMVRNKPGMASVKDMPVLQDGPPPGGFAPVRYARRIPNKGPSAIALFLTTFGAFSWGMYQVGQGNKVRRALKEEKIAARSAILPMLQAEEDERFVKEWKKYLEEEARIMKNVPGWKVGESVYNSGKWMPPATGELRPEVW

SEQ ID NO: 105990 - protein, 89 aa, Triticum aestivum
  unsure (1)..(89): unsure at all Xaa locations
  Clone ID: PAT_TA_408.pep
VRFGNLNYTNDIRGDLIFNGFGPTSGVPNSRDEHDLNLLSDSIRDTTPAAAPDLNPEQIIWAKDGWMDPLRKRTLIGGKAEPXSPYGTL

SEQ ID NO: 105991 - protein, 148 aa, Triticum aestivum
  Clone ID: PAT_TA_409.pep
TGIFGKALIQEQPTSPADGSPRFFDCNSHEKVSPRESLSPPSTSSHVDELDDRYEGFSLLHLACRVADVGMVELLLQYGASVNVSDSRGRMPLHHCILKGRHLHAKLLLSRGADTHAIDRDGRSALQYAMDRSTSDEGMLALLEEHFR

SEQ ID NO: 105992 - protein, 74 aa, Triticum aestivum
  Clone ID: PAT_TA_410.pep
VWLQGMSGIRSRLSASLQQLDMNSNRCCLDGGFSLTVVLLCKVLCELLIKWLHASSKYKGQGSFSFSKNIYFFA

SEQ ID NO: 105993 - protein, 224 aa, Triticum aestivum
  Clone ID: PAT_TA_411.pep
GSCFEADILAAFDAAIHDGVHVLSVSLGNDGEPYDYFDDAISIGSFHAVRRGISVVCSAGNSGPKPSSISNLAPGRVAVGASTMDREFPSYIVFNGTKIKGQSMSETSLKGKESYPMIDSAEAAAPGRAVDDAKICLQGSLDPTKVKGKIVVCLRGTSARVAKGLTVLQAGGAAMVLANDAASGNEIIADAHLLPATHIRHGDGLTLYNYLKSAKSPEGYIEKA

SEQ ID NO: 105994 - protein, 215 aa, Triticum aestivum
  Clone ID: PAT_TA_412.pep
RVDGCEKKTEGLIGFPDFLVERTRFEAAVAQNWTIRDKCRIWWANDDGGGSWWEGRVLAIRPKSPDFPESPWDKYAIQYKNDGSDHLHSPWELHDADSPLVPWKHPHIDSSIRNKLLSAVTNLQNKSRRNQDCYGVLKLDAVAGKSEFINRFPVQFSMEVIRTRLQNGYYRSVEAGLRHAAVMLANAESYFSKSADMTKKLLRLSEWVEDNILSL

SEQ ID NO: 105995 - protein, 127 aa, Triticum aestivum
  Clone ID: PAT_TA_413.pep
RTSTTTTNICSYLPLAWPATATGIVTASPMGDITGDDNRCGFFISSSTHGYSCIDFHAFIVIDISRASSMKQYNPSMHAMATKMEACALLAFPSSTHIGAHTRGNTQPRFLLMCRIHMHACVPDMHA

SEQ ID NO: 105996 - protein, 392 aa, Triticum aestivum
  unsure (1)..(392): unsure at all Xaa locations
  Clone ID: PAT_TA_414.pep
KWAREXLEEVEFYRGLEVMRQQADAADSPAAPPPARLTALPQRKGEVKFKISGLDLSDPKWAEVAERAAEAEAHFVPEEAKAVDGKAKKAEEQLLAAEPRKGNPVPAMEEWKEELRPKRVDWMALLERVKARNVELYLKVAEILLDEDSFAATIRDYSKLIDLHSKATHVQDVERILGKMKEKDIAPDILTSITLVHMYSKSGNLEQATRAFDFIQKEGLQPDTKLFTSMISACINAGDPKQAEKLVKKMDELSMKPSREIYMDVMRAYAERNLVDGAQSVKTKMSFAGIEPPLECFTLLIEANGRAGNPDYAYEAFEQMRKNGHEPDDRCLAGMITALMKKNQLDQALKLLLSLEKEGVKPGVXTIRAXRDWLSXXXLXQXAEQLVXKDKK

SEQ ID NO: 105997 - protein, 403 aa, Triticum aestivum
  Clone ID: PAT_TA_415.pep
MTENHRFWGVVVKPGETVKCDPGDSHYHISTIALEPGKAEEDVQVFVKIDDTRIMLGTLSVDNHPHVLADLVFKEEFELFHSSMTSNISFMGYKFDIIKRFHSCTKQDADSDEEVPLAIPLDINTDGYKNNEATHGANNLLIAPRPADAPSSIPKAKVEETNSPGKQKGDDKDKTGMQNSSDGLDNESSDQDVDYPRKRTKDDYNPMETPLNTPQGKRAKIATPTTGNKTGYVHVATPHPAAKQARKSGDHVHVATPHPAAKQAGKSGDHVHVATPHPAAKQAHKSGDHVHAATPHPAAKQAHKSGDHVHVATPHPAAKQAHKSGDHVHVATPHPAAKQARKSGDHVHVATPHPAAKHARKTPENNDDKSKQSAGHVCNSCNRTFSSLKGLGDHSRAKHGDAK

SEQ ID NO: 105998 - protein, 261 aa, Triticum aestivum
  unsure (1)..(261): unsure at all Xaa locations
  Clone ID: PAT_TA_416.pep
FLCRIVIFSPPGEAAGRYILRTNARNVRPVPWAWCPTAPIVAPAVAAELSPYVILAEKLGRLAVQLVAGGSGIKAVKIVYSSARDPDDLDTRILRAMVTKGIVEPISSAFVNMVNADYVAKQRGLRIIEEQILLDGSPEVPINSIQVQLANVESKFAGALSDDGDIRVEGKVKDGTPHLTLVGPFSVDVSLEGNLLLCRQVDQPGIIGKVGSILGDXNLNVNFMSVGRIAPGKQXIMAIGIDEDLTRNSQFDSGNPSVDPS

SEQ ID NO: 105999 - protein, 120 aa, Triticum aestivum
  Clone ID: PAT_TA_417.pep
MARILLHGTLHVTVFEGEGITNNSRPSSQAPQFLRKLVEGIEDTVGVGKGASKLYATVGLGKARIGRTRTLNDESSTPRWFESFHIYCAHLATDVLFTIKGSSTIGAFVVGTGYLPVRDI

SEQ ID NO: 106000 - protein, 126 aa, Triticum aestivum
  Clone ID: PAT_TA_418.pep
GGVLQARDDRPSEVRLHGIYKRAIHESPWRTSKRVVLVRVDVNAKAHTSCTTSSSTRYNLDHNLTISTLIQIPSSSQKKVNNSIQISINTLCVKVHRTSEKYQLSLSKAQTYWSELALSSYQQDYA

SEQ ID NO: 106001 - protein, 104 aa, Triticum aestivum
  Clone ID: PAT_TA_419.pep
MLASTLLQREGRHHHHFWPSTSNQSTRLLRKERSNHHVEKTYTIQSLSIPVFLLKKQFSLFFPHAAFPPECRPSDRRHVKRYIKELPYVPYVPYNQARLTICFS

SEQ ID NO: 106002 - protein, 115 aa, Triticum aestivum
  Clone ID: PAT_TA_420.pep
VADTSLEARYITLHVCDKVAERGARLAAAGIYGILKKLGRDRAPSDGSPKQRTVVAIDGGLYEHYKKFSSRVEATLAELLGEAAASSVVVKMANDGSGIGAALLAASHSQYNVVE

SEQ ID NO: 106003 - protein, 102 aa, Triticum aestivum
  Clone ID: PAT_TA_421.pep
GNLSVSVQQKKLAAVPPIHAWKETSYEHKSQHHYSESPASKGVDEVTWAPARKVTGSARMQISPRWPELVRLDLAHYSGSSPLSLLPAKPSWTWMCGCACSL

SEQ ID NO: 106004 - protein, 173 aa, Triticum aestivum
  Clone ID: PAT_TA_422.pep
AERTARSEAQLKEKYQLRLKVLEDGLRGPPSGSSRPPTEGKSFSNGPSRRLSLGGADNVSKVSPNGLLTRRSPSFHSRSSLSSSSSLILKHAKGTSKSFDGGTRSQDRGKVHGNGSHLLNKSTDAVKDREANDGWKGTVDEGTNESPNSNADQRSNETTNSNSIEMVSGFLYI

SEQ ID NO: 106005 - protein, 68 aa, Triticum aestivum
  Clone ID: PAT_TA_423.pep
CHEISLPLPKDFSMLYPVMDIMPCLSLGRNTPLKYVFKHIFLSILLFNLIIIFSFPLCGLTFLVNYMI

SEQ ID NO: 106006 - protein, 56 aa, Triticum aestivum
  Clone ID: PAT_TA_424.pep
VMLEDYISPTIINNIGIFRSLSAAGCCPRWSVLLVETAWARSTLGRSLQVHEISLY

SEQ ID NO: 106007 - protein, 194 aa, Triticum aestivum
  Clone ID: PAT_TA_425.pep
DIADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYNGEIHVTIIATGFPQSFQKSLLADPKGARILEAKVKAASLATAAAVQQPAAAVPTWSRRLFS

SEQ ID NO: 106008 - protein, 251 aa, Triticum aestivum
  Clone ID: PAT_TA_426.pep
PEFPGRPRVRLALLGCECSGSVFLAMPLLQRCRLDFVGSGTCSLALAAPLVESLEVQGFNYITLHGGDRLKRLTISKNTGRVNTVGIDRLPVLEQLSLRGVQWSWGAVSHVLQCGAEAKHLVMKVEFCGDFDTLQPFPEVDLVEFFNSHPKLCKFEVHGAMFASLCQKNSLKNLDSRFLISSLEEVLITVRSPLNAEQKLITIESLVRYSPRLRRMVLRISQMKNCHEAADEFFEEVSKFAHMSNGRVRIE

SEQ ID NO: 106009 - protein, 279 aa, Triticum aestivum
  unsure (1)..(279): unsure at all Xaa locations
  Clone ID: PAT_TA_427.pep
KPRTARHGSSRSSTRSSRQPPLLPKKLRKPTGSPCSKPPSTRPLKSRWGPATTGARRPPISTRRSKRPSNPPPPPSRRLRTPTWRTPWRSPSPPLPMPPRMAPKLLPRPPQKPVPRLQLPTPATRPPTNPLPSPLPRQLPKPPTNPLPSPLPRQLPKPPPRPLRNPLPGQAAPAPAGAPATPPAGPRAADAAPGPGAGAGPRPGGGRXPVAGPGPKPVPSPAADAPAEPRXRKRLPSPQMANLATRPPPMPRPNLLPQAATICELLAQASFSLSLRPCI

SEQ ID NO: 106010 - protein, 296 aa, Triticum aestivum
  Clone ID: PAT_TA_428.pep
SRVDRLRKATEGYISVAFIQMLKALMPVATFIMAVLCGTDKLRRDLFLNMVLVSVGVVVSSYGEIHFNVIGTLYQVTGIVAEALRLVLTQVLLQKKGLTLNPITSLYYIAPCSFIFLFGPWYLLEKPEMDISPIQFNYWIFFSNALAAFALNISIFLVIGRTGAVTVRVAGVLKDWILIALSTVIFPESTITSLNIIGYAVALSGVVMYNYLKMKDVTAIQLPIDNTADRATKEKKVVNIYKPDSSIDSIDETVVGGVAVGSLATEAAAVDEEAPLIPSSRISHVTRTQTGGLSSR

SEQ ID NO: 106011 - protein, 223 aa, Triticum aestivum
  Clone ID: PAT_TA_429.pep
MNRRFVNLLVSKSGDCRPAFNLHRINPASLFCPTRSLKPADPAATKKKTLSRLPPAAISFELPCPWKKFGWMDFMARKNDIIAVDHEGHTLLYNGTVGALCAMNRMVDPCHSSISVVVGDELYAMAINRGLLPKVDYFKALTYGRSFGHCQPEDWHWRPLQPPPLEYDHEKDQRYNPTAAPVTHPCAIGAYTVVRDSQIWISTTGAGTYSFDTTSSVWRKIGE

SEQ ID NO: 106012 - protein, 294 aa, Triticum aestivum
  Clone ID: PAT_TA_430.pep
PSRRRRSSLAAAAATFVAAAAARPPPLSSSSTSSSPASPSSTPTTSSTPTTAGDIGPAPIGAATVPPPPPPSGRRCRSSLAAAAATFVAAAAARPPPSSSSSTSSSPASLSSTPTASSTPTTAGDIGPAPIGAATVVESFSAGLSDFSDMAYSSCRSLVYACPVLATPPRAFVHDVSPGLASLARRFVNFVFVRLRMPGAGNTGAWLRPRCVPGLGKPAATRRQHHLLPGAPLLRHHCAHANSAPPCARGSTATSSTPATPTRHRPRHSSHGYLDHSTTHALYIDKRHKGLPSA

SEQ ID NO: 106013 - protein, 74 aa, Triticum aestivum
  Clone ID: PAT_TA_431.pep
VILECTLTNPILRPKMSEVLQALESNVTLAENGVDLNREALLPYGGSCSFSVRHGDPHDSSSFIIEPIELSGPR

SEQ ID NO: 106014 - protein, 189 aa, Triticum aestivum
  Clone ID: PAT_TA_432.pep
GRLLGTGCQPSLHPYGCRVIQRILEHCSNGSDGLVDEILQSTCILAQDQYGNYVTQHVLEKGKAHERSQIISKLARQVVSMSQNKFASNVIEKCFQHGDVAERDLLIKKILEQTEGNNYLLVMMKDQFANYVVQKILETCNGQQRDALVSRMKGHLQALRKYTYGKHIASRIEHFSGDGAVPPGSQKKA

SEQ ID NO: 106015 - protein, 107 aa, Triticum aestivum
  Clone ID: PAT_TA_433.pep
RRSPAPSLSPPPPPWPSPPTPRPWPRPPAPPSPAPPPPPSRPSAPCSGPPCSPSSPTTCSKRAPARVSSLRGGGRQGRRRSLIRYVWLYATLIRGTRVRFDRCMRVL

SEQ ID NO: 106016 - protein, 354 aa, Triticum aestivum
  Clone ID: PAT_TA_434.pep
YAAPSAAATPTPFSAVAGIGARGLVAPSHASAARPAAWARAPSEPARKIERYSPAFYAACTAGGITSCGLTHMTVTPLDLVKCNMQIDPAKYKSISSGFGVLLKEQGAKGFFRGWVPTLIGYSGQGACKFGFYEFFKKYYSDIAGPENAAKYKTLIYLAGSASAEVIADVALCPMEAVKVRVQTQPGFAKGLSDGFPKFVKAQGYAGLYKGIVPLWGRQIPYTMMKFASFETIVENIYKYAIPAPKSECSKSLQLGVSFAGGYVAGVFCAIVSHPADNLVSFLNNAQGATVGDAVKKLGLWGLFTRGLPLRIVMIGTLTGAQWGIYDAFKVMVGLPTTGGVAPTPAAAGEQLKG

SEQ ID NO: 106017 - protein, 91 aa, Triticum aestivum
  unsure (1)..(91): unsure at all Xaa locations
  Clone ID: PAT_TA_435.pep
MWHYLAHSELSTVFYDKVLLLHXGYNNIFILAIGVVVFIXATVGVLLVMETLSAFLHALRLHWVEFQNKFYEGDGYKFAPFSFALISEDEE

SEQ ID NO: 106018 - protein, 73 aa, Triticum aestivum
  Clone ID: PAT_TA_436.pep
AILRNSTSKIVFAHESTTHQHNTPPGILPRHPMRGPSSVLTLILSLLLVTINLSMNCIGNQVVLYRGRGYSNR

SEQ ID NO: 106019 - protein, 95 aa, Triticum aestivum
  Clone ID: PAT_TA_437.pep
MAKPQQEVYFVFMNFDPVYERLRADRTKQGSATLDAYLSQKHDKLLAKLLQPDTYWKKSSLAIVDGFAVEITDAQASVLRSAKEVRVVEKNQELA

SEQ ID NO: 106020 - protein, 322 aa, Triticum aestivum
  Clone ID: PAT_TA_438.pep
MDRKVGVVLVCLLFLLIGEVSAVAQTEVGHVRVTQEAPDLKLEDAGRHDVSQSGRVSVYVVAWSTLAMAAATGLGALPFFFLELEAQWAGLCNGLAAGVMLAASFDLVQEGQMYGSGSWVVFGILSGGIFIWLCKKILEQHGEVSMLDIKGADASKVILVVGIMTLHSFGEGSGVGVSFVGSKGLSQGLLVTVAIAVHNIPEGLAVSMVLSSRGVSPQKAMLWSIITSLPQPIVAVPAFLCADAFQKVLPFCTGFAAGCLIWIVIAEVLPDAFKEATPSQVASAGTLAVAFMETLSTVLQGFTDGHGLEDTSGFLVSLVFGL

SEQ ID NO: 106021 - protein, 401 aa, Triticum aestivum
  unsure (1)..(401): unsure at all Xaa locations
  Clone ID: PAT_TA_439.pep
MEAMEELSQLSESIRQAASLLADDDPSDDTAPRRPSTFLNAVVLGNVGSGKXSAVLNSLIGHPVFXPSGEESGRPGAPIVVDLQREPGLSTKSIVLHDRXKSQQVSASALRHSLQDRLSKSVSGRGRSDEISLKLRTSTAPPLKLIDLPGLDQRAVDDSMINDYAGHNDAILLVVIPAVQAAEVASSRAIRLAKDIDPDGSRTIGILSKIDQADGDTKTIACVQALLLNKGPKNLPDIEWVALVGQSVAIASAQSGSVGSENSLETAWQAEAETLKSILTGAPHSKLGRVSLVSAIAKQIRKRMKVRLPNLLTGLQGKSQMVQAELARLGESMVQSPEGTRAVALELCREFEDKFLAHITSGEGSGWKIVASFEGKFPDRIKQLPLDRHFDLNNVKRIVLE

SEQ ID NO: 106022 - protein, 160 aa, Triticum aestivum
  Clone ID: PAT_TA_440.pep
VTFQSYRANLIYQVYFLTVGGTQLHADARRNSLEEAVRLCRAGGLQGIVSEARAVFRHPSAVARVKESDLSLLTYGQLNNVPEAVYMQHLMGVDGVIVDLVQEIAEAVSEFAAVVAPEPSPEEGQAGRLGLDRAAPAKKTPNFSQREISFLLRLIPELVQ

SEQ ID NO: 106023 - protein, 83 aa, Triticum aestivum
  Clone ID: PAT_TA_441.pep
EDPVGLHMSPHLLLPDTRFSYEHHLALLLLHTPHSSPTIDSREARGVSRPHFSSLAQPPTSYSSTTPSLSAGRHGHAHTRHVA

SEQ ID NO: 106024 - protein, 173 aa, Triticum aestivum
  Clone ID: PAT_TA_442.pep
KSSIAKAGPRPSVSRFLTGKSYAPQGAESLLLSCISHTRGRKKLFHLSSRNKMTTFSVKKKCPPFLYDYIETQLNLHDDLMSGRPILHRQMQPDTDPGTRRHVPVISVSIFNYPFNTQRRMRFQPLNAKNSCSWLRRTWTRPRRRKIFWGSTRHQCFHVTPHLLYLHEARDLA

SEQ ID NO: 106025 - protein, 189 aa, Triticum aestivum
  unsure (1)..(189): unsure at all Xaa locations
  Clone ID: PAT_TA_443.pep
MPPFPLPVLAVVLLLCLGAPHAAGNPPDPPPAPTPWPHQFHAKLLMDYKGNLSLADLWYDWPGGRNLHVIRYQLPRAAPYYDXVVEQGWAKVEHATYYEVAQTRRPLKWVFYTGRTAHVMSFEPGAVLEDAAEWQAPDYCFAAGNDRADRAPRPGVLPRRAVPARGEPRPSGGAGRPHGMAGARLLLRH

SEQ ID NO: 106026 - protein, 194 aa, Triticum aestivum
  unsure (1)..(194): unsure at all Xaa locations
  Clone ID: PAT_TA_444.pep
RKGLDVSNLAEISDASXSLDRATPERAMHTANLCLRLLLSRDSIVIRRLIMTANHKSLARDLISKDAAIFRALLSRALADVVCQWMVKAAGLKRSRDRMGDDLGMSLSKEAPISPVVSSLQEVVRDRRLKVIFSKFVKDLMEVPMLMVRVGWSALVVSAVSAAIGAHRFAVLLSEEYLPTVWTPAPPPPQLAWS

SEQ ID NO: 106027 - protein, 156 aa, Triticum aestivum
  Clone ID: PAT_TA_445.pep
FDVINKVVRLREDDRRDRGFGITLLTQSPASALWWSSYGGAQHAIWRSLGYGNGTQKKPSHTELVAVQATAGTIAGACSSIITTPIDTIKTRLQVMDNYGSGRPSVMKTTRLLLREEGWRGLYRGFGPRFLNMSLWGTSMIVTYELIKRLSVKPEQ

SEQ ID NO: 106028 - protein, 122 aa, Triticum aestivum
  Clone ID: PAT_TA_446.pep
LILDNGGWRVVDQKSPAAGLASPPLATSPVSAVFMLKLLRLRPPTLFTEKLFSCTPAAASTGAAVWLSSKSPSRARPSRVMRSSLFLAPAIDACGRLRDCADGGGFICLLRWIIRKLWGLVN

SEQ ID NO: 106029 - protein, 93 aa, Triticum aestivum
  Clone ID: PAT_TA_447.pep
LVLDCGVPEGGRWEVAGGGSGLACPPFALSALGAVHAEAVETAVTRRRSWRSCSSCTPAAASTGAAVWLSSRSPSRARPSRVMRSSLFLAPAH

SEQ ID NO: 106030 - protein, 144 aa, Triticum aestivum
  Clone ID: PAT_TA_448.pep
RRHILYSMHPPVGPTNLLHHGPSLHNSINPPDCSPRSTRTLQSFVAMPASSSSVGHDEILPLVPCRDWSAMILIWRSYSPQPHHLPPIWSLYSALQHFFSVRIMVAITLVHICQRRLARRRLHYHPLHTLFQDSSLPASITTDP

SEQ ID NO: 106031 - protein, 106 aa, Triticum aestivum
  Clone ID: PAT_TA_449.pep
SALRTDSMNLAALLVDISGRGVGGARRGVDGGSGPGVVGGCCSLAGGAGWDAGVPAYLGYAIATVLLIPLAPFFIAPSIALCSLLCKVFDYAFALCLRTCGLAGAR

SEQ ID NO: 106032 - protein, 178 aa, Triticum aestivum
  Clone ID: PAT_TA_450.pep
HNSLCLSEFQHLKNTIRIPSPELKLSFSTVYIRRAARAPPLLPDPDGSRRRNPMARRPAGSSPVRSPQRATVVRVLVAGEVIHAFGFPLPVVVPHARVRRRRRPLVGAPVLVQARGAPQQQLARRAVPHQPVQAVAVPPRRRLLPRRDDGVEGRVPRHVQRLLVLRGGVAVSPVLRRE

SEQ ID NO: 106033 - protein, 136 aa, Triticum aestivum
  Clone ID: PAT_TA_451.pep
HASAHASEIRPCIGPIRCSRDSRKCPPVPHLPPAARSPPIPPPATNSPPRPRSAPSPPRPASRSGRRADTDPRDQAAPAPPVLDPAAALPASVLTCPAPRPQRRGWQSPRGPSIDRQKGGLPGELSFLFFLPQNLW

SEQ ID NO: 106034 - protein, 419 aa, Triticum aestivum
  unsure (1)..(419): unsure at all Xaa locations
  Clone ID: PAT_TA_452.pep
MIRPSSKESLNYDNNSQKVYPQPIDENMNQNMGSMIGRIFNNISSLKAAYIQLQEAHTPYDPDKIQTADKLVIDELTSLSELKHTYRERNPKPVAASPQDSRLLSELQEQQNLLKTYEVMVKKFQSTSQVEAXIFSKLSXELDEAQYRKTXLEKELKQRGLLNKDSDESDEEEIYLSIELTPSLFTSTAGIAYKLIHDFSKPWTTIVITAVRGLDTAANVLEPDVVYXKXPLYRYKSVSYICEKMISGLHEERLSIMAATARVSNEAFVLQFLGVRAMDPLVVLSQNPDSVFGKFCRSKYLLLVQQKMEGSFFGNMDQRNYVMSGGHPRTAFYQAFLKLAKSIWLLHRLAYSFDPKVRVFQVKKASEFSEIHMESVVKNIILDENADRPRVDLMVMPGFLIGTSVIQSRVYLSAVKCAD

SEQ ID NO: 106035 - protein, 94 aa, Triticum aestivum
  Clone ID: PAT_TA_453.pep
TSVMAARGALWNASIFSAKGKVPWEDFKTEYVRKTILWDNDIKSTKTTLREIIMHYICLEGTEGKGVIKCGLSADVARLYGEEDYYNFVVSNRK

SEQ ID NO: 106036 - protein, 125 aa, Triticum aestivum
  unsure (1)..(125): unsure at all Xaa locations
  Clone ID: PAT_TA_454.pep
RQHRRRPCRGVRCCCSCWRLRRGGGHIQARRRPAIGSAGSRDEDDDIGEADEPGKAGRSGMGRRHPDPSGSGRIPTNLKENGGWKVSSGDAMGARPACCGGRRGRRHVTQPATESLEGTRVXLLL

SEQ ID NO: 106037 - protein, 181 aa, Triticum aestivum
  Clone ID: PAT_TA_455.pep
SGKLIPQPHHRPPIRGHALVEVFAAAVLTGGAERGGCLNASWGVGRPCAGACGGDDCSRGGRTRHREGGAARDGRGRHRSGRANQAGQGGREWSRRHPDPAGSGPNLKENGGWKVSSGDAMGARPPLGRAAVGGAGDGLSRSRRRSAAESLEGTRVRCWGAAACCWYGARVRGCRAGARAR

SEQ ID NO: 106038 - protein, 144 aa, Triticum aestivum
  Clone ID: PAT_TA_456.pep
KRDKVDCYNIEYEQIPHFCFSCGRLGHSDLFCPTPGTRDAKGDLPFNSSLRAAEDRKKGFSGESSSKERYETRQSTKESWTPSSQQNKGVEVTSPVKNPSLNKRKGGPQQVYRVEPAPLAMTEHGEVHATTEEASGKSSAADSE

SEQ ID NO: 106039 - protein, 65 aa, Triticum aestivum
  Clone ID: PAT_TA_457.pep
STLQVLHATSISTRYMNTYTHYMDLECSIGGGLYVNVDQKLPIAGVCRRRVDVLRLRRPSDVALN

SEQ ID NO: 106040 - protein, 77 aa, Triticum aestivum
  Clone ID: PAT_TA_458.pep
SRRCLRQMDAIRALVVTHTFSTYPLLRRQLSCDQCSDASSDAGLPGCRSHSSDDDLASQNPFHGNGLHDHHPEYVRL

SEQ ID NO: 106041 - protein, 249 aa, Triticum aestivum
  Clone ID: PAT_TA_459.pep
GSSAPSLRPTAPRQSARSNLFSPSELAVTADPTEEMTEEEKKLHDKVELIRVKFLRLVYKLGATPEETVAAQVLYRLSLAEGIRHGRQTNRAFSLENARKKALLLEAEGKEDLSFSCNILVLGKIGVGKSATINSIFGEVKSKTDAFGAATTSVREIVGNVDGVKIRIIDTPGLRPNVMDQGANRKILASVKKYTKRCPPDIVLYVDRLDSLSRDLNDLPLLKTITSVLGSSIWFNAIVALTHAASCAS

SEQ ID NO: 106042 - protein, 193 aa, Triticum aestivum
  Clone ID: PAT_TA_460.pep
RPPLGFFSSRRRAPLRPSMRELALACSLSKTLSPIAHPLLFILVSPSASDDLSTHSFDYRAFLLVGSRLVPASLTVVNVGPGFRDQYHSFAPESPFPLLQTKPPPAAPQADDAYSIGEQKAVDAMVERFGLGRLQGLVCAAAGQAAGMDSMYAGMLRRMEKLAREVEKSNHRVLDQERRNLVMRCKTAGLQLQ

SEQ ID NO: 106043 - protein, 65 aa, Triticum aestivum
  Clone ID: PAT_TA_461.pep
SAASHTYASFYYFSSIIFHMTVAATKCHKIVAQCKWTREILLRMHSCYHHVLTVILQTRVLPLAM

SEQ ID NO: 106044 - protein, 184 aa, Triticum aestivum
  unsure (1)..(184): unsure at all Xaa locations
  Clone ID: PAT_TA_462.pep
SLKCETTCFNKKIREIYCLYHMYQQYPPVILRNLNSSCIYLTEDNAAKISDIGFGDDWKEGEDEFDEPEECTIVYRLPCFLLETISGRXPFSNDTGLLILWAHRYLTGEKPLTGMIDPTLRSVPLEQVAALTELVKLCIRDDPWRRPSVGEVTRRMQEITGFSQDQSTPRNSALWWAELEILTV

SEQ ID NO: 106045 - protein, 157 aa, Triticum aestivum
  unsure (1)..(157): unsure at all Xaa locations
  Clone ID: PAT_TA_463.pep
VWFYIIANELXALLVAFGVILGINPSILGLTVLAWGNSMGDLMSNVALAMNGGDGVQIAMSGCYAGPMFNTLAGLGISMLLGAWSTAPNSYVLPQDRSLIYTMSFLVAGLVWALVTLPRSGMRPNKTLGVGLIALYSVFLFIRVSSAMGILPLPGLN

SEQ ID NO: 106046 - protein, 102 aa, Triticum aestivum
  Clone ID: PAT_TA_464.pep
YTVAHHLSATMIDYSLLTHLPLSSPACCHVLPSITIFLMIVSTQSVAPPKTIALRCLQSSQVMSERMILVSFRKKENNGPRFVSQVIVNSGSLVRIPNSRPH

SEQ ID NO: 106047 - protein, 257 aa, Triticum aestivum
  Clone ID: PAT_TA_465.pep
MDRYQRVEKPREEVPIKENEIRITTQGRMRNYITYATTLFQDKGCDEVVFKAMGRAINKTVMIAELIKRRIVGLHQNTATESTDITDTWEPLEEGLLPLETTRHVSMITLTLSKKELDTSSVGYQSPLPADKVKPFLEYENEEDAHSPPGRGRGRGRGRGRGMGRGRGARGNGYMEYADGGWENEHAPAYAGNGYADHGPAYEGNGYGAVAGEGAMVVSLIISMMEGIMSRRRRPPRRRGRGFRGRGRRGGYGGGHA

SEQ ID NO: 106048 - protein, 145 aa, Triticum aestivum
  unsure (1)..(145): unsure at all Xaa locations
  Clone ID: PAT_TA_466.pep
CRPKDQGGLGIENLKVKNRCLLSKWLWKLVSGTEAMWAQIIRSKYLQTRTLSQVSVRPTDSPFWKGLMKVKVLLFNRXKWSLGNGATTRFWEDSWLGDSPLAMQYPSLYRIAQRREVFVATVFQTIPLNIQFKRSLVGTLGSLVH

SEQ ID NO: 106049 - protein, 216 aa, Triticum aestivum
  Clone ID: PAT_TA_467.pep
MSIKHCDKHDCERRRLYRQFCAALVAVILLILLIVLIVWLVLRPTRPRFYLNGLTVACLNATSSPASYLTVTLQATIAARNPNSRVGIYFDRTDAYAEYKGQQVTVPTALPVVYQGHLDVSVWSPFLVGSNVPLAPYLAVALAQDETAGYVLLTVRVDGWIRWKAGAFITGHYHLRVRCPALLTVNGGQGSYGSIAGGGGNGYFNFQRAAPCVVDV

SEQ ID NO: 106050 - protein, 237 aa, Triticum aestivum
  unsure (1)..(237): unsure at all Xaa locations
  Clone ID: PAT_TA_468.pep
GLGFPPKIKKLGPYLETPIGKRAWWGLPNLFCAPFWSPLGFWDQGPFQEGFXMVGSXKAKNPFLXCIASCTXVDGSGLAPVKNGILPGFFSLKKMGKIAMQMEDXHMRIXVSSCSSPFSSKLSTEAEFSPYAVHMLPPLYKVAEGFAGKVISDEVKQSAEVTRDKLRDLIGVEKFVEIYNSVRKDLKAKRESRKQAEKLVAAVDPARHAKRKLRMSAKHREHKKRKITAMKMGRWLR

SEQ ID NO: 106051 - protein, 67 aa, Triticum aestivum
  Clone ID: PAT_TA_469.pep
ESSILGSCFFIFLHVYLVIRSIFSSLFLFRTFPLPLLRIISCGTLPNIGSSMMLPVGSSIQCCHGSF

SEQ ID NO: 106052 - protein, 210 aa, Triticum aestivum
  Clone ID: PAT_TA_470.pep
MITNLYSNSQEEVNRLTIEINKLNRKLNEVESVSSELKNTILLLNTEKDTALLQHKQSLVRVSDLESKLSQVQAELENSEQKGQMLNKELKQKREEVDTLQTKLKDEAHKHIEAEASLLMMTNMHSQSQEEVSGLVLKIERLNDKLNEMESSKLDLESMISKHAEDNRILGEQNLSSELTISGLHDELDMLKEMKVNLENEVGLHIGDRE

SEQ ID NO: 106053 - protein, 428 aa, Triticum aestivum
  Clone ID: PAT_TA_471.pep
HFVPLLLHSRAVSAGVTTTEHLLQLTDKVVDEYDSYFSYLPLAHIFDQVIGNYCISKGASIGFWQGDIRYLMEDVQVMKPTIFCGVPRVYDRIYTGINQKIQSGGLIAKHLFQYAYNYKLGNLMNGFKQHEASPFFDKIVFSKIKEGLGGRIRLMLSGAAPLPRHIEEFMRVTSCSVLAQGYGLTESCSGCFTSIANVISMIGTVGPPVTAVEARLESVPEMGYDALSSAPRGEICLRGHTLFSGYYKRPDLTEEVYSDGWFHTGDIGEWQPDGTMKIIDRKKNIFKLSQGEYVAVEVLESAYTQSQLAASVWVYGNSFESFLVAVVVPEKQAIEDWAALNGKSGDYAELCNDPKARRYIQDELNQTGKKLGLRGFEMLRAVHLEPVPFSIDKDLITPTFKLKRPQLLKHYKDRVDQLYKDAKMGTAQ

SEQ ID NO: 106054 - protein, 374 aa, Triticum aestivum
  unsure (1)..(374): unsure at all Xaa locations
  Clone ID: PAT_TA_472.pep
PTRPPTRPGQGSAASAAHYGLQSQMMAQPRQKGMVQGAQFNTANAAQALQGMQSMGVMGTLGMNQMRPNGTIPYAQQRFAQAQMRPQQASQQAALSPQKGVXSRLVENSIDHRIKLTTAWSVTKWADDANVTFATTAAVVEANAIIFGLAISTSNSAAAQDAIDATTSERTDSTPDCTSPTTAFTASQCPXLMQQQHIMQQLQQQQQQQSPRMSASGSQKSANLTGSQPGTPLSGGTMAGGSGSQGAEGTNQLLGKRKIQDLVAQVDPLGKLDPEVEDLVLEIADDFIESVTAFACTLAKHRKSSVLEAKDVLLHLQRNWHLTVPGFSKEDKHPQRNYVKAVVDPQQPESHASAGSHPFWKPRMCCCTYREIGI

SEQ ID NO: 106055 - protein, 312 aa, Triticum aestivum
  unsure (1)..(312): unsure at all Xaa locations
  Clone ID: PAT_TA_473.pep
MGDSYCQDCKKHTEVAFDHSAGDTVCTECGLVLEAHSVDETSEWRTFANESNXNDPVRVGGPSNPLLTDGGLSTVIAKPNGAHGDFLSSSLGRWQNRGSNPDRSLILAFRTIANMADRLGLVATIKDRANEIYKKVEDLKSIRGRNQDAILAACLYIACRQEDRPRTVKEICSVANGATKKEIGRAKEFIVKQLEVEMGQSMEMGTIHAGDFLRRFCSTLGMNNTAVKAAQEAVQRSEELDIRRSPISIAAAVIYMITQLSEDKKPLKDISLATGVAEGTIRNSYKDLYPYAARLIPNSYAKEEDLKNLCTP

SEQ ID NO: 106056 - protein, 59 aa, Triticum aestivum
  Clone ID: PAT_TA_474.pep
FSWKLCVAKFKCVCTSYCTEQASVLYYYYYKECSVCYYMCLPIIKLTKSWVFFLVRTWI

SEQ ID NO: 106057 - protein, 131 aa, Triticum aestivum
  Clone ID: PAT_TA_475.pep
MASTGVKDFYRQKKKGGVGKTSASSKKKTQNYTGGASVGASNKAQTAALISHGSLDLKDDFSEQEEQLRQFDMDMKFGPCIGVNRLQRWERASAMGLQPPPHLRDLLARASSGNNRNNGGPSPECLWEGKI

SEQ ID NO: 106058 - protein, 307 aa, Triticum aestivum
  Clone ID: PAT_TA_476.pep
PRVRPRQELYQWQSVARSARNALGMRYRMLPYLYTLNYQAHLTGAPVARPLFFSFPDFAPCYGVSNQFLLGAGVMVSPVLEQGASSVDAVFPPGTWYNLFDTSKAVVSTGSGAAVRLPAPLNEVNVHVHQGTVLPLQRGGTISRDARVTPFTLVVAFPLGAADADAEGAVYVDDDERPAMVLAEGQATYARFHAAVRGGKEVTMRSDVAMGSYSMHKGLVIEKITVLGLHGAGTDLAIQVDGADDATAVATSSPYFAAADAAQVLRQGEEDDAVEGEKRSGVTMEVGGLALPLGKSFTMTWNMRIQA

SEQ ID NO: 106059 - protein, 264 aa, Triticum aestivum
  unsure (1)..(264): unsure at all Xaa locations
  Clone ID: PAT_TA_477.pep
HASAKTIIPACNAVVDMSTNSRDLIERELAAFGQSLENSLCRLPATPQALLEAVGSNGATGSEALASAEKQAAMLTARAGARDPSAIPSICRISTALQYNSVSPGTEGTDSGLASVLSALEFCLKPCGSEASILEDLSKAINLVHTRRNLAENDRVLLNRARPARPEYERVANYCLKLAGEQEKVVAERWLPELRNAVQEAQRCFXDCRRVRGRRPEWYEQPAATIVDWVTIDGQSVGAWINLVKQLHMEISRRTLAMSSAGEE

SEQ ID NO: 106060 - protein, 299 aa, Triticum aestivum
  Clone ID: PAT_TA_478.pep
MDAGRKRAVPEGTNGGAAVKRARESESVQTGVGSKSKPCTKFFSTAGCPFGSSCHFLHNFPGGHQAVSKMTNLGGPAVSAPQGRMPMGPGVPDGPPTPSLKTRLCNKFNTAEGCKWGNKCHFAHGERELGKPMLLNNSMAPPMGPRPNGHFQPPPMPGPDMVPPSTFGASATAKISVDASLAGAIIGKGGVNTKHISRMTGAKLAIRDNEADPNHKNIELEGSFDQVNHASAMVKELILRIGGNAPPQAKNPGRGPAGGGGGSNFKTKLCDNFNKGSCTFGDRCHFAHGESELRKSAAA

SEQ ID NO: 106061 - protein, 139 aa, Triticum aestivum
  Clone ID: PAT_TA_479.pep
LQQCKVITAIISWNTTSWTRIGSKKVTRDAISAFSVSPDGTLLAIGTIEGSISVLGPRDMRVVLTVKKAHLGIVTTLAFSQDSRALLSTSFDSTTRVTSTESPKSDGISLWSMVLAIILGILVYYYMQHKEDLLAMLPQ

SEQ ID NO: 106062 - protein, 397 aa, Triticum aestivum
  unsure (1)..(397): unsure at all Xaa locations
  Clone ID: PAT_TA_480.pep
MAPRAGGQTYGFPIYCASWLPLAHIIKPSPSADDVVDADASPAPSSPPPRPMVVLGGGGGEGRSGVPNALVVAALEPAAARAPPALSPERVFRLGTKEQLQDSTAVYPCRDGTLXSNSQYLGRYHCCRLTRRXDAHSLILRSDQEALVKLNDVGLQLAVSFSGEGSILATGGEDGHLRVFKWPGMETVIEEPDAKTSVKDLNLISXNVATMKILSSGSSRVWDLKSSEAVANLPREQGEIFGFCRFSYXSDNSQILFVTAMQGDYGKIISWNTTSWTRIGSKKVTRDAISAFSVSPDGTLLAIGTIEGSISVLGPRDMRVVLTVKKAHLGIVTTLAFSQDSRALLSTSFDSTARVTSTESPKSDGISLWSMVLAIILGILVYYYMQHKENLLAMLPQ

SEQ ID NO: 106063 - protein, 172 aa, Triticum aestivum
  Clone ID: PAT_TA_481.pep
MALSSSSSTLLRRLLGSTPLSSSRSSVLRAAFCSSSSAAPSPTLPPPSTIFGDDTEVANVPPLTTPKLFVSGLSRLTTDEKLKSAFAPFGQLLEAKVITDRVSGRSKGFGFVRYASLQEAETARQEMNAKFLDGWVIFVDPAKQREQKPAPQPDTASSHAGFTINKTVGWCG

SEQ ID NO: 106064 - protein, 56 aa, Triticum aestivum
  Clone ID: PAT_TA_482.pep
RRSPSPPSWSLPRPPPSWPPKQHPPATPTPWQPPPPPPSPPASPSSHISSTDGEKA

SEQ ID NO: 106065 - protein, 109 aa, Triticum aestivum
  Clone ID: PAT_TA_483.pep
MASSSNPVSMDMDPPVVSIAVEHGPPESRLVQLGVRSWPKWGCPTGKFPVKFDARQTCYLVKGKVRAHIKGSSECVEFGAGDLVVFPKGLSCTWDVVAAVDKYYKFDSS

SEQ ID NO: 106066 - protein, 141 aa, Triticum aestivum
  Clone ID: PAT_TA_484.pep
LEGRCSEVSFLADAATHLAMTAHVVIVDEHVRIKHVPFLVILRVRVRGVAPDAEHRLQTLGEDPGCVLRGARGQHVQRCFPGVIALAEGERVGLPLPGRHPHRLRSPNDPHRSSRTCVRRFTIPTRLLADADYQWVYASIW

SEQ ID NO: 106067 - protein, 128 aa, Triticum aestivum
  unsure (1)..(128): unsure at all Xaa locations
  Clone ID: PAT_TA_485.pep
MAGRLTAMGSRIMGGHGAAARAGASALRNRAGMGLPAGRHIVPDKPLPVNDELVWDNGTPFPEPCVDRLAPHIGKYEALAWLXCGGLSFFAXLSGLAAVVNDKASKXMPYTPKVYPFDNLRAELGDRS

SEQ ID NO: 106068 - protein, 123 aa, Triticum aestivum
  Clone ID: PAT_TA_486.pep
FGTSSGPCIPCQYTEKNDENYCCSETGYRLPLKCVQVQNGTKEENKTKDRKMLAETSTPTGPKHYVTYRSCVELEDEEVLSILGFEVLMAGMLLVSGPFVYYRKRQASLMQGVSRIPTNAPRF

SEQ ID NO: 106069 - protein, 153 aa, Triticum aestivum
  unsure (1)..(153): unsure at all Xaa locations
  Clone ID: PAT_TA_487.pep
YIIRSNKLMAGKNFFQNEKKFQLSTVSSFPIHSVSSAAAFRSIFGFFPLLWAAGLVGSGGPLGRFTAEHRGSALGDEXTYVRXGXGTRTRRMAGFSGGRRPCLKAAXAGCAFPGXXGTTXXGGTPDEXRTXXXPAKRADRARRRRAXRAXADT

SEQ ID NO: 106070 - protein, 74 aa, Triticum aestivum
  Clone ID: PAT_TA_488.pep
DYFIRAWHVLFTSMSMYMFYIVVYITTMLVWKHIPFVEYTLFFFSGGIYIPHIATLFLGKGTYAIYISILHNIV

SEQ ID NO: 106071 - protein, 102 aa, Triticum aestivum
  unsure (1)..(102): unsure at all Xaa locations
  Clone ID: PAT_TA_489.pep
PGSGGRRESRGDDAAEQKMGVQSLSLGVQQRRDRLPVDAIPVPPAMAVTPEDREDRGPGTINSXRTDQQSKPGQPDQWKEFALGDLDLVEILNKCYKGSRFC

SEQ ID NO: 106072 - protein, 322 aa, Triticum aestivum
  unsure (1)..(322): unsure at all Xaa locations
  Clone ID: PAT_TA_490.pep
MVGSGRERAKAPSSSARGLRSSIPDAPLRRALLDSMATPPGPSSSTAVPSRGRGRKRGGGARGRGRGGRVTATAPSSPPPPAVSPEHVTARVDSSEEEATRTPVHEPPVHGSWAHEPRAHVTPEEHTSGWVTWPDQPEEPSGHADDGGEPTDLEEEGGTVYQRGATRLPVRXPATREQRWLIFPDGERGWXTIIVSAGPNSVLGVLCRQNFPGFVTLPGEGRLPELGLSWEHYVAAPAPPDEIIDGVVCDTRADMVIRTFWTFYRCEEGYEXTAAHVIENVCKRLLQNLRHEARVQAVRDYYALRGIKKTKPACRDKFLSKS

SEQ ID NO: 106073 - protein, 54 aa, Triticum aestivum
  Clone ID: PAT_TA_491.pep
EPPGCRLNGLGIKTGVDLSKVIAAGEFICKHLGRQSGSKAATALSKVTASASKL

SEQ ID NO: 106074 - protein, 48 aa, Triticum aestivum
  Clone ID: PAT_TA_492.pep
KNYYRGCTGYIITVFVDGQVIMVVPMILFPTHQNESRFCVTSSTLMNK

SEQ ID NO: 106075 - protein, 126 aa, Triticum aestivum
  Clone ID: PAT_TA_493.pep
NLSAFISSTSSGRLLLVLVHAHSCDMAMAKLQSSSKSQLITVRFYLLLQKIEQRWNQSRVRERKQDLFTWASSIHGHRRSNLGHRPAAGGRATIRPSTAGAGSSGWMASSGRRRSCCGGAWACGRA

SEQ ID NO: 106076 - protein, 211 aa, Triticum aestivum
  Clone ID: PAT_TA_494.pep
MIISKKNRREICKYLFQEGVLYAKKDYNLAKHPQVDASNLEVIKLMQSFKSKEYVRETFSWQHYYWYLTNDGIEFLRTFLNLPSEIVPNTLKKSAKPPSRPFGSGPPGDRPRGPPRFEGDRPRYGDRDGYRGGPRGAPGDFAGEKGGAPAEYHGVKKRLFSKWEHPTGLQIQCARGVLSSLLMFEFCKHCDDFVYRDCSLRPWFMGSFVLE

SEQ ID NO: 106077 - protein, 120 aa, Triticum aestivum
  Clone ID: PAT_TA_495.pep
LCFYLLQKIERKRAGKGTFFTWASSIFHSTPPVDGQTSTVGRSWLIWVGGWLAAVDEVVVAAGLGHVAEHDEHQGDHHGQQEPLGVQPHATIAAAVVVATVAAADAAARSRPHGDGPLSL

SEQ ID NO: 106078 - protein, 182 aa, Triticum aestivum
  Clone ID: PAT_TA_496.pep
MIISKKNRREICKYLFQEGVLYAKKDYNLAKHPQVDASNLEVIKLMQSFKSKEYVRETFSWQHYYWYLTNDGIEFLRTFLNLPSEIVPNTLKKSAKPPSRPFGSGPPGDRPRGPPRFEGDRPRYGDRDGYRGGPRGAPGDFAGEKGGAPAEYQPAFRGAGGAARPFGRGGGGGTFGSGATME

SEQ ID NO: 106079 - protein, 188 aa, Triticum aestivum
  Clone ID: PAT_TA_497.pep
MIISKKNRNEICKYLFQEGVLYAKKDYNLAKHPQIDVPNLQVIKLMQSFKSKEYVRETFSWQHYYWYLTNDGIEFLRNFLNLPSEIVPATLKKSARPPGRPLGSGPPGDRPRGPPRFEGDRPRYGDRDGYRGGPRGAPGDFGGEKGGAPAEFQPSFRSSGGGGFGRGGGGGGFGRGGGGGGFGTGPME

SEQ ID NO: 106080 - protein, 295 aa, Triticum aestivum
  Clone ID: PAT_TA_498.pep
RARTVEATEHHKIQRDQHLYLPVPVSEVKGKGAVAMGSGSCCCIGCGNGGDDDGGGDGGMGLDPKGFLLAMMIALDARYGLPHAQGPPQRRPPPPPPPLRAPAPPPAPLPPLRAPAPPRPHDRPPEDPPRASASSSSKQGVLHAEEDYKPWPSTPQRDEASNLDGQQAHAQLQAQGSTSRGKASTSHALLLVPDQRHALSSYASFLNLPSQTSAQPLSSTPPKPPSRPFALSPRHVRRPPALLLRFWGRERPPVWVPPGMGTGTRAHVVREGGSRGRCRWLLLWYWAGRSVGVWW

SEQ ID NO: 106081 - protein, 190 aa, Triticum aestivum
  unsure (1)..(190): unsure at all Xaa locations
  Clone ID: PAT_TA_499.pep
MANTTSWSSGLCGCFDDVGGCCLTFFCPCVTFGRIAAIVDKGETSCFVSGSGYLLLNWLTGLACLHSFRYRSKLREQYGLQEKPCPDCCVHMFCEACALCXEYRELXTRGFDMSAGWQENGAATAAPQMNPRDDSLVRPHLPISRLLHTLHAYQSDYCTQCMPASTPVSSSDYVYDRVYRVRLPPYESFP

SEQ ID NO: 106082 - protein, 206 aa, Triticum aestivum
  Clone ID: PAT_TA_500.pep
RFDFGTATAPKWRATASSCWRRRRACTPRRGTSNTAEQSSDRSEQSSGPPGRLTWITASSFSSSSFLMPPPASLPAQQQQLCAPMMGMDMEMEMEEQLCFVGRGGGGGGGERKRRFTEEQVRSLESTFHTRRAKLEPREKAELARELGLQPRQVAIWFQNKRARWRSKQLEHDFADLRADYDALHSRVGSRRRQKLPRAALHRGEG

SEQ ID NO: 106083 - protein, 99 aa, Triticum aestivum
  Clone ID: PAT_TA_501.pep
DTISLPAYLKVPSGMPTEKLLFSEIACMSLSICTNVRHIFSYKGYHFFNMKPHESYFLKSVRLPAMRHHLSPVHFRSFAIRHDVAEPPPSISLKTLIAR

SEQ ID NO: 106084 - protein, 94 aa, Triticum aestivum
  unsure (1)..(94): unsure at all Xaa locations
  Clone ID: PAT_TA_502.pep
GRPPKVRPPGHYPGGAXPPSAPLSSDGLAVVAVATAPRRRGRPPKPRDPDAPPKIPRPRGRPRKNPLPDGMVPVPRPGPTTAKPRPQFAEVGFV

SEQ ID NO: 106085 - protein, 185 aa, Triticum aestivum
  Clone ID: PAT_TA_503.pep
HFRAAFFVCWVQLIRTSCIIVPSYMSFLQPFFTTDNSHGNLEYRSFIETSKRHVLSTKYKKGNEESSCGTQYQHFSTLVRSFRFFICFFQESHFVPHGAYVGSQLFKFRLTMSAEFCFILESVGVSHVGFCARMRIRFDPPSAIAEGPPWAPREGPLRDRWPEHGEGPLRDRSPESAACGGSEQQ

SEQ ID NO: 106086 - protein, 376 aa, Triticum aestivum
  unsure (1)..(376): unsure at all Xaa locations
  Clone ID: PAT_TA_504.pep
RSSPPASPCSCPAPPHRPPIAAAVWLLGRGGASLVWAGSLAGGSDVAVGVLDDAVALPPPPASDTDILSSINLAFDVADAAASVSSNDLLSAYASLQGGRLGEMLPGVEHXMSMFGWTERFNVAVGVAHALDYLHGNGNSRPVFHRDVKSSNILVSEDFEPKLSXDFGLALWAADATPQITCNDVAGTFGYLAPEYFMHGKVNDKIDVFAFGVVLLELVSGRKPLCTGCPKGQESLVMWANSIIQGGKLTQLADPSLPTEGHTDEIERMTLAASLCIRPTPQHRPHIAVVLKLLDGDNDILKWARSHVGLSYKSDGDEDMVTLAPPENNTNIQSYINLAFDVEDDSAAVSSNDFITANTSLEEYLQGRWSRSSSFD

SEQ ID NO: 106087 - protein, 197 aa, Triticum aestivum
  Clone ID: PAT_TA_505.pep
MAARPSPPPPTRASCGSFLQELQELWGEIGPDELERDRMILQLEEDCLNVYRKKVEQTRKQKADLLQVMSLGEAEIEKILSALRERESFSRVEKLGGTLIEQLAKLEPVLDDLRRRRDERINEFLAVQLHIVRLQAGWSAQVYYGDVAADVSYETDLSTGRLAELKTQLNELQTEKNLRLQKIDSQIKCINEMCNMM

SEQ ID NO: 106088 - protein, 223 aa, Triticum aestivum
  Clone ID: PAT_TA_506.pep
YPRVRGTHWDGVVPPDCAPSAAVLRLSPSLRWEQAREPLHQGIDGNRTCGVGPGMSFANAVLRSGGARGAAVALVPCAVGGTRMAEWGKGSELYADMVRRARVAVETGGRIGAVLWYQGESDTVRWADASEYARRMGALVRDLRQDLAMPHLLLIQVGLASGLGQYTEVVREAQKGLKLRNVRFVDAMGLPFQDGHLHLNTQAQVQLGHRLAQSYLTYGTFKH

SEQ ID NO: 106089 - protein, 206 aa, Triticum aestivum
  Clone ID: PAT_TA_507.pep
QHSTPSTPLHLPCLALLVHITTPPSCLALLVHIISLGFPFDASREREREKERGKMADEGTANCIDIILAIILPPLGVFFKFACGIEVLDLLAAHLLRLPPRHHLRRLGHHQVGLQEGLLTSCRLGDPCRTCSGGLVQAVCPRREPRFHGAACLHVCVHAVVHLCCCPCLMISLLSCHLPFSSVVYPSIHLCCSSAHFRRPCTLNFD

SEQ ID NO: 106090 - protein, 96 aa, Triticum aestivum
  unsure (1)..(96): unsure at all Xaa locations
  Clone ID: PAT_TA_508.pep
RRYNCHVPSSLTDSPRYKAQNYQEAMXICQSLGYTDLFVTLTCNATWPEIQSIYATGRERSDIVDRVFHIKLKEFMRNIREREYLEKTLASNILLT

SEQ ID NO: 106091 - protein, 84 aa, Triticum aestivum
  Clone ID: PAT_TA_509.pep
QTYCDFQKLDGTCQPRSRPIAVSSREAGQLKADYKHHQTTRERESLAGTLSENCTLTRGTNRRGANQRMAFPPAPVSSSLKNRS

SEQ ID NO: 106092 - protein, 114 aa, Triticum aestivum
  Clone ID: PAT_TA_510.pep
MDPYKYRPSSSFNAPMWSTNSGAPVWNNDNSLTVGSRGPILLEDYHLVEKIADFDRERIPERVVHARGASAKGFFEVTHDVSHLTCADFLRAPGVQTPVIVRFFNVIHERGFPE

SEQ ID NO: 106093 - protein, 361 aa, Triticum aestivum
  unsure (1)..(361): unsure at all Xaa locations
  Clone ID: PAT_TA_511.pep
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGDFPEWKLFVQVIDPDDEDRFDFDPLDDTKTWPEDLVPLQPVXRLVLDRNVDNFFNENEQLAFGPGLVVPGIYYSDDKMLQCRVFAYADTQRYRLGANYL

SEQ ID NO: 106094 - protein, 465 aa, Triticum aestivum
  unsure (1)..(465): unsure at all Xaa locations
  Clone ID: PAT_TA_512.pep
HTPASAGHPQPGRRPGPRPGARPAMAPGCTRTAPGLRGADLPPPSPRAAGTPARRRPLHPPRPTAPRQEARRPARAGRRSGPTPARPPEPPSSGSAPPTRRAPAARSAPSSTTTTAPRHLMRPPSGATRIPAPASRPSPGPSSPTQASLRLPPLHACAPRHQGALRIPPRAAHPGPQLPARAAGSHCRRHHPPPSHPGRQRIHCPPATTRVRPSHXRPSSRTRRSEPTTDRPACPSPRGSSHLPTSPGPMSGGEYTCDCRPPHPSAPTSTTTKTGPLNFNPPPPARSTTSLLRFRPPPRTGPRFPAPRTRRSSTSPPGSTPPSTRPATPSPPAPSNGRREKRVIREGEQLQAARGEVPLHGPGKPRGIPQQLERSSLSARSSRAVSAPSRACKISPWSAQIRNLLQGRPSSSLLSANNYVPNAKPEYLLLLSLFFIDDSHVVLPHVMRIVVRHSCTNLYKASVYY

SEQ ID NO: 106095 - protein, 139 aa, Triticum aestivum
  Clone ID: PAT_TA_513.pep
GTSSAGAVVPLVHLIGERGTGTSEKAMVVLASLASIAEGRDAVVEAGGIPALVETIEDGPAREKEFAVVALLQLCSECSSNCALLVREGAIPPLVALSQSGSARAKHKAETLLGYLREQRQGGGGCRAGPGGAATSMAR

SEQ ID NO: 106096 - protein, 143 aa, Triticum aestivum
  Clone ID: PAT_TA_514.pep
GVSILRPTGRGRGGSSCNKKLILQQACGDAPCMVVAYAPIDTADLKDVMHGGRRASLSLLPSGFSILPDGVGDIQTDPLDANPSAVDPIDHQRSCGSLVSVLRQTHLIGGNLTAQTVDNFGNNVSGSIMKIKDAVHAKRVMTV

SEQ ID NO: 106097 - protein, 166 aa, Triticum aestivum
  Clone ID: PAT_TA_515.pep
MIQAVMVISTLGKPRLLKFYNFQDSEKHQELVRGVFQLLSARPEGVSNFVEAVAIFGPGTRLVYKHLATLYFVFVFDSSENELAMLDLVQVFVETLNRCFKNVCELDIVFNFNKLHTVLDEMILGGQVIETSSEQIMKSVEEIARLEKQSSTTSLIPKSISERFSR

SEQ ID NO: 106098 - protein, 187 aa, Triticum aestivum
  unsure (1)..(187): unsure at all Xaa locations
  Clone ID: PAT_TA_516.pep
WQGTGAFNARXHRPKQCRKATVRGATVRPXWPSCHLRLPPRTAWLHSLSPRAPGTFLWRHIDECAGAWAQSGGFAAASALPRSLSCRTRKLVARRVLPGRAARRGKFLEMPWLAFPASSSCRGLVLPGKLLLPESCLLSENTLFLNGINTSYGGSWRTPGKPCHWVLRLPVHKFGILRYPYFSTPTV

SEQ ID NO: 106099 - protein, 137 aa, Triticum aestivum
  unsure (1)..(137): unsure at all Xaa locations
  Clone ID: PAT_TA_517.pep
HGSSVDWWTLGIFLYELLYGKTPFRGPGNDETLTNVVSQGLKFPDSPAVSYQARDLIRGLLVKEPEXGLGSRKGAAEIKRHPFFQGLNWALIRWTAPPETPKSVDASTLTAAVARKKKEGKCLEFRMNGDDIEFELF

SEQ ID NO: 106100 - protein, 426 aa, Triticum aestivum
  unsure (1)..(426): unsure at all Xaa locations
  Clone ID: PAT_TA_518.pep
METDSPRSPEAEIGHRVEDLWEVAQPQLSPSEKLNSCFEDIPVAAFPRNHPSQVIEIPSDASLSDTVETLSKNKILSAPIRNVDAPEDATWIDKYIGIVEFAGIAMWLLHQSDASGNGTAGSAVGSPVANLASRLGSFTFRRTSSGRVETTTDSESDEAASVGGSFFETLTSSEFYKNTKVXDISGSFXRWAPFLALQTSDTFLTMLLLLSKYRMKSLPVVDMGGNQIENIITQSSVVHMLAECVGLSWFESWGTKKLCELALPLMKPYRLVKVNEDQPVLKAFQLMREKGVGGVPVIDTNGTKAIGNISIRDVQYLLSAPKIYKQYRTISAKDFLTAVRHHLQEQHEASPLLHDVITCKRDDVIKEIILKLDSTKIHRIYVVDDKGDTEGVITLRDIISKLVHEPRHYFGDFFDGVVPLPTNSTV

SEQ ID NO: 106101 - protein, 262 aa, Triticum aestivum
  Clone ID: PAT_TA_519.pep
PVTVRQPLYFDYTEPQPSAAVALGPPAGHSVRVSMSLLLPDSDHNRQIGVFQIKTEAIAPSGSTIASATQPYMLRYKSAPVRLAQSTLTIVPLALGMRSESQSATLKLLQYWEGHDRHRRTRLIRVSLQPRAMTVHLPQVYRAEITVQTALPWFKAVARSLKWTMCVWLSFWVYVILSLLAVRWVWPLALSASDSHRGLSDHQVNGKTIAANLGGGDTGQSSHEGSSRGGAVKWRDRRGRRKAQQTTHGGMVELKLRRGLVF

SEQ ID NO: 106102 - protein, 279 aa, Triticum aestivum
  Clone ID: PAT_TA_520.pep
MHLDNVNWGLYLNTLFWNLNYWDSISTLAGEVENPKRTLPRALSYALVLVVGGYLYPLITCTAALPVVRESWTDGYFSDIAKILGGFWLHSWVRAAAALSNMVRFVTEMSSDSYQLLGMAERGMLPEFFGKRSRYGTPLIGILFSAFGVVLLSWMSFQEIIAAENYLYCFGMILEFIAFIKLRMTHPSTSRPFRIPLGTVGSVLMIIPPTILIVVVMVLASFKVMAVSILAVLVGFALQPALVYMEKKRWLRFSVREDLPDLLDPSAGAAEDETTPLVV

SEQ ID NO: 106103 - protein, 35 aa, Triticum aestivum
  Clone ID: PAT_TA_521.pep
MTCTAQTNTTLSITLHAFCSPHPIGKNRNFIRSSD

SEQ ID NO: 106104 - protein, 324 aa, Triticum aestivum
  Clone ID: PAT_TA_522.pep
KAEKNTDLKDARQGETINIFSVASGHLYERFLKIMILSVLKKTQRPVKFWFIKNYLSPQFKDVIPHMALEYGFEYELITYKWPSVRPRVREKQRIIWAYKILFLDVIFPLSLRKVIFVDADQIVRTDMGELYDMDLKGRPLAYTPFCDNNKEMDGYRFWKQGFWKDHLRGRPYHISALYVVDLAKFRQTAAGDNLRVVYETLSKDPNSLSNLDQDLPNYAQHTVPIFSLPQEWLWCESWCGNATKARAKTIDLCNNPMTKEPKLQGAKRIVPEWVDFDAEARHFTARILGENVEEIAEATPPSSESDAPKPDHEDSSQDSKDEL

SEQ ID NO: 106105 - protein, 97 aa, Triticum aestivum
  Clone ID: PAT_TA_523.pep
KYFFAKDHMAASVEINDTYFCQEHFAEVCEECNVDFREENDAFYGFDSRDRDALTCPPASINNNGVVVCNEHDSATCGQCFNWKRQIARKSRDAAKR

SEQ ID NO: 106106 - protein, 94 aa, Triticum aestivum
  Clone ID: PAT_TA_524.pep
QQTPTTLLWMPLQFAHYIFLAKLTEVNTTETTSRQINAHNQSEQAHTKKKLPALDLFCRAANLVEIPSSNYSMTTGSWLPSRSTRAESLCPRDK

SEQ ID NO: 106107 - protein, 114 aa, Triticum aestivum
  Clone ID: PAT_TA_525.pep
RDRESCRALLSDGSFIEVFLNMSLELCEARDPKGLYKLARAGKIKGFTGIDDPYEAPLNCEPQETLETGFRPALYIKQHQNKIEIKEVDGVCPSPSDMAAQVITYLEDKGFLHE

SEQ ID NO: 106108 - protein, 182 aa, Triticum aestivum
  unsure (1)..(182): unsure at all Xaa locations
  Clone ID: PAT_TA_526.pep
MMASTSTASATAVAGAFAAAGANRPRGSAACPRVPAGGRRRLSCVVRCDAGPGAQAQAAAKAASVAALEQFKISADRYMKEKSSIAVIGLSIHTAPVEMREKLAVAEELWPRAVAELTNLNHIEEAAVLSTCNRMEIYVVAXSWDRGIREIVDWMSKKSGIPVSELREHLFMLRDSDATRHL

SEQ ID NO: 106109 - protein, 257 aa, Triticum aestivum
  Clone ID: PAT_TA_527.pep
DELVVNPDGAYSQLIRLQENNEEEQKVDHRRLDPRSKSTSLSLKRSISRGSAGNSSRNSFNLSFGLPGAVELPEGNDTHGENHTEQDGEVPKKAPMGRLALLNKPEVLIILLGSLAAAVHGVLFPMFGVMISSAIKTFYEPPDKLRKDSSFWGLMCVVLGIISIISIPAELFLFGIAGGKLIERIRAMSFRSIVHQEVAWFDDPKNSSGALGARLSVDALNVRRLVGDNLALTVQIISTLITGFVIAMIADWELSLI

SEQ ID NO: 106110 - protein, 146 aa, Triticum aestivum
  Clone ID: PAT_TA_528.pep
HASDFGAVVALWDEEEDKWIEKSYVMDHWTEEGFGPRMDYNVLDMIFHNDAFHLLTEEEDIIRVLPYAQGVQKLHVWRRMDREVDEMFEDNLHGTTIKYLVESTGGYLVMCIKYVRRGRTESINMYRLSVPEKRWHNYRSPEGEVI

SEQ ID NO: 106111 - protein, 128 aa, Triticum aestivum
  Clone ID: PAT_TA_529.pep
LIMGLHDKLALIFTSSAVVLDAVNNLAILLAFTILLNSIQPVLSGVAVGSGWQSAVAYVNIGSYYLIGVPMGVLLGWLFNLGVLGIWAGMIGGTAVQTMILAIMTVRCDWEKEAMVASTRMDKWSEVR

SEQ ID NO: 106112 - protein, 103 aa, Triticum aestivum
  Clone ID: PAT_TA_530.pep
LKRTAFQHAKTIISNGPRNKKKVCRLLPCSNGDQKGFRDFISYLKLNKYAGVIKIAPVKPMGSRLLFILPPTSEVFGLLGLPPQPTECLIAVVLPKETTTEVS

SEQ ID NO: 106113 - protein, 190 aa, Triticum aestivum
  Clone ID: PAT_TA_531.pep
PTRPVNFGSITVVTPAQLAEFAWGLAGCGQPFLWVVRPDLVAGEKAVLPEEFVRETKDRGVLASWCPQERVLSHPSVGLFLTHCGWNSTLESVCAGVPMVCWPFFAEQPTNCRYACARWGIGVEIGGGVAREEVARLVREAMDGERGKAMRASATALKQSAGAATEGGGSSSENMDRLVEFLHAGCDGAT

SEQ ID NO: 106114 - protein, 124 aa, Triticum aestivum
  Clone ID: PAT_TA_532.pep
QEKSEIGKPRTYTSLALAHHACMPHSANTQGHSAAAATPASSTPPVAAARAMPAGRAGALICQAAPPALPPLAGTRRFAKEKEGTSRSVDDLDPSSTTSLLHCCFDLQPPPPTEERSGKGRVKG

SEQ ID NO: 106115 - protein, 84 aa, Triticum aestivum
  Clone ID: PAT_TA_533.pep
SVVDQYRSQGTTYRLLSSLKTKKKHIISSLQSISSGALFGVRRILQHHGCRILYIRSLLFVATKCMKSKKYHKREHRAGRMLSY

SEQ ID NO: 106116 - protein, 114 aa, Triticum aestivum
  Clone ID: PAT_TA_534.pep
SRQDVIKNHTLEWIEKFYPGLFEQIHFGNHFALEGQSRPKSEICRSFGAQVLIDDNPRYALECAEDGMRVLLFDYDNTYPWCKTGVDQSHPLVTKVHNWQEVEQKLLSWVAPES

SEQ ID NO: 106117 - protein, 114 aa, Triticum aestivum
  Clone ID: PAT_TA_535.pep
PRVRPRVRINQASIISEISMDKHKSHTCAPALLLSLLFLACSPLHAQCRIIEGMDDDKINIPGGLCVHHKDCAPGNCCFWCLVLDLCYATMAECNTECKGHIDARLFNLRSPSN

SEQ ID NO: 106118 - protein, 318 aa, Triticum aestivum
  unsure (1)..(318): unsure at all Xaa locations
  Clone ID: PAT_TA_536.pep
PGCRNSPEDDKSELELASXEQXRNDQDILKLVXXQKREKEDALARMLQLEKXLHEKRELELEVTRLNGTLQVMKHLEGDDDGDIHDKMEKLSEKLEHERKRLEELSGELVRKERESNDELQEARKELIMGLEDILSGRTAIGIKRMGELDERPFQNACKRKYGNDDHETRAAELVSSWQEEIKKPAWHPYKFVKAEDGSDKEVVNDEDPRLKQLWIEYGDDVCNAVKTALSEVNEYQTAKDNGVELLDDETVREFADAWGGDRQEVKTVTYASAASCRAETAEDWKRRSVLKSWAISRTRRWKGSLRMSSSVTFWYLD

SEQ ID NO: 106119 - protein, 144 aa, Triticum aestivum
  Clone ID: PAT_TA_537.pep
PRVRDSNSANSNSFMSSANGGLGGIGNNNVNWGTPPVPAQGANAGSGYGSGSFGYGSTENNFNLSPGAYGRNTGSGGVNASLNQSSNGYGRNFGDSSAGGGGSIYGDTTWRSGSELDGTSPFGYGLGNAASDVTAKSSAGYMGH

SEQ ID NO: 106120 - protein, 97 aa, Triticum aestivum
  Clone ID: PAT_TA_538.pep
MDREAKKEGFRKYLESSGVLDTLTKALVALYEENDKPSSAVEFVQQKLGGPSISDYEKLKAEKLDLQLKYNELLETHKETSRQLEELKNLKIDAPWN

SEQ ID NO: 106121 - protein, 221 aa, Triticum aestivum
  Clone ID: PAT_TA_539.pep
MAGGGEEEAKLLGTWASPFVLRAQLALSFKGVSFENVNEDLCNKSDLLLRSNPVHKAVPVLIHNGRPVCESLVILQYVDEAFGGPPLLPADPYERAIARFWAAFIMDKLVAPWQKVFTTKIEEEKAEWMEQTLAAVDVLEGGLKECSKGGSFFGGDNVGYVDVVLGGAVPWIYGTEALCGTRLFDTSRVPLLAAWLERFGALDVAKAVMADVPTRLVELAR

SEQ ID NO: 106122 - protein, 238 aa, Triticum aestivum
  unsure (1)..(238): unsure at all Xaa locations
  Clone ID: PAT_TA_540.pep
RPRPPTPTTRRALAPPTPREKGPSIVEQTAIATLGADVEGGGAAAAKKQQEEGGEVATPPSPRREGERERPRGLVPAIPVYLIPFLPVANYNNNSPAQDGKRGPARHSVXRPPPPLLLPAPPPEPAPPALLRNAXKVGALVWDKVVHGHQGWRLVSCIWLHARVLRLHAHTPGLLPVGCGLGRLFGCLRVGAIYLSSRVGASVLSSPLSTGCWAVGRSAAPSRAAGGAAPGPSADWYC

SEQ ID NO: 106123 - protein, 142 aa, Triticum aestivum
  unsure (1)..(142): unsure at all Xaa locations
  Clone ID: PAT_TA_541.pep
MMHKTSSLSELGFDAGDASSGFFRAVADGCPLTPTSSSAPHRRLTKVSVIGAGNVGMAIAQTILTQNLADEIALVDALPDKLRGEALDLQHAAAFLPRVRIVSGTDAEVTKNSDLEEXKNSARQIPGETRLNLAPGNVKLCR

SEQ ID NO: 106124 - protein, 205 aa, Triticum aestivum
  unsure (1)..(205): unsure at all Xaa locations
  Clone ID: PAT_TA_542.pep
MASTSSSTAVDERERKRKRAAGGDSTASAGPGTEAQPSKWRTQREHEIYSSKLFEALRLVRGGSSSASTAPARGRAVREGADRALAVAARGRSPWSRAILASRRRRLQAXHRARLRAPATPPARHPSVAAAAQPQPGKAPALAKKAKVLGRLVPGCHKLPFPALLSEASDYIKALEMQVRAMTALAEVLARVSLSAASGSSSSPA

SEQ ID NO: 106125 - protein, 135 aa, Triticum aestivum
  Clone ID: PAT_TA_543.pep
FHLDIAEQKIITCLPVPKRVNGILEALLEPSACQPPAERCPTSMPPALLRPSATAMAPVLRHGHHLQPRRPPEPKVHLVHAEPRGPGDSTPPGIATASAVHATTGRLGPASARRSTGAASGAAARPLPRCWPGTG

SEQ ID NO: 106126 - protein, 169 aa, Triticum aestivum
  Clone ID: PAT_TA_544.pep
LSNFRRLPDHRCPLDHHCLPLSPQPEFAITRLPHLAVVSTALAGCSSAIRRFQQLTPPNIARHRCPWLAVVVDLSCPPPSVGCSTADCWLQLYVSWLQLLGVPVPANSDVSSQLWCNQFQLPAVLVVAPHDAGCSSPRNRLHHRCPLARRLQGWSPGRSICASGPCSTQ

SEQ ID NO: 106127 - protein, 118 aa, Triticum aestivum
  Clone ID: PAT_TA_545.pep
MSTVEEELSECEVLWPETRHGAPGSAWGSSTAAPRASRDHRQCSAPVDIPRGRGRAGLDDDEEEEDGAMVPPHLMVSRRWSEGKAAAAFSLRSGPGRAHRDLNNLRNSVLRMTGFIEG

SEQ ID NO: 106128 - protein, 310 aa, Triticum aestivum
  unsure (1)..(310): unsure at all Xaa locations
  Clone ID: PAT_TA_546.pep
HEADAELLAKLFDVAPFTHVLHLAAQAGVPHALVDPMSYVRAIVAGLVALLEAARAADPQPAIVWASSSXVYGLNSHVPFSRXDRTDRPASLYAATKKAGEEIAHVYNHIYGLSLTALRFFTVYGPWGRPDMAYFFFTRDILAGRPITVYESSGGGTHQTTISRDFTYIDDIVKGCIGALDTAGRSTGSGGKKRGPAPFRTYNLGNTSPVPVTQLVDLLEKMLKVKAVRRVVKMPRNGDVPYTHANISLAQRELGYRPSTDLQTGLKNLCAGYLEYYNPELGCEARSSMAVQWARVHAGPEWAARAVQDD

SEQ ID NO: 106129 - protein, 114 aa, Triticum aestivum
  Clone ID: PAT_TA_547.pep
WTTSSTSGLAAMSQQHSSVTGWQWGLFGVLFLAHASLHNDCTHGPGISKQISDSASPDSITVAITTMRAAKHTTPVFLMVNAMPRYAKLASYLSLFYTVCLISSWRCADPGPAG

SEQ ID NO: 106130 - protein, 255 aa, Triticum aestivum
  unsure (1)..(255): unsure at all Xaa locations
  Clone ID: PAT_TA_548.pep
PTRPRKQKVSATPLQFYDCESISISNHDDLAKSRKGLEEFEQPSPVSILQPPTDEDSCCSGFFKNDLQEMPSVETQMDHRRFRDEPEVSSMSCDDGNDSSYKSLEAFQVEEDRDFSYLLDILISSGMIVSTDWQLLCKSWHSSSFPVGPQVFERLESKYATITSWPKPERRLMFDLANSVLSDVLAPCTNIHPWVSSTRQCRPIWGPEGPVEXVWQMIVRQQEELAIDKADDNKKILRDETGWGLIYKKAKMGGS

SEQ ID NO: 106131 - protein, 116 aa, Triticum aestivum
  Clone ID: PAT_TA_549.pep
MESNGNGNNSNNAKVGNGCGGGAAEAPRRPHWSHRDRSATAVYLVHPDQFRAVVQQLTGAEAPPPVHGHSGGNGGADRGAAMAVEATKGRSGAGSSVEQRTLAQLHHDCLAWADEC

SEQ ID NO: 106132 - protein, 157 aa, Triticum aestivum
  unsure (1)..(157): unsure at all Xaa locations
  Clone ID: PAT_TA_550.pep
MASLLCSQIKQNRAYVRRQVHENRLTRLPKSLHWSPLQSGHFKNIALRCTKNLPWEASLPYASTEDDASIIMGTNVVEAIDTEEAPEIPILQSDQDVVDVRNEPSKQPATFKLPMWLLGPSVLLVTGIVPTLWLPLPSVFLGXXIAGLLSXXGLDCI

SEQ ID NO: 106133 - protein, 122 aa, Triticum aestivum
  Clone ID: PAT_TA_551.pep
TAVRAAVTGLLDAGRVNEWVVTEKLGDANKTKPAMEVLDAVKVIDVELTTPLVPKLKKRRIRLWDKYNCSEIFVGTCIIISGFYDLFYANKGYYIYLFIQGLAFLVVGFEYIGTRPPTPSAE

SEQ ID NO: 106134 - protein, 207 aa, Triticum aestivum
  Clone ID: PAT_TA_552.pep
SRRSRRRPCRRRRSCGRSPQRNTTRRRGRPTRHGAPRRRSSRPRQRENLKRKCCPPPESPLVARAFRGPRYPSRGRRGLRLRQSIAASSLLGRHGVYAAPTSSCQPRHGEPGPVSLVVPEPDGTAGPRRRRQDGSQRCNRPGHLMPTDDAVEAKEPAVAAPFGSLLPLVLLLGRGGTEELDGCPGLVRISGKSGPGGGRGGEGSELR

SEQ ID NO: 106135 - protein, 169 aa, Triticum aestivum
  unsure (1)..(169): unsure at all Xaa locations
  Clone ID: PAT_TA_553.pep
MAIAVGHCHDLKPPAVRGRHYRPHSVTQLDRSLLERDNQERNALSPQRRCLSSPCFTTVAEPASDDAQDDKKMPRVEIVAGRHARGVHELIAEAAGAIASGTRLVPAQSGLGGALLLKDGRSGEHVXVIKPLDDATSSPSTNVGGGYESKAVLREVAAYLLDHEGSPAS

SEQ ID NO: 106136 - protein, 61 aa, Triticum aestivum
  unsure (1)..(61): unsure at all Xaa locations
  Clone ID: PAT_TA_554.pep
FXFFFFFLFYNFDKIYQITKAAELLEQTKLTNYSTECTSLLFLPLETEEKSISQPRTITKV

SEQ ID NO: 106137 - protein, 316 aa, Triticum aestivum
  unsure (1)..(316): unsure at all Xaa locations
  Clone ID: PAT_TA_555.pep
CGRALLACVACREQDGYEVLRKVGKGKYSEVFEGLRTGSEERCVIKILKPVRKKKIKREIKILQNLYGGPNIIKLLDVVRDDDSKTPSLIFEYVNNTDFRVLYPKLVKITMVLGTEDFHRYLERXGSTRNIMHRDVKPHNIMIDHEKRQLRLIDWGLAEFYHPRMEYNVRVASRCYKGPELLVDLLDYDYSLDLWSLGCMFAAMIFRVDPFFHGQANYQQLVKITKVLGTEDFHRYLEKYGLRLDPQLEMLVGRHRKKPWEKFVDSGNRHLVSPEAIDFLDKLLRYDHQERLTAKEAMAHPYFGPVRSSEHPENVQ

SEQ ID NO: 106138 - protein, 401 aa, Triticum aestivum
  Clone ID: PAT_TA_556.pep
ASSISYATENVNSHEFVLDKYIDALYEKRGSTREAALASLVDAFESFMLGGLVENKYATLLSLFNTSIKKGSTKEACLASRAIGLLSITLGAGSSSHETMVESHPQLSKVLQTWSDASKMISALDCLAVVTFVGATDLAETEVSLKAMWDVIHPKSGSNVGTVRKPRPPVLAAALSAWTFLLTTIGSWRINTDSWKEPIAFLSTLLGAEDRAVRMAAGEALALCFELNLLDISPSEDADDDTGVPGSSKGKLFLDMQALKAKIAGLASNLSAEAGGKGADKKNLSDQRDLFQRILDFVKYGECPEESMKIAGKRDVLRVASWSELIQLNFFKRFLGRGFLKHVQDNGLLQDIFNIKADKAETLSSNDKKIFRSGEEKGRALKLNKDRRLAQERKNAGMFDE

SEQ ID NO: 106139 - protein, 70 aa, Triticum aestivum
  Clone ID: PAT_TA_557.pep
DDSQRGPAADEGPRLHHMDMEARATHLANVKNLKGLQAGDDIKQLRAGAEMIRNGALLLMRACDASKGGM

SEQ ID NO: 106140 - protein, 255 aa, Triticum aestivum
  Clone ID: PAT_TA_558.pep
KLLGPGKIIGVTASSKEEALKACKAGADYLGIGTVYSTQTKKDTKSIIGPSGVRDILSALHDAGYGSVPTVCIGGINASNTAPVLASAGSPSKALDGVAVVSALIAAPDPAAAARDLLSKVVTTKIPEVIRAVVDKTPLSHNMTNLVVQNFAANVALCVGASPIMANYAEEAADLAKLGGALVVNMGTVTPDGLKNYLQAIKAYNEAGRPIVLDPVGAGATVVRRNAVKTLLDAGHFTIIKGNEGEIQTIAGATI

SEQ ID NO: 106141 - protein, 139 aa, Triticum aestivum
  Clone ID: PAT_TA_559.pep
NKYALALCEERGKPLHKFFPHICKNYSSTLGEQEDATVGPCTMIEGLAAPPPLAKIARRGRPHRGGRRLARCNGMRMGLRGITNSAATKELVIDVEPWECGSAGVLFEPVMERLRSTSALATAGYSFRDNKLSCVPKRP

SEQ ID NO: 106142 - protein, 114 aa, Triticum aestivum
  Clone ID: PAT_TA_560.pep
GHPWRLPLFPLDHVTIKLVAIHKLLKPDGKFVSITFGQPHFRRRFFEAPEFTWSVEWNTFGDGFHYFFYTLQKGKRSPESNGHQVTLPAAPSFNMLHEELESEDYIFRTNVDEL

SEQ ID NO: 106143 - protein, 187 aa, Triticum aestivum
  Clone ID: PAT_TA_561.pep
MYPTTPSDAYDRFSNGPPPTAPPPQQQPTYNHAMNQSHHARPAAGLARWSTGLFHCMDDPGNCLITCLCPCITFGQIADIVDRGTCSCAGSGAAYAAICATTGMGCLYSCVYRTKMRAHYDLDEGECPDFLVHWCCELCALCQEYRELKNRGFDMGIGWDANMERRNRGVTGGQVMGAPATPVGMMR

SEQ ID NO: 106144 - protein, 262 aa, Triticum aestivum
  unsure (1)..(262): unsure at all Xaa locations
  Clone ID: PAT_TA_562.pep
XLLWAASWLYHATGDQTYLSYVTVQXERYADWGRPTWFSWDDKLPGTQILLSRVNFFGSKEISNAENSGLKMYRDTAEAVICGLLPDSPSATGSRTSGGLVWISGWNSLQHGINAAFLAVVYSDYMLTSQTAAVECSGKYFSPTDIRNFAISQANYVLGDNPMKLSYLVGYGSSYPQQVHHRGASIPADAKTGCKGFEYLHSSSPNPNVATGAVVGGPFQNDSFVDLRDNAVQTESSTYNSGTFVGLLAGLVTTSSIAKTFT

SEQ ID NO: 106145 - protein, 462 aa, Triticum aestivum
  unsure (1)..(462): unsure at all Xaa locations
  Clone ID: PAT_TA_563.pep
PARGPRRRPPRPPPGPAPPQLSDSTDGDALGVALQAFQVQKAGKVVGHPVSLRXGDYALRDXKKSNPELCERLYDAGDPMTFTCPMAPPATVLTRRVTRSGGPRIAASQLVPPPTAPPFVSVFLIEAKPSENVFYIQVGDPDLDHDCWRRLDTMTANKAPAQITPETPVSDITWEQLPAVAAPQVGINSXDVKTGFKGFDYPKPSRLFPKLAKAAVVAGPLHYESSVVLRATAVQTYPSSVNGRTVDDLLDGLVTTSSSAETFTSGSFSSNDNVKIDAHVIPGLIRYRPVHWRCSIRWGLSRISGCNSLQHGINAAFLACVYSDYMLTSQTAAVECSGKYFSPTDIRNFAISQANYVLGDNPMKLSYLVGYGSSYPQQVHHRGASIPADAKTGCKGFEYLHSSSANPNVATGPVVGGPFQNDSFVDLRDNAVQTXSSTYNSGTLVGLLAGLVTTSSIAKTFT

SEQ ID NO: 106146 - protein, 369 aa, Triticum aestivum
  Clone ID: PAT_TA_564.pep
MGSRDDDGQSTEGQGYAADINSIREAQTRIAPYVHKTPILSSTSIRCHTRVAIVLEVSLPPVAPGVHTPASLSPFSIDPSTGQLLAFTCQGPKRPGAFKIRGASNSIFALDDNQAAKGVVTHSSGNHAAAVALAAKLRGIPAYIVIPKNAPACKVENVKRYGGQVIWSDVTMESRESTAKKVQDETGAILIHPFNDKYTISGQGTVCLELLEQVPEIDTIIVPISGGGLISGVALAAKAINPSIRILAAEPKGADDSAQSKAAGRIIKLPATNTIADGLRAFHGDLTWPVVRDLVDDVIVVDDNAIVDAMKMCYETLKVAVEPSGAIGLAAALSDESKQSSLWHESSKIGIIVPRGNVGLRVPWEPLCK

SEQ ID NO: 106147 - protein, 349 aa, Triticum aestivum
  Clone ID: PAT_TA_565.pep
SFSNPPQYYPQYGNYYPPPPPSVQVPLPAPYDHHHRGAAPPPNVPPTEFPPSVHSHHYPGWAGRYPYGLQPPMPTPYVEHQKAVTIRNDVNLKKETLRIEPDEGCPGRFLVAFTFDATVAGSMTVYFFAKEELNCNLTAMKPDLIKPVTVSFKEGLGQKFRQPSGTGIDFSAFEDSELLKQGGMEIYPLAVKAETTLAADQPSEGEDQKPKTPNSQITQAVFEKKESGDYQVRVVSQILWVNGTRYELQEIYGIGNSVEGDTDANDPGKECVICLSEPRDTTVLPCRHMCMCSECAKVLRYQTTRCPICRQPVERLLEIKVNNKAEEPPQQTSQSPPLPPPPALHQEEV

SEQ ID NO: 106148 - protein, 160 aa, Triticum aestivum
  Clone ID: PAT_TA_566.pep
EFGTRFKAMVGKGRIGDVPIMLAKPQTFMNASGESVGQLVSYFKIPLNQVVVMYDDLDLPFAKLRLLPKGGHGGHNGMRSIINHLKQNRDFPRLRIGIGRPPGKMDPANFVLRPFTKKEQEELDFTFHRSLEAIRIMALEGFNKSATFVNTAQSSEMLNR

SEQ ID NO: 106149 - protein, 336 aa, Triticum aestivum
  Clone ID: PAT_TA_567.pep
HEADPDVLLAAASSDGSLASFSLSSCIASSASAHAAPQLAAAALVDPVCIVQAHSGPVYDAKFYNDPIQPLLFSCGDDGHIRGWRWHEMQSCLLPLSLQGDHVEPILDLVNPQHEGPWGARSPIPENNAIAISKQDGSLFAAAGDACAYCWDVESGKCKMTFKGHTDYLHSIAVREANHQVVTGSEDGTARIWDCRSGKCTQTIRPVQNKKFEGSWVGCIAIDASESWLACGTSCGISVWSLLSNECIFNADCGAPVQDLLFDKNQILAVGAEPALSRFTINGVVVSQIKCAPPSAFSVSMHSSGMAAVAGHGGLVDVIFGFGSHLCAFRCRGLDR

SEQ ID NO: 106150 - protein, 79 aa, Triticum aestivum
  Clone ID: PAT_TA_568.pep
DSKIIRTKTLRATKTCTDRHNYLIHIFDTTLPLNCTSVPHTTESNTPNKNREISGQILYSLRPKISSTKSATLFGMEGV

SEQ ID NO: 106151 - protein, 480 aa, Triticum aestivum
  unsure (1)..(480): unsure at all Xaa locations
  Clone ID: PAT_TA_569.pep
ATDLIAFDSTACVRCFEHQDGRLHRKASPVPVHVNHDSKIEAPETRITTLDNGLRVATVSSLSSRTATVGVWIDAGSRYEXTEKAAGVAHFVEHMLFKGTGTRSAGQLEQEIEDMGGHLNAYTSREQTTYYAKVLDKDVPRAMNVLADILQDSKLEDNRIERERGVILREMEEVQGQSEEVIFDHLHATAFQYTSLGRPILGSADNVKSITKKNLIDYIQKHYTASRMVITAAGAVKHDDIVQQAKELFKSLPTDPTTTNMLVAEQPAIFTGSEVRIIDDDMPLAQFAVAFNGASWTDPDSIALMVMQTMLGSWNKSAGGGKHMGSELVQRVAINEIAESIMAFNTNYKDTGLFGVYAVAKADCLDDLAFAIMQEMSKLSYRVTEEDVIRARNQLKSSIQLHLDGSTAVVEDIGRQQLIYGRRIPIPELFARIDAVDPSTIRRVANRFIFDQDIAIAAMGPIQSLPDYNWFRRRTYMLRY

SEQ ID NO: 106152 - protein, 129 aa, Triticum aestivum
  unsure (1)..(129): unsure at all Xaa locations
  Clone ID: PAT_TA_570.pep
MITRRIARPSCRRRIIQILASPPLALPHPQRPTSPPPTMDADGIEATTGPPDSLSSAGSAQRSPNPSRTPRPTPAPXASPPSSXASPVQADPAALGRPRPRLLLPSPDLTRLPPDPSGSDSSTPPRRRI

SEQ ID NO: 106153 - protein, 205 aa, Triticum aestivum
  unsure (1)..(205): unsure at all Xaa locations
  Clone ID: PAT_TA_571.pep
MAGGGAAAPALSSPWRALLQRALDANAHLXHSTFFQLATRGADGRPANSSFQDHGDKEQCDKIALNTDARSNKIGEIREWPLGEICWYFTDSWEQFRISGIIDVIDGSSPDPAKLQQREKAWFASSVKSRSQYLGQSPGVPVANDDHIKDVHIDPSAAPVDAYCLLTLDPEKVDYVNLKSNQRLMFTRTQEGDESSDWMAEKVSP

SEQ ID NO: 106154 - protein, 144 aa, Triticum aestivum
  Clone ID: PAT_TA_572.pep
PSHQHRDPAPALGPGARPMGVLAPAVDLDPGDVGSISLLSGCRSWSPKPNPSRSASPSPPTLNPADATLTARCRPRARPQRRHTHRRRSVLGHWSANVQASGGSGRVAHDIDSGHDQPRRMGQWDGRRETKRRKKTMITKFYHR

SEQ ID NO: 106155 - protein, 186 aa, Triticum aestivum
  Clone ID: PAT_TA_573.pep
MEKIRKLMGDLLLEYQASDGGVGTSESHVGGSISTQGGAAVDEMENIFKQYMSSKPVMSASRVRTELDLYLEEEIIHRPEGLDIINWWQYAGIKYPTLRRMAHDILAIPVTTVASESAFSTSGRILSAHRCSLAPNMTEALMCMQAWSRADMLGDCNSTLFADFETVLKDDTEMMEVDDQSILTEA

SEQ ID NO: 106156 - protein, 59 aa, Triticum aestivum
  Clone ID: PAT_TA_574.pep
TSTERKLTFPTKTERESISSFASDVVALGSPPCISAYKVQRLNVLRYLQGNYINTEITV

SEQ ID NO: 106157 - protein, 189 aa, Triticum aestivum
  unsure (1)..(189): unsure at all Xaa locations
  Clone ID: PAT_TA_575.pep
MADEKLAKLREAVTGLGQISDKEKSGFISLVSRYLSGNEEQIEWGKIHTPTDEVVVPYDTLAAPPEDLAATKALLDKLAVLKLNGGLGTTMGCTGPKSVIEVRNGFTFLDLIVVQIESLNKKYGSNVPLLLMNSFNTHDDTLKIVEKYANSNIQIHTFNQSQYPRVVADEFLPXPXXXXTFFFTLFVPL

SEQ ID NO: 106158 - protein, 270 aa, Triticum aestivum
  unsure (1)..(270): unsure at all Xaa locations
  Clone ID: PAT_TA_576.pep
VLYDVDLATRSRQISFCLDSIKPMNLRGHVDSMVKEVEDYFTKWEQHGVVDIKHEMGNLILLIANRCLLGKQFRENMFEEVSTLAHDIFDNGFHLISLFFPYLPIPXXHRRDKARAKLGEMIHEVVRSRRSSGQAENDVLQKFVDSKYINGRSMTENEIAGLLICMMFAAQHTSSATSTWTGACLLSHGESYLAAAIEEQKRIMERHGEHIDYTILQEMGTLHCCIKEALRLHSPAILLIRHASKSFSVQTREGYKIDIPQGHTLATCTT

SEQ ID NO: 106159 - protein, 196 aa, Triticum aestivum
  Clone ID: PAT_TA_577.pep
MGHEMVASNGKGNGAGRRTTKPHAVVIAYPYQGHVIPAAHLALRLAARGFAVTFVNTESVHEQTARALGVDRRRYDIFAGARASSEGKEPLDVRYELLSDGFPLGFDRSLNHDQFKEGELHVLAAHVEDLLRRVVVDPASTCLVADTFFVWPATLARKFGVPYVSFWTEPALIFNLYYHMDLLAEHGHFNSAKGPP

SEQ ID NO: 106160 - protein, 145 aa, Triticum aestivum
  Clone ID: PAT_TA_578.pep
SLDLSTASAMDAEAAAATAATATPPAPSSQPLGSIPQPPPPPPPPSSVVHTPLPLQTAPPVASFPSAAYIHAMRVESAHINLGVRLDMKGANYSTWRGLMLEVIDQYDVAAWIAPDFTNRAGDVAWNIVNKAVKRWFYGSMVTEL

SEQ ID NO: 106161 - protein, 68 aa, Triticum aestivum
  Clone ID: PAT_TA_579.pep
MTRGDQRERDRQRAQARKPGTKGRDDGLTPEQRRERDAKALQEKTAKKAAQATQGADDAKKKNVAGKK

SEQ ID NO: 106162 - protein, 67 aa, Triticum aestivum
  Clone ID: PAT_TA_580.pep
MTRGDQRERDRQRAQARKPGAKGRDDGLTPEQRRERDAKALQEKTAKKAAQATQGADDAKKNAAGKK

SEQ ID NO: 106163 - protein, 234 aa, Triticum aestivum
  unsure (1)..(234): unsure at all Xaa locations
  Clone ID: PAT_TA_581.pep
VINNVQYRGKLESTAVLKAICAGFKXRTTEPRVCMTQDMETDECLHNNGGCWRDXKKTNITACKDTYRGRVCECPAVDGVQYEGNGYKECKPVGPGRCAANNGGCWKETRHGKTFSACKGSGSLSGCECPPGFKGDGITCEDVDECSEKLACTCPGCSCRNNWGGYHCSCGGGGNQVYIQAEDTCVGKNAAAMGWLVAVLVLXCLASAGLAGFAFYXYRLKRYMDSEVAGIMSQ

SEQ ID NO: 106164 - protein, 138 aa, Triticum aestivum
  Clone ID: PAT_TA_582.pep
MQYNNLGRSGLRVSQLSYGAWVTFGNQLDVKEAKSLLQACRDAGVNFFDNAEVYANGRAEEIMGQAIRDLGWRRADVVISTKLFWGGQGPNDKGLSRKHVVEGLKASLKRLDMEYVDVVYCHRPDATTPIEETVRATN

SEQ ID NO: 106165 - protein, 162 aa, Triticum aestivum
  Clone ID: PAT_TA_583.pep
NRLDLVGPIVEQPEYNLFSRHKVESEFVPLYNTYGIGLTTWSPIASGVLTGKYSKGNIPAESRFALDNYKNLANRSLVDDTLRKVNGLKPIASELGVSMAQLGIAWCASNPNVSSVITGATKESQIVENMKALEVVPLLTPEVLEKIEAVVQSKPKRLESYR

SEQ ID NO: 106166 - protein, 369 aa, Triticum aestivum
  unsure (1)..(369): unsure at all Xaa locations
  Clone ID: PAT_TA_584.pep
FAQASAAPPHRNQNPPASPPAPPPGPGAEPPTTQYNTQGQSDLLGRPGPQGGRVTFGDRLAFGKALSLLEAXRLLQVSWFDRAKVYANAGAEENGREAVRRRRSLRGLRWSSAAMLFPAKVFGPTTRRHLPGMPRTHSVAGLKASPRRLDMEDVDMVSCHRPDPTTPIEERVRAMNXMNREGWAVYWGTRGWSERTVQQVTEAWGAPDRLDLVGPIVEQPEYNLFSRHKVESEFVPLYSTYGIGLTTWSPLASGVLTGKYSKGNIPAESRFALDNYKNLANRSLVDDTLRKVNGLKPIASELGVSMAQLGIAWCASNPNVSSVITGATKESQIVENMKALEVIPLLTPEVLEKIEAVVQSKPKRLESYR

SEQ ID NO: 106167 - protein, 209 aa, Triticum aestivum
  Clone ID: PAT_TA_585.pep
RTRGGSLTPAISVLSAVSGIREKAPNLTQLQVVWISVAILFLLFSVQRFGTDKVGYSFAPIILVWFVLIAGIGAYNLAAHDATVLRALNPMYIVDYFRRNGKQAWLSLGGVVLCTTGTEAMFADLGHFNIKAIQLSFSFIIFPSVALCYMGQASYLHKFPQDVADTFYKSIPRAMFWPTFIVAILAAIIASQAMLSGAFAILSKALSFA

SEQ ID NO: 106168 - protein, 91 aa, Triticum aestivum
  Clone ID: PAT_TA_586.pep
IFRSNPFADLVSLVCLKKIMRQRFKINSSSCTDYRVRNAHSPRSKADGEHLLKFIVGKIHCVPHTRLIAPSMLLHLLRASSRSRAAARDLE

SEQ ID NO: 106169 - protein, 337 aa, Triticum aestivum
  Clone ID: PAT_TA_587.pep
LLGLAQRGGDRLLELPPSAAEAVDFLAEFEHEFGAGRGPRFVAEGFADALQRAQREYKLLFVYLHSPDHPDTPAFCGGCLCSEPVAAFIDENFVAWGGSIRRTEGFKMSNSLNASRFPFCALVMASTNQRIVLLQQVEGPKSPEEMITILQRVVEECTTSLVAARIEAEERLNNQRLREEQDAAYRAALEADQARERQMREEQERLEREAAEAERKRIEDEEAQARAVQEAAEKEAALARRRQEKAMALGAEPEKGPDVTRVLIRFPTGERKERRFHSSATITLIYDFVDSLDCLKAEKYSLVSNFPRVTYGPEKNSQTLVEEGFHPQASLFIEIQQ

SEQ ID NO: 106170 - protein, 49 aa, Triticum aestivum
  Clone ID: PAT_TA_588.pep
NGPPFFFFFFFFFFFFFFFFFFFFFFFFFFFFFFFFFFFFFFFFLSRQD

SEQ ID NO: 106171 - protein, 783 aa, Triticum aestivum
  Clone ID: PAT_TA_589.pep
STHASAGLSTNQDDADEDIFGTGGGMELENDDSISIKGARNLEGSSKCHFPGEHHINKCPSRTLFVTNINTNVLDSDLRVLFQQYGDVHKLYTCKEHGYVTVSYYDIRAAQNAMRALHGKPLGLVKLDVQFCIPKGNASDKDINKGILVVSNIDPSVSNDDLLQALTVYGDVKEICRASTSCNKKLVEFYDVRAAEAALYDLNKGAISGPKIKAEVSNPGGTIFGLRQQYPREWKLDGSPRQPRNSPPGTIGGPRSHENSSLHNLFSPVSSQLDRSPHGIASSGPQKLSSPIRIEPTRQYNNQAAISELGGSLGQGNFGHGMQMFHPHSLPESQNGICNISKSMTSSGRSAGFRVDGVDYSHLQKVGSGSLHGHSFDQNNEAFGPAGVGSFPLNGHHYSWNNSNAFPQSPSSPMLWSNVQHPGHMHGYPGVVPPHTLNNGAYPMDQHHMGSAPNNGGSFRNARSVHPGSLGSVGFPGSPQMYPSDVPVFAPARGSYRETMFSPVGAGFPSLQQMCNAMNRRNPMVQVSASYDATNDRMRNRRHDGNAVQPENKRLFELDIERIAKGEDPRTTLMIKNIPNKYNCKLLLGVIDENHRGTYDFVYLPIDIKNKCNVGYAFINMTDPQHIIPFYKTFNGKRWEKCKRATLAYARIQGRNELVSHFRNSSLMNEDKWCRPILFHKDGPNAGEQEPFPVGNNIRPRSGRNRPLHSADTRGDASLSTSPNQENSSRRANAAEGDDSIFAHSLEDEEAAINYPQFCYLFFSPARLGYVASSNGLLAIRRK

SEQ ID NO: 106172 - protein, 399 aa, Triticum aestivum
  unsure (1)..(399): unsure at all Xaa locations
  Clone ID: PAT_TA_590.pep
MMSPTTAAPATATAAAFLAPPPPPASSAPPGRARRAAVPAALPSEEPLLIRAARGEDGLPRPPAWMMRQAGRYMASYQALSKRHPSFRERSETTDLIVEITLQPWHAFAPDGVILFSDILTPLPAIGVPFDISGSKGPVIFAPVRXEEQVREPVPIDLDKLQFVGESLKIRRTRVDGGPALLGFVGAPWTIATXVVEGGMTNTFAYMRRVGPADPFAPWPLLSHEIHRVCESSWSQGSSAAQGPRCFASCAGRLPXHFVDVTRSLRYEQIVAKIKNKXCPHIPLVLYINGNGVFLGRMNSQRVDVIGLDWTMEIPFGGAVPGDGTMAKSTQFCSXLFSPLQSIXLHEIHKVVKAVGPKGIYLTWGHGVFQKTPEEAGSTFLWMSQRSLRYDTLFQGHPY

SEQ ID NO: 106173 - protein, 233 aa, Triticum aestivum
  unsure (1)..(233): unsure at all Xaa locations
  Clone ID: PAT_TA_591.pep
MAALTGAALLLASLLALAAIASGNTEGDILYSQRLAWKDPNNVLQSWDPTLVNPCTWFHVTCNNXQQVNSVIRVDLGNAGLSGALVPGLGRMVNLQYLELFGNNISGPIPATLGNLTRLVSLDLYDNRLTGAIPASLGNIGTLRFLRLHGNKFAGGIPSSLGRLTKLQTLELQENMLTGTVPLEVLSLVLLGDLTELNVAKNSLAGTVKSSKPRVATVIQDTLKTTRLHAEQH

SEQ ID NO: 106174 - protein, 134 aa, Triticum aestivum
  Clone ID: PAT_TA_592.pep
CLPSPRKRRPPLKRASPQPPSAINNGRGTPGRPRRRPSTRRRSRSPPPRTPHRSTSSRSSSSPPPPRTTPRRPTTATSSPGRSSPRRSPTNRGPRSATSTRPPPAAPCWSARRRRRSTAGPRPRTWPSSSCGRC

SEQ ID NO: 106175 - protein, 160 aa, Triticum aestivum
  Clone ID: PAT_TA_593.pep
ILYNIFEGCDLTWIMFILQGAPSLKELCIVVRDHLCEMVTGEQRKLYAFSEEKDKGVEWEPSASDFKHRNLAEVRIFGRFLAYDNIVRFVRNVMEAAVSLEGIKLYKSLVCQNCKQTVQKWTLKEKVSLTHKLNVGMLSSAVRIQFPNLEHVATWSTYCS

SEQ ID NO: 106176 - protein, 170 aa, Triticum aestivum
  Clone ID: PAT_TA_594.pep
MDQIMNKMGSYWLGQRANKEMSSAGDDIESLSTSVGDGAKWLVNKLKGKMQKPLAELLQEHDLPVGLFPREATNYEFEPETRRLTVHIPAVCEVGYRDGSELRFDTTVAGTLDKGSLTGVEGLKAKVLVWARVTAVKADAAKVYFAVGIKKSRSREAYEIIRGAITVDEF

SEQ ID NO: 106177 - protein, 177 aa, Triticum aestivum
  unsure (1)..(177): unsure at all Xaa locations
  Clone ID: PAT_TA_595.pep
MESAFPTAARLGLHVLLYSSLLLNALFLAHHFLSAPPAPSPLLSEADNGGGGGALSWALRAARDAESVAAAGCSGHGRVFLDGIVGQDGRPGCECNTCFEGPDCSVRTPDCTVDADSGDPMFLEXYWMQHRRAXAVVVSGWDRMTTEQRPSLHPFNSTFISRSAASVTQEICCTHQV

SEQ ID NO: 106178 - protein, 249 aa, Triticum aestivum
  unsure (1)..(249): unsure at all Xaa locations
  Clone ID: PAT_TA_596.pep
MMDGGGAAADPVDEFLIGGAGDAATAGRTSSPYGTLGIEDGMSADATLGHSNLGKRGRDEPSPSGPKSKACREKMRRDKLNDRFLELCSVMNSGKHTGLEECSASNPGKNAKLDKASILSDAXRMLTQLXRGETEKLKESNVNLRETIKDLKAEKNELRDEKLSLKAEKERLEQQLKAASAAPTGFAPHMPYPAAFHPAVFPPFAPPYQVPANKGAPVXAAFPGMAMWHWLPPTAMDTTQDPKLWPPNA

SEQ ID NO: 106179 - protein, 159 aa, Triticum aestivum
  Clone ID: PAT_TA_597.pep
GVVAADAHCRQWPPARVPRVRIHYAKSADITVWLGDLNYRLEGISSMPARKMIEENRQSKLRDRDQLLQEAEKGQVFNGYCEGTLSFKPTYKYNVGSSNYDSSYKIRVPSWTDRILFKVDHSSGLDAVLSSYEALDCVSSSDHKPVKAHLCLKVRGGNT

SEQ ID NO: 106180 - protein, 132 aa, Triticum aestivum
  Clone ID: PAT_TA_598.pep
LFCIPPIFCPPTPSALPPPPPPAKPEPKECLPSLMGLMPCKDYLTNRTAPEPPNQGKCCDGLRSLFVNAPVCTCRISDDGDLDRLMSAPLHGGNFLRLAVICGTTIAPSDYRSCQAGPVPPLRAAPAPEAAS

SEQ ID NO: 106181 - protein, 146 aa, Triticum aestivum
  Clone ID: PAT_TA_599.pep
DTGAKRVLDLLLHLLRRRELVGDGRFEEGVLYTAGCQPNRTPNQPIRQISMAHQLAGCRRTLAPWPLFRGGACLCCTGASPWSLRMRSSTRTRRSCRRAGQATVPTLIPDGRLQGAPRPWILRDEVLRAALLEVDHQEARARVGAL

SEQ ID NO: 106182 - protein, 259 aa, Triticum aestivum
  unsure (1)..(259): unsure at all Xaa locations
  Clone ID: PAT_TA_600.pep
VYSEMLDAGCQPDIVTYGIMVDSLCKTGRVEEAVFVVQDMSSRGCQPTTFIYSVLVHTYGVEMRIEDAVATFLDMQKDGIVPDVVVYNALVTAFCKVKKFDNAFRVMDDMEGHGITPNSRTWNIILNKMISLGKDEEAYRVFRRMIKRCQPDSDTYTMMIKMFCENDRLEMALKVWKYMRLKQFLPSMHMFSVLINGLCDKGEVSQACVLLEDMIEKGIRPPGSTFGXLRQLLLKEGRKDVLEFLVDKMKILIQEPLFD

SEQ ID NO: 106183 - protein, 146 aa, Triticum aestivum
  unsure (1)..(146): unsure at all Xaa locations
  Clone ID: PAT_TA_601.pep
HASAHASAHASACLLLLATLTIAAAEIGHLQAPAAATGAVGCRTEIRDVGKNKLVQSLGRFAVSEHNRRLSHGGGPVNNGDPVQVQLVFIAVAAAQKQVASGVXYYLKVIARGXAGGGGDRPFDAVVVVKAWIKSKELVSLMPSPK

SEQ ID NO: 106184 - protein, 192 aa, Triticum aestivum
  unsure (1)..(192): unsure at all Xaa locations
  Clone ID: PAT_TA_602.pep
GTHTASTAAGHFVDGVSAFGLGKGTAAGIAPGAHLAMYKVCDGEGCFESDILAGMDAAVKDGVDVLSLSLGGPSIPLDKDLIAIGAFGVMSKGILVVCAGGNSGPTPSTLSNXXPWILTVGAGSVDRSYRATVRLGDGEAFDGESLTQDKRFSSKAYPLYYPXXTSYCDYFDGVNITGXXRVRHRVASAELD

SEQ ID NO: 106185 - protein, 74 aa, Triticum aestivum
  Clone ID: PAT_TA_603.pep
SSALFFFFFADENSLLLTEEEMRISVYFKTEMLVDKGNKKLKTTVVADTLGCTSSDQYKIQVIKRKLEELYIIT

SEQ ID NO: 106186 - protein, 242 aa, Triticum aestivum
  unsure (1)..(242): unsure at all Xaa locations
  Clone ID: PAT_TA_604.pep
MGAREYYDXRCYGDITHKAILVDLCXAAGTLLAPTEPMATECLTVGEKYGVKYSEDEILMRYRQAYAQPWGRSRLRYVDDGXWQHIVSSSTGCSDLEYLEGEELYHYYTTEKAWRLIDPDAKYVFEALRRAGVRTAVVSNFDTRLRPLLQALNCDHWXDAVAVSAEVAAEKAKPXTIFLKACELLDVXKPEVAVHIGDDRRNDLWGARDAGCDAWLXWGSDVHSFKEVAERIGVSVGMGNNM

SEQ ID NO: 106187 - protein, 257 aa, Triticum aestivum
  unsure (1)..(257): unsure at all Xaa locations
  Clone ID: PAT_TA_605.pep
AXGHLLPLSSPHPPLPTATHTYARPPSIPIPTSTSLRRGSGARSRATAPPGTPLILHLPPAPPNLLQRYRKPRPPPVRRRPAMTPDPAPTQHVLPPPHAYCLDLDLTTGSSLQLLSDRASGWVLVVALPRSGDGRRPPMGFPLLILLSDKQRAPRRLLDFISLELALTHASDVLEVVVCQVSNSSTVTPFHLLLSPLYHRDPCPSSSNGTPGPIWDSSARRRYLATRVQHHPALLYRVQCTPARTASPPPFAPSSTV

SEQ ID NO: 106188 - protein, 92 aa, Triticum aestivum
  Clone ID: PAT_TA_606.pep
LRESVLQESFKLTANRNGRHDLMEKSGNIHSALLFFGLGCRQLPITTRESYFGRKENTILVFIHLYACVSLMKHKGCPSDQSRMILGVFLLG

SEQ ID NO: 106189 - protein, 204 aa, Triticum aestivum
  Clone ID: PAT_TA_607.pep
TNNQLLPLKKIHTERELRKLRYMLRWYSTLKLQNHVQYNNKIYSPSRVKQNHHAMPMPYPYDYSLERIREQVFTLPVGSGCSEGRAAAAALPVAVPGGLGPMRAADLASCLVYVQAAVIILLLPRLPRASTTGLRLVRLLHGALGLPLLRQQRRPPPPPADRAGEAGLEHGGGRTGEGGGRGRRERGGAGGGGGGGGGWPAAMG

SEQ ID NO: 106190 - protein, 226 aa, Triticum aestivum
  Clone ID: PAT_TA_608.pep
QRLLRVIEPAGLLRSWRLCFSRACTSVWACPLSPSPAPPPTPPTSSPPPAPAPSLAAAAGPSTATRRGSATHTAPPPPSRPDQAPAPKTRCPQRTPSSSSSSTAARRRRRAPRLITAGMGDVSGRSRSSEQRLVSPATSSTLLCSPSRLQSDHLDVLALPPPPPPSFIERVPRAAKGSLQPPSFIERVPGPTPPCRRPFPKGRAARLCHQARVFVQGSPPPFRSSD

SEQ ID NO: 106191 - protein, 209 aa, Triticum aestivum
  unsure (1)..(209): unsure at all Xaa locations
  Clone ID: PAT_TA_609.pep
PRVRPRVRTYIVREGDPVAEMLFIIRGKLESSTTNGGRTGFFNSTTLKAGDFCGEELLGWALVPKPTASLPSSTRTVKALIEVEAFSLQAEDLKFVASQFRRLHSKKLQHTFRYYSHHWRTWGACFIQAAWRRYRRRKMAKDLSMRESFNSVRSEDSDGXDDPPPKKNISLRMMAGKVMAGNRKGLQAIKELPTLKKPDEPDCSLEPYE

SEQ ID NO: 106192 - protein, 348 aa, Triticum aestivum
  unsure (1)..(348): unsure at all Xaa locations
  Clone ID: PAT_TA_610.pep
MLLLGARPLARSRYGVGQRQMLAATLVSVAGGSGFTGTCLVRLLLDRGYTVHAPVQEPWDEAETNHLHALQCSGTLYXRRCLMHRPRPGARCARRAPYVSAIYPLNLPLCSRYPGSRRTKKDVLGQEGQPPRNSSTSVFVAPRFTRLLGRPWNSVRSPGETEACTRMYIDGDCWAXDVEILKQLDLWNNVAKTLEEKAAWDFAGEEGLQLVVLNPGLVLGPTLTPAPTGSLRLLMLLLGGQKLDMEPFFVGCVDVRDVAQSLVVLYENPSAQGRHLCMESAVRLVDFHDELANLYPEFPVHRIQEDKQGWVVRSKAPSKKLIDLGVRFTPFDKTVRDTVDCLRSKGEI

SEQ ID NO: 106193 - protein, 95 aa, Triticum aestivum
  unsure (1)..(95): unsure at all Xaa locations
  Clone ID: PAT_TA_611.pep
IDQHITCKKPIHLHYIAKVTKTVVFGQIIEANNNIGQCCCNTRNVDAALSCCTCPCNQARCRHVDAALSCCPRVRALHGRTVRYKQTSLQGXGKQ

SEQ ID NO: 106194 - protein, 265 aa, Triticum aestivum
  unsure (1)..(265): unsure at all Xaa locations
  Clone ID: PAT_TA_612.pep
MEGSSSGKHFILVHGLCHGAWCWYKLVPMLRAAGHRVTALDMAASGAHPARMDEVPSFEDYSWPLLDAVAAAPAGERLVLVGHSLGGLNIALAMERFPRKVAAAVFLAACMPCVGSHMGVTTEEIMRRIKPDFFMDMKRMVLNTSQGPRPALVFGPKLLAAKLYDREXAEDQTLATMLVRPGCQFLDDPTMKDEALLTDANYGSVNKVYVVAMADASNSEAMQRWMVDDLSPGTVAEEIAGAXPLARALPSQRCAALPRIADKYE

SEQ ID NO: 106195 - protein, 534 aa, Triticum aestivum
  Clone ID: PAT_TA_613.pep
MADDDEYPPARTLPETPSWAVALVFAVMIIVSVLLEHALHKLGHWFHKRHKNALAEALEKIKAELMLVGFISLLLAVTQDPISGICISEKAASIMRPCKLPPGSVKSKYKDYYCAKQGKVSLMSTGSLHQLHIFIFVLAVFHVTYSVIIMALSRLKMRTWKKWETETASLEYQFANDPARFRFTHQTSFVKRHLGLSSTPGVRWVVAFFRQFFRSVTKVDYLTLRAGFINAHLSHNSKFDFHKYIKRSMEDDFKVVVGISLPLWGVAILTLFLDIDGIGTLTWISFIPLVILLCVGTKLEMIIMEMALEIQDRASVIKGAPVVEPSNKFFWFHRPDWVLFFIHLTLFQNAFQMAHFVWTVATPGLKKCFHMHIGLSIMKVVLGLALQFLCSYITFPLYALVTQMGSNMKRSIFDEQTAKALTNWRNTAKEKKKVRDTDMLMAQMIGDATPSRGASPMPSRGSSPVHLLHKGMGRSDDPQSTPTSPRAMEEARDMYPVVVAHPVHRLNPADRRRSVSSSALDVDIPSADFSFSQG

SEQ ID NO: 106196 - protein, 258 aa, Triticum aestivum
  unsure (1)..(258): unsure at all Xaa locations
  Clone ID: PAT_TA_614.pep
MRKRERENPCGICGHYHKYEEGEPCGVCGHRPPALGPAGAAAAPRQESAFPSEILKDFLFLGSYDNASRSELLKTIGISHILNTVPLCQNLYRNSFTYHCLQDDKTLQFDDAIQFLEQCERDKARVLVHCMSGKSRSAAFVVAFLMKSRGWRLAQCFQWVKERRPQVQLADAAQQQLIEYEQKLFSCNVAPTDSFPSLGFGFPKPSGDVQVPIFNQQAPGSIFEXSALNNIPSNFSFGAKQSTLPDVSNFVVGQLGWD

SEQ ID NO: 106197 - protein, 62 aa, Triticum aestivum
  Clone ID: PAT_TA_615.pep
MPHRARPMTGLLVFMGVNLVLLSTITPVYDFVCFHPYWDRRRERRQREREALQGNGSLETAK

SEQ ID NO: 106198 - protein, 274 aa, Triticum aestivum
  unsure (1)..(274): unsure at all Xaa locations
  Clone ID: PAT_TA_616.pep
MKRTKTQPSENFKETMKRVSYGNILKATNWFSVVNRISSSHTASVYIGRFEFETDLVAIKVFHLSEQGSRTSFFTKCEVLKNTRHRNLVQAITMCSTVDFEGDEFKAIVYEFMANGSLDMWIHPRVGSSRRLLSLGQRISIAADVASALDYMHNQLTPPLIHCDLKPSNVLLDYDMTSXIGDFGSAKFLSSVSAGQEASLGFGRTIGYIAPEYGMGCKSPQWATLRFGCCTGDPRAATTAIGITSVVYLPKDENNHRGQACSRLKHIWPMAVIK

SEQ ID NO: 106199 - protein, 116 aa, Triticum aestivum
  unsure (1)..(116): unsure at all Xaa locations
  Clone ID: PAT_TA_617.pep
EKSDVYXXGVVLLELATGRAAVADGEDVVEWASRRLDGAGNGREKAMALLDGSAAREEWEKEEAVRVLRVAVLCTSRTPAVRPSMRSVVQMLEDAAVGGRVGGNGKPALEVKVVVA

SEQ ID NO: 106200 - protein, 108 aa, Triticum aestivum
  Clone ID: PAT_TA_618.pep
MAEPEARITTLGSSAFRFTVDYEQSKKVPVGKAIHSDVVSAGGHHWRIEFFPRGQSEADKGEYVSIFFRHMSKTRRIRAIIEAFVTGSDGNPSVPDILQRTFPLNQWR

SEQ ID NO: 106201 - protein, 205 aa, Triticum aestivum
  Clone ID: PAT_TA_619.pep
MESIEVLALVAAVLFCLAVLRRSTSPAVQLIRDPAVAHSLLNEHADAFVNRPSAGLLTALATWTRGPERNETLATVIYGSHWRSLRSNLTAGFLNPTHLAAVAPLRADAIQDLVTGLSQAGGEEVVMREHLDRAMFTLGARLCFGGDHGLQESGVRAMQRAMDDLSQAMDDTVSFDGSTLGRITHWRRLRRLFGLFAPLCQVVRP

SEQ ID NO: 106202 - protein, 481 aa, Triticum aestivum
  Clone ID: PAT_TA_620.pep
CGFVYISHANKSNDARTIEKDFQDKVRETMEKAFWDVVTDSMRGDKPDYSQLINLVKEVRDSLHDLAPKEWKEEICENIDLEILSQVLESGSQDTQYLGQILQYSLDMVRKLSAAAKDDEMKASHDKLLSELAASSEDTDNGVSSFVIAVIKGLRFTLEEIKQLQVEVSKRPVQLMQPTIKGSAGVEYLQKAFGDRYGPPANASASLPVTLQWISASKSIVDAEWSEHLGSLSVLPAANHAQPLVTVLRAGHGAPAAAVASAGSSGLPECKGEKIDKLVRVGLLQLISGMEGLQLQSTPESFHLNFLRLRAVQGQFQEVIVMATSMLVLRQVLMSENSKITPLELETVISELFGALVKLLDNSPEAGTEEIVEAMMSASASAGSLSDAKIQARRQIITRVLLKSLQADDIVFKKVSRAVHCAFRGVLLGGSGAKGQKLADAALRRVGAGKLADRVFKAAEVLIRVATVSEKVHGPWYKALA

SEQ ID NO: 106203 - protein, 180 aa, Triticum aestivum
  unsure (1)..(180): unsure at all Xaa locations
  Clone ID: PAT_TA_621.pep
MAEAVRDDHRGAVGVAVDDGTGLRPSTNGDSTWEIEELEPDDRTAGPPPPPPPGAAATSDADDVYVAVGKGGSSMAALSWALRQLAKPRSFVYLVHVFPVVATIPTPXMMPKRQATPEQVETYMNQERSKRREMLQKFLDHCRNFQVNVDVYLIESDQIADAVAELIPVLNIKQLVLGVA

SEQ ID NO: 106204 - protein, 175 aa, Triticum aestivum
  unsure (1)..(175): unsure at all Xaa locations
  Clone ID: PAT_TA_622.pep
MSVAAGVSDAAIAVRDKLRGKIGQTKVKRYWPGKKPEWADEAEDDIDLRAARXSLDEAFPKAEEGDRDRDRPPKDDRRLRRLAETRAENKEELRADHRRIRQAEIVSTAEEERDRQEAQVEEEDDEDAQEERRRRIKERQRLRAQEEEELLPQEDEPIEDDVQESEEFEYETDSE

SEQ ID NO: 106205 - protein, 139 aa, Triticum aestivum
  Clone ID: PAT_TA_623.pep
MASTVAFPPAIAVGANVQHSRRTSSLRPVPRARPVAARASAERDGAAAAVQARSGRTIEECEADAVAGKFPAAPPPTRPQAPNGTPEIRPLDMAKRPRRNRRSPALRAAFQETRITPENLVLPLFMHEGEEDTPIGAMP

SEQ ID NO: 106206 - protein, 113 aa, Triticum aestivum
  Clone ID: PAT_TA_624.pep
MGCAGSTPKSDDSSKKLKKPKPWKHTQSITPAQLKQMREEFWDTTPHYGGQKEIWDALRAAAEADLALAQTIVDSAGIIVSNSDMTLCYDERGAKYELPKYVLSEPTNLIREK

SEQ ID NO: 106207 - protein, 313 aa, Triticum aestivum
  unsure (1)..(313): unsure at all Xaa locations
  Clone ID: PAT_TA_625.pep
MQSEIWLLWATLAAALLFYLTSAARRGGTGARQPRGPTPLPVLGNVLDLGGNLHHTLARLARVHGPVMKLKLGLVTIVVVSSRDAAREAYTRYDRHLAARAVPDAANAVGNSXRSMIWLPSSDPLWKTLRGIVASHIFSPRGLAAARGVRERKVRDMVGYFRCHAGXELDVGQAVYGGVLNLXVSSAFFSVDVGGXGSESASGLREXVEDIIAALTNPTLRIFPFLPAAGPARLXXLGRGRXTKVFXIFTDIXRXXANPGQRTTQSLIPADSFKIPKYVNQRPDHGTREWQCHSRTHASSPNGNLEETSDPKA

SEQ ID NO: 106208 - protein, 163 aa, Triticum aestivum
  Clone ID: PAT_TA_626.pep
PTRPVVPDADDLRTKFPYLEQVLKETMRYFPGSPVVSREATADVEIGGYFLPKGTWVWLATAVLGRDPEQFPEPEAFRRERFDPESEECKRRHPYAYIPFGIGPRACPGQKFAFQQLKLTVIHLYRRYVFRHSARMESPLQLQFSIVTNFKNGVKLQVVQRKN

SEQ ID NO: 106209 - protein, 136 aa, Triticum aestivum
  unsure (1)..(136): unsure at all Xaa locations
  Clone ID: PAT_TA_627.pep
RRCLRSAGRASSPPPTPSIRRPRWPSPPAVATRTPSRRVASDPTGRGSAPPCGTHAMGGRRRRRSSATRWRSTTARAGASSPAPAAPPGRPARAPLSPRXKREPEAEAGPQRRAXASLGRRTSSPRRRRTPFCPRC

SEQ ID NO: 106210 - protein, 546 aa, Triticum aestivum
  Clone ID: PAT_TA_628.pep
SGNSDIKARPLFRVISEDGLQIDGSTPNACWKEIYCRIKQKQCNVASELEGNVCQRSGSDMFGFSNPQIRQLIQELPNARSCLKYFENGGDTLRGYRAVHVNWKDLDFCSVCDMDEEYEDNLFLQCDKCRMMVHARCYGELEPLNGVLWLCNLCRPGAPRVSPRCCLCSVTGGAMKPTTDGRWAHLACAIWIPETCLKDVKRMEPIDGLSKINKDRWKLLCSICTVAYGACIQCSHPTCRVAYHPLCARAADLCVELEDDDKIHLMLLEEDEGPCIRLLSYCKKHRQPSTERPSLESNLGNPAQLVQTDAASSSGCARTEPYNFHRRRGQQQPQVTATASVKRLYVENMPYIVSGYCQNKVGCDTSCEPIQSVALLDAASQEASVNVSSMAEKYKSMKATFRKRLAFGKSRIHGFGVFAKVAHKAGDMMIEYIGELVRPPISDLRERRIYNSLVGAGTYMFRIDDERVIDATRAGSIAHLINHSCEPNCYSRVISVLGDEHIIIFAKRDIDPWEELTYDYRFVSNEQRLPCYCGFPKCRGVVNDVE

SEQ ID NO: 106211 - protein, 317 aa, Triticum aestivum
  unsure (1)..(317): unsure at all Xaa locations
  Clone ID: PAT_TA_629.pep
MHNRAGGGGGGAGEIVEAGERIVPHSGPLGAKRSAMRKSARFAESVSAPLTAPHGAPAPRARNDGGGDDDDDYVEITLDVRDDSVAVHSVKPAAGGEDSDVKLLAQTLEKRSSSYGQGVLRTASTRIKQVSQELRRLASVNRRGAGPGRVDKSKSAAAHALKGLKFISRTDGSAGWPAVEKRFDDLAENGLLHRSKFGKCIGMKELAFAGELFDALARRRNITGDSISKAELLEFWDQISDTSFDSRLQTFFDMVDKDADGRITEEEVKEIITLSAAANNLKKVSEQXEEYARLXMEELDPNNLGYIELYNLEMLLL

SEQ ID NO: 106212 - protein, 265 aa, Triticum aestivum
  unsure (1)..(265): unsure at all Xaa locations
  Clone ID: PAT_TA_630.pep
MKLRAGILPVAMLAIAVLSSPAFAQKTKSPPAPPAAVLPPSPAPAPAPRHVDLADLLSVAGPFHTFLDYLQKTXVLETFQSKANDTKEGITMFVPKDSAFAALRTTTFANLTSDQLKSLMLYHALPKYYSLAEFNKLSSLNPVATFAGSQYTLNLTDNMGSIRIKSMWSNPKISSSVYSTRPVAVYEVDKVLLPMQIFKSDPPLAPAPAPAPADAKSSDDAPSPASGKSASAKAKAGSKSASHRAGVSVASYLAVAVSGGLMMLL

SEQ ID NO: 106213 - protein, 66 aa, Triticum aestivum
  Clone ID: PAT_TA_631.pep
VRKNCPEHVIPNLSTLSSHRAGTPGRPCTAPPPSCPTFHRANPPGLLTGRGDPAQQGFQRNGAARP

SEQ ID NO: 106214 - protein, 263 aa, Triticum aestivum
  unsure (1)..(263): unsure at all Xaa locations
  Clone ID: PAT_TA_632.pep
APASPTDPNLLVSLFSVSPTLPPPPXSLPLPPFGHFHPQVPLPPPIPAPXSPPPPPPPPRTRPFPVVSSPTHRRPGRPPHPQPPTSSLPPLSASSEQLYARGDRASARVRPSSQPPPTIPRARAPREELLLCFCTPPPATTSHSLPEPADSALRRHGRSCPRPCSAPPRCEVPPCPFLRRWAEASPKSKRRRRLPPRHGLPCFVCFADRAPSPSTCPPAVSVRCRAQSTPAAPPRCRSARHPRFSTCKQIARSKQALAVDIIS

SEQ ID NO: 106215 - protein, 157 aa, Triticum aestivum
  unsure (1)..(157): unsure at all Xaa locations
  Clone ID: PAT_TA_633.pep
MEEQLSPVAVTHLLQHTLRSLCTSDASQWVYAVFWRILPRNYPPPKWDLPGVAYDRTRGNRRNWILAWEDGFCNFRGHHLXQPPAAKKGAGAAAAAYADCEAAAAAAVQEAKQGLGLGLQPELFFKMSHDIYNYGEGLIXGKVAADHSHKWIFKEPP

SEQ ID NO: 106216 - protein, 118 aa, Triticum aestivum
  unsure (1)..(118): unsure at all Xaa locations
  Clone ID: PAT_TA_634.pep
GVYWVADSNLASDVTGGFMVRSSQMLFAQALIFHHLGSSGSPLLRAGMLLSYTRTRHLYGDSEVCAFSTYLLLQSGKIYGLAARSWVGHIYVXGXKXLSDKQRAPEINRMKSYGAYVA

SEQ ID NO: 106217 - protein, 173 aa, Triticum aestivum
  unsure (1)..(173): unsure at all Xaa locations
  Clone ID: PAT_TA_635.pep
MMIGVAGFSRHIGQLLSKSNGFIAASLSAASCADEAEKAEGAGCRDDAAALRLKWIAMAAILVSGVMGVGLPLAGRKRRTVQTGSAVFVAAKAFAAGVILATXGFVHMLHDAEHALSNPCLPAAPWRRXPFPXFVAMLAALATLVLDVLVTRFYETKHRAGGSFGSRLTPADS

SEQ ID NO: 106218 - protein, 158 aa, Triticum aestivum
  Clone ID: PAT_TA_636.pep
MTTLVGCTLVEVDPGYFQTSQLTEKSDVYSFGVVLIELLTREKPICGGQMDEVRSLAMHFSTMFHQNQLLKIVDSQVAEEAGMRHVKTVSQLALRCLRLRGEERPRMIEVAVELEALRRLMKQHSVLKSEEEEPLLPLLRDCELPRGDEFRCAVEFEP

SEQ ID NO: 106219 - protein, 222 aa, Triticum aestivum
  unsure (1)..(222): unsure at all Xaa locations
  Clone ID: PAT_TA_637.pep
RADLXRXPRXFFPRTLLVXDLXLAXDREGPXRSLLQRSTCSGGSERHGHRRPWPMPRVRRDRPPPVSDGPRTARSPLPMSDATRLTRSPPLISNSTRPTRSPPVMSDAAARIINLLSIHLRLADARPGFPSVRDVLSNVEIGADGGVGSSAGRTAAILILPCQEQRPKTKEAEKETKSTNPNSIGSTEEEEGDLHDLIFVFRPTERKARASKRKGKPGYVCG

SEQ ID NO: 106220 - protein, 95 aa, Triticum aestivum
  Clone ID: PAT_TA_638.pep
ALYSIHLDTVQGPDAAPPPPARAPAPTAAVFTPAPAPLRLRFSASFMPLHEADRAPTHSDLAPARCRRIKMAAFCIYSSPSSALPEFERVAHWER

SEQ ID NO: 106221 - protein, 172 aa, Triticum aestivum
  Clone ID: PAT_TA_639.pep
PTRPGTITLTRLLAPFMLDRGMGHFVVMSSAAGKVPTPGQALYSASKHALNGYFASLRSELCTKGIKVTVVCPGPIETPVSSGATSLSQRHSSEKRVSVERCAELTIIAATHGLKEAWISYQPGLAVLYVVQYMPTIGCWIMDKVGAKRVDAAAKKGNAYSWNLLFGGKKSA

SEQ ID NO: 106222 - protein, 248 aa, Triticum aestivum
  unsure (1)..(248): unsure at all Xaa locations
  Clone ID: PAT_TA_640.pep
MASFFALLVVSAGANVHLYKFNLDSGDYHPLTYGRVRRNKVXGKDVSMTGVIHGIGEVLSMQFASFGAKLVPSGRNKEELERVKRNIISKHPDSKVEVLLMLLSSDEESLKEVVHSGESLFSSAGIDFMMHNALFERPKRGALVVTDEGLKATFQSNVFGTITLTSLQSLLVLXSRARTHCCDERVSVERCAKLTIVAATHGLKEAWISYQPVLAVMYVVQYMPTIGCWIMDKIGAKRVDAAATKAFT

SEQ ID NO: 106223 - protein, 303 aa, Triticum aestivum
  Clone ID: PAT_TA_641.pep
MGDGVAFEAARKIIMHPLYASRSSPWLDLKVFYVRVSNCMVDESAPDHLTLNHIPLSPDTVIEVNGRRSSMHTEFVSSSLRRDRIDKKTEEATYVSTDSIRMTGSVRFQVFDKNDLLLTGDLELCNANGVVGEPKSSSKKWNIRSQSSASSSGFLKGKMSTGPDSAHPVVEVYIAGTFSGTPIILTKTVQYISRRKSQMKLKLDSIPENEATELHTENSHGDSVKVSEFYDPKSETDVDMDYNSLYSRQDFLEGEDGELSWFNAGVRVGVGIGLGICVGVGLGVGLLVRTYQGTSRNFRRRLP

SEQ ID NO: 106224 - protein, 230 aa, Triticum aestivum
  Clone ID: PAT_TA_642.pep
MHRSHASPKGLEPNSAREGGSQASSRATMKCWCTHAPKGAMATPLSSPFSVTTLRAPLWHGRLHAPPLPPLRASSGDDAAGPETPAPVATAPAADEEFEKRVLQLKSRVGPKKRGSAGARKRKAAAESNAVTLPPVPLREPRSALGLPVEFGFTAYSERLNGLLATVGLTALLLVELGSGKSLVKYHQAPTLFLQVYTIVAAGTVYVKYEKERISVWPAPAPPKAPTSGE

SEQ ID NO: 106225 - protein, 156 aa, Triticum aestivum
  Clone ID: PAT_TA_643.pep
GVLKLMKVEGLTIYGRVGLQNYRHVKYIPEKKEVKRPCSEDNKAKSTSGIDSGKKKSFQMAEALRMQMEVQKQLHEQLEVQRKLQLRIEEHARYLQRILEQQKARKSLVPKPEEKTEASTTSAPSLKCKISDTEIEQNLQMDSRRPELQLDLESEP

SEQ ID NO: 106226 - protein, 232 aa, Triticum aestivum
  unsure (1)..(232): unsure at all Xaa locations
  Clone ID: PAT_TA_644.pep
SCDMFLLHAAQLCGLPKRLLGKPHSGLTARAVLKASQNAAFNGLITSANSRIDEFMLLLTSIDWTTEETPEHANDYMNEVLIYLDMVVSTAQQILPREALFKVISGSLSHISDSIITVLLSDRVKRLSINAVVGIDIDLKQLEEFAEDRFHTTGLSALKKETNFKDCLVEIRQLTNLLLSNHAESFMNRCDQGXKSYASLDHKKVAIICDKFRDAPDSLFGSLFSRNMVPEC

SEQ ID NO: 106227 - protein, 200 aa, Triticum aestivum
  Clone ID: PAT_TA_645.pep
PRVRPRVREPTPTGSPGPYPSRSGRCHNLATESGVAHLLFQSCELQSATTDAARLPSGTCHLRWSEAAEAGDFEASARSYFALDVEEGVGLSSWSPRARRRWAHTWRRSGHRPLLPLSSCSLPHLPLFLFRRFLRPGAGVHQLATRRGALAVRTIQLSFSWDHVLRTSIEFPSKVSASKFNHLHIHAEAGSLYMCSCRLY

SEQ ID NO: 106228 - protein, 367 aa, Triticum aestivum
  Clone ID: PAT_TA_646.pep
AGLEVNVLLNPKDEQVICYPDQDVQGMDQKVGAGLVAPLPQSAVKMDEIPVAPLPQSAAKMEDEIPVAAVPLSLSLAISLPPSVKEVDKAQVAAVPLPLAVEEDVPKPTQKVFKRTESTQKVLSDKMPSKKLKLSQDLTTKNMPSKKLKLSQDLTTQSMAPVPDVKVRSVPSAQLPTRQADRSKWFKPQPWHEKLAQADKEGRLVYIQNLDIRFGASEIVELIREALQLSCTAKPINHPTYDDPNNGKAYVVFNSRNIADDAVMKINSGLVVGGRPLYCSKGLLKVPKPASGALVGHLTISNQKMNPRQREEQKKAVSTSHCSQPNTIEYDLALDWMLVREKQAMKFSMLHKRHAGERKSFAAKMEK

SEQ ID NO: 106229 - protein, 147 aa, Triticum aestivum
  Clone ID: PAT_TA_647.pep
QIWDTAGQERFKSLGVAFYRGADCCVLVYDVNSMKSFDNLNNWREEFLIQASPSDPDNFPFVLLGNKVDIDGGNSRVVSEKKAKAWCASKGNIPYFETSAKEGTNVEDAFQCIVKDALKNEPEEELYIPDTVDVVGGNRTQRSSGCC

SEQ ID NO: 106230 - protein, 206 aa, Triticum aestivum
  Clone ID: PAT_TA_648.pep
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGINVEEAFQCIVKNALKNEPEEELYMPDTVDVVGGNRGQGSSGCC

SEQ ID NO: 106231 - protein, 148 aa, Triticum aestivum
  Clone ID: PAT_TA_649.pep
PAPGPSAPRPPACHPSRRTATAQAHASPLPPPPPPPLRPLPRASATPPPATRLPTFDPPRPRARSAPPSHRRHATTPVATHRPHHPLSQPRRRQSGVQAYHPTRNSSAKEEVQQRIGGSHRQMLDSAGRGSSTEALFSILCLERSGSL

SEQ ID NO: 106232 - protein, 205 aa, Triticum aestivum
  unsure (1)..(205): unsure at all Xaa locations
  Clone ID: PAT_TA_650.pep
MPATMAGIMRAILACVPAAPSSTGDGSLSAAFSSTCPGGGGEDRISRLPDALLADIVSRLPVKEAARTAAISPRWRRLRPSTPLVLDDTDIFDDFAEADDDDDGDTFGLIDWRALTNTLSRILSGHPGPFRCVHLTTACNYASARGGSALVRWLHLFAAKSIQELVLINFPNWPFKNTLPAEILRXVASLRRLYLGLWDKFPDTN

SEQ ID NO: 106233 - protein, 351 aa, Triticum aestivum
  unsure (1)..(351): unsure at all Xaa locations
  Clone ID: PAT_TA_651.pep
LPLQPLTDAGTLAARHGPGFSLRLGSRPAVVVASAELARECFSSELDATLANRPRFPSLKEVSFDYRALTVASYGAHWRAARRVAVVHLLSARRVDLMSDAVVARELRALVRRLARVAAGGAARVELKRRLFDLSHSVLMEAIARSRNTYSDDGADMSREAREMKDIVDAIVPLVGVANLWDYLPVLRWLDWRGVRRRLADATSRRNAFIYKLIDGERQKRLNAAADAADKQQEEQEQSMIGVMLSLQKSEPELYTDTFIAALVANLLGAGTETTSTTTEWAMALLLNHPAALKKAQKEIDTHLSLSGEPSRLLDKKDLPHLPYLHCIISETXRLCPAAPLLLPHEAXADC

SEQ ID NO: 106234 - protein, 251 aa, Triticum aestivum
  unsure (1)..(251): unsure at all Xaa locations
  Clone ID: PAT_TA_652.pep
AYSDPQAIALCFFFHALQTSGVRLFTAIQEENNSPPQDFLHGSAKRILTSLKSNSIEATTFGQDSSSQDEAYTAGYYTSSRGPEASYYGLHATMDVYGHELKHGQWSSTTFWVSHYGDGNKSSYNEIQVGWHIRPERYGDSHPHFYTLWTRDGFETGCYNMDCPGFVRANDAVIAPGDAIHPVSHVPGPIQNITLRVFKDKTSGXLVGLLRLQQHPHRGGIFSEVHIQLLSTKGKCNVFLWDLLNLQKRFQ

SEQ ID NO: 106235 - protein, 185 aa, Triticum aestivum
  unsure (1)..(185): unsure at all Xaa locations
  Clone ID: PAT_TA_653.pep
EXIYTRRESSNTWPEVLTPSANQKLQEEMNKALSLSVVCSTENDGNNNVFEVCDGSVYTVNIDTWECTCRKWHVSGIPCCHAIAVFEQTDQNPVEYCAKYFRRDYYRMTYAMSINPIPDVIVPPASTDLTQSMGLQPCPILARRQVGRPKEKPADPRIAIKRAVRCSRCKGYGHNKATCKVPLTA

SEQ ID NO: 106236 - protein, 269 aa, Triticum aestivum
  unsure (1)..(269): unsure at all Xaa locations
  Clone ID: PAT_TA_654.pep
PPEHIPPGQGPTGREQTSTKTGGPTLLMLGLLLLSLFSVGTVSAQQKFGINYGQIANNLPDPTQVAGLLRSMNVNRVKLYDADPKVLTAFANTGVEFIIXVGNENLQTMATSPGAARQWVAQHVQPFLPATRITGIIVGNEVLGNNDTAMAASLVPAMQAVYDALAALGLSGRVTVSSAHSVNVLGSSFPPSSGAFQEGVAQYVRPLLDFHSKTGSPFLINAYPFFAYKGSPGSVSLPYVLAQPRPARRRPRLRHHAVRAARIDAVYAA

SEQ ID NO: 106237 - protein, 277 aa, Triticum aestivum
  Clone ID: PAT_TA_655.pep
MPPPSPVCVVSSRTVKPPARPRERIPLATWDVSMINANYIQKGLLFPAPPPPFSTGAAVTSHLADALAEALGGDYYPVAGRFVTDRHRDDSGAVVGCSVSIDCDGQGVEVVHAVADGVAAADVVPPDADVPSVVEDLFTLNDAINYDGHELPLFAAQVTELADGGVFVGFVCNHALADGTAFWNFLKALAEISRARLAPPGDPQLPTSSPRPMFERWSPDGGTAAPVVLPCKDLPELIERPARVPLRGRVLHFTAESMAALKEQAREELLAAGDAAG

SEQ ID NO: 106238 - protein, 236 aa, Triticum aestivum
  Clone ID: PAT_TA_656.pep
YILYKNSYSSPTGDLCMIQCTTGLWLYYSNAATAGAAPPPVRCMLLRAAAAAQPGRAGAATDGRRRPERYHANQREHKRHCQRPTRATTAAAAGSPGCCRSPQLKKRTIGTPGCINAASLPPQCRALVVARISYTALRRWSAGALAVAGSSAASAVSGDEDLKEPLLVPRLGRQPELPQRGREPGPLAPLLLHGVAPAQGRLRGAVDSPESSAAPAATDHSRPVEQMHGWIATTSR

SEQ ID NO: 106239 - protein, 224 aa, Triticum aestivum
  unsure (1)..(224): unsure at all Xaa locations
  Clone ID: PAT_TA_657.pep
MAQAEADVPATSLFGADRRLCSADVLSPLEGRARIEGAVLNFLATLSSPSSPAIPVLPLISRKSTNCSLRSGLLSDVSSVDLSYAFCKRSLMRENDAKAFVRVWKVMEMCYKILGEGKLVTQRELFYKLLSDSPKYFSCQRHVNQTIQEWWSLXRCARXRLGIMGSRXGALIGRXXLHEPEEDXIECAIAWPSGHAILGDLNQLSRXNLSSEARYLILGGKDAI

SEQ ID NO: 106240 - protein, 416 aa, Triticum aestivum
  unsure (1)..(416): unsure at all Xaa locations
  Clone ID: PAT_TA_658.pep
VDVSNGIHAFLRHLPCTFSVFVPEEEIHSGAHGFPAFPRRLPSTSLVFLPEEQNHGDGHGFHGQGWSSRERPSVLARRLTETESPHSLPPEKRQILDSLNXRPGGTTFVDASLKPVLKDSWSSHRDXLPHPSSERFFDVVKDLRERAEEIPDEYLVCLVGDMVTEEALPTYQKMLNILDGGVRDETGSSPTSWAVWTRAWTAEENRHGDLMNKYIYLTGRADMRQVEKTIQYLVGAGMDPKTEANPYEFFIYTSFQERATFISHGNTARHARKYGDLKLAQICGTIAADERRHELAYTKIVEKLFAVDPDYTVLAFASIMKRKITMPAHLMYDGQEDNLFEHFSAVAQRLGVYTAMDYADILEFLVKRWNVAGLTGLSGEGRRAQDYLCSLRTRFXKLVERAQGSGKQLPVVPFSW

SEQ ID NO: 106241 - protein, 256 aa, Triticum aestivum
  unsure (1)..(256): unsure at all Xaa locations
  Clone ID: PAT_TA_659.pep
PSSTGAATGAVGGDVLLQWGHNKRSRCRRDSSAASSSASPSSQRRQALGNGKIQRRCVSXAPAEKLMPPPPAAPPRRPRLRPPPPLPPGTPGAFAHDPPSPTIRSVEERSGGVHKRSSPDKAPHHKPPAAEHHMDSKNAHHHHHHHSNNHDSQLAAADNGTGAGEKLGGERLELPRIYISLSRKEKEDDFLVMKGTKLPQRPKKRAKNVDKSLQFVFPGMWLSDLTKGRYEVREKKCAKKRRRGLKGMESMDSDSE

SEQ ID NO: 106242 - protein, 178 aa, Triticum aestivum
  unsure (1)..(178): unsure at all Xaa locations
  Clone ID: PAT_TA_660.pep
FSHWEILGSVHLPYGVKDVFKTVYKEGGVRSLYRGIGPTLIGILPYAGLKFYIYEDLKSRTXLFSGIGPILKLSCGALAGLFGQTQDYPLDVVRRQMQVQNKQPQNANDAFRIRGTFQGLFLIIRCQGWRQLFAGLSLNYVKVVPSVAIAFTTYDMMKNLLGVPPREKAHPLTIDSNK

SEQ ID NO: 106243 - protein, 136 aa, Triticum aestivum
  Clone ID: PAT_TA_661.pep
VRPRVRPRVRSLYPPHLRCAVWVLSPPLLLLPPTLPPTSLPPPLILLHSPIESTPGEPPAPHRGSCLLVLPRSSKFAPFLLLPRQSSPRRDFRSRDSELPSPSSFSDCSWLLPRVVQAARVGRLILCACGRRIYVS

SEQ ID NO: 106244 - protein, 309 aa, Triticum aestivum
  unsure (1)..(309): unsure at all Xaa locations
  Clone ID: PAT_TA_662.pep
GSRWLAAVPEEVWEVRPSGMLVQNRTPDSVPPPGGAPVPTIRVKVKYAXGVYHEVYINSQASFGELKKLMSEKTGLHPDDQKVVYKDRERDSKAFLDMVGVKDRSKMTLLEDPTAQAKRLIEERRNAEXRRAAKAVSRVSLDLDKLASKVSALETIVSKGGKVVEADLVTLTEALMSELLKLDAIVAEGDVKDQRRIQEKRVQKNVETLDAIRAKTAKRNNTPAATANKARAPHLPPRPPPAQQHQQRRQFQPAAPTTATAPAPQTATASWDTFDLLSSAPSSSSSAPVSTMALATTTSPSPRFEWELF

SEQ ID NO: 106245 - protein, 132 aa, Triticum aestivum
  Clone ID: PAT_TA_663.pep
SSPAWARFACSFLPFCSCSRSHCGKTPVGKGWRPPYLESMQNQIYRYACVAAMGLYAIADAHTVTQWQWQASSPFDGYSTWVLGAWPMPTSRSKRPTQCPTPTAPVPVHTTHTTRPHARGDGTPSLESKTCT

SEQ ID NO: 106246 - protein, 249 aa, Triticum aestivum
  unsure (1)..(249): unsure at all Xaa locations
  Clone ID: PAT_TA_664.pep
MVADLNPCFFEEDVFFTLFCTVDLYSWVEKEPDCSKILDKQQWRGDGVLTHEGLLWWFDFSYCILACDPFHDKPVLHQIKFPHVQHELPFAPSTINGDILRCLKVSEGSLRYVQIHGPRHEPVVSMWTLSSNNPSEAQWKPTHEVRLAEIWNHETYKRTPLHXDVIPTVALVNPMKAHEVYFFLDKHIFSVNLQNSSVVXYEKFEDSGMPDLSSRLVHAWQFPPELTEYHHLPGTDVLGATGGLFPESI

SEQ ID NO: 106247 - protein, 283 aa, Triticum aestivum
  unsure (1)..(283): unsure at all Xaa locations
  Clone ID: PAT_TA_665.pep
ASLLRPDRNYAPLSTDDPSASSSRGAATVGLPPAWVDVSEEISANMQRAKTKMAELAKAHAKALMPSFGDGRDDQRAIEILTHEITDLLKRSEKKLQKLSMKDSSEDSNVRKNVQRSLATDLQTLSMEFRKKQSTYLKQLRQQKEGQDGVDLEMNMNGSKSTFELEDDEFEDVGFTEVQMSKLKKSEAFTREREREIEQVAQSVNELAQIMKDLSVLVIDQGTIVDRIDYNVQNVAASVEEGYKQXQKAERTQKKGGMVMCATVLVILIFILIILLVLKKILF

SEQ ID NO: 106248 - protein, 98 aa, Triticum aestivum
  Clone ID: PAT_TA_666.pep
HRPRHTFSPVGMCAASQPVGGQPPCGLCVPHDGPGPPPSRRLYKCRHSLMMGSPEKASPPNTRAELDARRISTVTTIKIAAETNFGLIVELMCFAIQQ

SEQ ID NO: 106249 - protein, 72 aa, Triticum aestivum
  Clone ID: PAT_TA_667.pep
VPSFSVWKIQNPNSSVEHLFWSAHLVIFVLELDYCRVDRLLYILKKCALPSPFHSMVQKYRSFVSTYRRNVP

SEQ ID NO: 106250 - protein, 156 aa, Triticum aestivum
  Clone ID: PAT_TA_668.pep
KRKRELRHDPGNSEKQQKKVKHAAQRGRAANRTDSILPTPTVFMPHVHQVGSTQPFNQIVHPSQLPIPPRLSYGLPQAHFHPGPHMIGQPHGSFIYSTDPGIQLQQQARHMFVPLPVHQPAINRSFHPHGFNGAHEVLYDDNSWLPYGINPNYRRV

SEQ ID NO: 106251 - protein, 121 aa, Triticum aestivum
  Clone ID: PAT_TA_669.pep
CLGYCIRSRLDSELTLVAWLMQETEAKKRRLERINQQKLGLLAEVKFLRKKYSLFAKDDPEQTHHRLKKKKAKQIPSILGINEGPSTSKNTNVDLNHDSAMNAEEAGFQDIQNLGSMIRLV

SEQ ID NO: 106252 - protein, 114 aa, Triticum aestivum
  Clone ID: PAT_TA_670.pep
YYIKMSPHREASFLVRATRTPTGTALLRNTRAFLSFHISQEISSIRETITLRAVTSPRYHHHHYYYSHWQDMIRNADECFRRRMRPRCYPTQSTATVHPFLSSARPIWIDVRAV

SEQ ID NO: 106253 - protein, 375 aa, Triticum aestivum
  Clone ID: PAT_TA_671.pep
MAFLLGTDGGGGRSLLPSRWKSSQPQLDPVDRSDEEGGGDIDWDNLGFGLTPTDYMYVMRCSQEEGGFSRGELARYGNIELSPSSGVLNYGQGLFEGLKAYRRADGPGYMLFRPEENARRMQHGAGRMCMPAPSVEQFVHAVKQTVLANRRWVPPQGKGALYLRPLLIGSGAILGLAPAPEYTFMIYAAPVGTYFKEGMAAINLLVEEEIHRAMPGGTGGVKSISNYAPVLKAQMDARSKGFADVLYLDSVHKRYVEEASSCNLFVVKGGAVATPATEGTILPGVTRRSIIELARDSGYQVEERLVSIDDLVSADEVFCTGTAVGVTPVSTITYQGTRYEFRTGEDTLSKKLYTTLTSIQMGLAEDKKGWTVAVD

SEQ ID NO: 106254 - protein, 290 aa, Triticum aestivum
  Clone ID: PAT_TA_672.pep
GPRAVAPLPRPMGRPCPDPVPLAAGARVGRCRAGLGCRFPLYSSRCRFRCRAGRGLVFAHVAYGVMPLWSLSSAPASGAEVWMTSLACRRPWRAAAEVEAGRSSFPNKLAVVVPDLEDRQSLVLFFPCCRGGGKEEGMRWTSRSCRFGLEQILTGGWCGLMAPAKLGCGGRRPVMEPAYCGRWPGSRASPVTFLAEGQPTISSWPGCHMAGSCTFVSEFMECCCNHEVVAAPSGPSPVTAKLDLRGSCVGPNCSSILESGVLLVKVRDLCVISLSFESLSELCTVMTRNQ

SEQ ID NO: 106255 - protein, 273 aa, Triticum aestivum
  unsure (1)..(273): unsure at all Xaa locations
  Clone ID: PAT_TA_673.pep
MWFVAWAVGGGRLWRARRELDKVLDKIISQSEIRQGDHLLSVLLRISDEGELDFPIDMGGGKAIVMDMFTAGTETTSSISEWVMSELMRSPEVMAKAQAEVRRAFDNKSPQDHEGHVAELHYTKMVIMESMRLNPVVPLLVPHVCRETCDIGGFEVTEGTRVMVNTWALGRNPEYWHEPEEFRPERFEDGTATYKGSRFEYLPFGSGRRNCPGDTFGLAVLELMVARLLYYFDWSLPAGVKPSELDMEMMVAATSKRKNXLHLVATPCKACSF

SEQ ID NO: 106256 - protein, 274 aa, Triticum aestivum
  unsure (1)..(274): unsure at all Xaa locations
  Clone ID: PAT_TA_674.pep
AKSLVLLVYTQLYPVCIVFVHTVRIMPHRPVRRRGEEETAATTSDPFYCFLYISMALATYLLFCIVVQNQLELSHPALVVSATALMLILLLPLAVVVKQEYRIKRELEESLLVPPTVTYEKPAVQLQMAAKTETKTETVTSAPTEVEMSSSSKAGPQCLKEMSPPPARSXGGCVMHMFRSVDMLVLYTITISLVRGTLLAIDVATICGVGGTQTAIANMGQIGQWLGYPAKSINTFVSLISIWNYAGRVTSGFASEVLLERYKFPRTLMLTGVL

SEQ ID NO: 106257 - protein, 191 aa, Triticum aestivum
  Clone ID: PAT_TA_675.pep
MAGAEEDEMAPSAPHPVDPQQPMEQGPAAKRSRSEHHHGDGDAPSFKMEDLPVDVQAVIMSLLPLKMAVRTSIVSKNWRMLWTFRCNLSFKGPRYLCENDTKIQQAKCIETVNCVIQQHSRIGINKFSIRCGLFEEDSVHLDRWIRFAASSKAKIIHLDLRFKDVFEEVNHLHLEALLDAQGSSFVRSLFL

SEQ ID NO: 106258 - protein, 124 aa, Triticum aestivum
  Clone ID: PAT_TA_676.pep
KKMENSYKAWGDAECTVQASEVTIKSDMVSQPTGRLLLPSEDSVENPERKAAYLPHLVISDPSPSLDGDGVVYLIAREKLYHQKSWVLAVDMNSKTLRSVAPFGMVEDPCDSVVYCTSRSASNT

SEQ ID NO: 106259 - protein, 148 aa, Triticum aestivum
  Clone ID: PAT_TA_677.pep
VLRNSYAVGGSISSSAFTAGLQYNNRDQLRLMVSHKLQEKSHVKELMHRSSIGKDLYALFCPPASSQTTIAAQLIHCSTAQSTVGAVGIEFADPDSVLKLRLASSGVISTSWKNRFGLATVGLKAQFDVTDLGARPRVGFSVSVSPRF

SEQ ID NO: 106260 - protein, 450 aa, Triticum aestivum
  Clone ID: PAT_TA_678.pep
GTRVSARPSGVPSSRAAGAGPVPSTRARRFGHGRRHPSVALDLVAGDGSLHRSAVPSGASTGIYEALELRDGDKSVYGGKGVLTAVRNINEVIAPKLVGRDVRNQKDVDAIMLDIDGTENKSQLGANAILGVSLSVCRAGASAKGVPLYKHIQELSGTKELVMPVPAFNVINGGSHAGNNLAMQEFMLLPVGATSFAEALRMGSEVYHVLKGIIKAKYGQDACNVGDEGGFAPNVQDNREGLVLLMDAIEKAGYTGKIKIGMDVAASEFLMKDGSYDANFKNQPNNGAHVLSAQSLCDLYKEFVKDFPIVSIEDPFDQDDWSSWASLQSSVDIQIVGDDLLVTNPKRIVEAIDKKACNALLLKVNQIGTVTESIQAALDSKAAGWGVMVSHRSGETEDNFIADLAVGLASGQIKTGAPCRSERLAKYNQLVRIEEELGNVRYAGEAFRSP

SEQ ID NO: 106261 - protein, 199 aa, Triticum aestivum
  unsure (1)..(199): unsure at all Xaa locations
  Clone ID: PAT_TA_679.pep
MTAYKLFLAAAFAATALAAPVEERQSCSNGVWSQCGGQNWSGTPCCTSGNKCVKVNDFYSQCQPGSADPSPTSTIVSATTTKATTTGSGGXSVTSPPPVATNNPFSGVDLWANNYYRSEVSTLAIPKLSGAMATAAAKVADVPSFQGMDTYDHISFMEESLADIRKANKAGGNYAGQIVGYDLPDRDXAARCPHGEYSP

SEQ ID NO: 106262 - protein, 170 aa, Triticum aestivum
  Clone ID: PAT_TA_680.pep
RHEPSPPTSCPGPDPSPRAAARSPWLPRRRATFLDLPPPRAPPPGYHPAGPPAAGPHGPTRFPPRLRPPRNPPPIPACPLSSPIAAASTLCPYHSSRLSSCASPAGRHPCATSPSKTNPGSSSKFALDPASPLVRCHHDHSPRAISDLPKPKRRPVRGLSTKFMLESSPN

SEQ ID NO: 106263 - protein, 264 aa, Triticum aestivum
  unsure (1)..(264): unsure at all Xaa locations
  Clone ID: PAT_TA_681.pep
FVSVPPQSPPHGLATMTAAPLLSLTDAATATATAALAPGRAPARARIQAAPRHPATVSLRCHRARPLTAAAATGDSPSSAAFHGECFVVGDNIDTDQIIPXEHLTLVPSKPDEYRKLGSFAFVGLPAAAYPIPFVAPGEESSRYAVIIGGANFGCGSSREHAPVALGAAGARAVVAEGYARIFFRNSVAXTGEVYPLELADSGASKECKTGDVVTVDLDNSVLINHTSGEQYKLKPIGDAGPVIEAGGIFAYARKTGMIASKSA

SEQ ID NO: 106264 - protein, 372 aa, Triticum aestivum
  unsure (1)..(372): unsure at all Xaa locations
  Clone ID: PAT_TA_682.pep
MVNRDKAGCPTAAATLPLDRLLASLAANAEQLGKRWEIAVRDRRARAAERRMEADAAPPVQLHTPLFYATCALGGGLSTGXLTHLAVTPLDLVKCNMQVDPSKYRDISSGFGVLLQEQGLGGFFKGWMATLVGYSSQGACKFGFYEYFKKCYSDIAGPENADRLKTVIYLAASASAEVIADLALTPTEAVKVRIQTQPGFARCLTDGLPKLVRSEGAFGLYKGTLTLFGIQIAYTMMKFACFETIVEMVYKHAVPKPKDQCSKPLQLAVSFAGGYIAGVLCAAISHPADNLVSFLNNAKGATVADAITTIGLWGLFTRGLPLRIIMVGTLTGAQWATYDAFKVFVGLPTTGGVSSSCHAATTLHRVDHEKQN

SEQ ID NO: 106265 - protein, 145 aa, Triticum aestivum
  Clone ID: PAT_TA_683.pep
ASATTANSSELHILWQVPQYALIGVSEVMMYVGQLEFFNGEMPDGFKSFGSALCMMSMSLGNYFSDIIVSAVTKATAVDGRPGWIPADLNEGHLNKFYFLLAILSVADFAVYLVFAGRYRKSCKVDGRSDDEEEGSVDDEEACHA

SEQ ID NO: 106266 - protein, 278 aa, Triticum aestivum
  Clone ID: PAT_TA_684.pep
TWATTCSSCPTTGSRAWSTAWWPRARGRGCRWPASSGRTGRRGCSRRSSPTAATPGTGTRRWTKWSGTTGPRAPVPPPPEEIPPACRRVAPEYVGLVQRLGRTLFELLSEGMGLRRGYLEEEQECLDGLSFAGHYYPACPEPHLTLGAARHSDPSFLTVLLQDAVGGLQVLVDDDKNQPAWVDVPTAAGALVVNIGDYLQLMSNDRFKSVEHRVVAKSVGPRVSVACFFRADASTRVLEPIVTDAGGARYRSTTVAELVRHYRAKGLDGVPALQHVRI

SEQ ID NO: 106267 - protein, 228 aa, Triticum aestivum
  unsure (1)..(228): unsure at all Xaa locations
  Clone ID: PAT_TA_685.pep
MPFAVGSAVTKQDLAVAQAEAPQLAKVKWWADPGMRVLYFYAAILCVCSATTGYDGSMLNTSQAMDDWQDYFGHPKGSKLGILNSIYQIGSIASFPFAPYMADHFGRKLPIAVGCLIMILGAFLSAFTNGYGMYLGGRFLVGFGNSLAQLSCPVLLTEICHPQHRAIVSGIYNCLWNLXATLCAFIGLGTINISSNWSWRSITLIQAVPSLIQITFIWXIPESPRWLM

SEQ ID NO: 106268 - protein, 361 aa, Triticum aestivum
  unsure (1)..(361): unsure at all Xaa locations
  Clone ID: PAT_TA_686.pep
MPKFKKNLNPQVFLEISIDGRPAERITFELFADVVPKTAENFRALCTGEKGLGESTKKPLYFKGTHIHRIIPGFMAQAGDFSRGDGRGGESIISVENCLGLDFLPEGMVILDSPSMVDYCQIHTSGPSLFXLSMLLPQPVGKTLVVGKFLYDKALLKQLQPRGPASANPAGPVKIVDCGEASNIDTQNQLHGEKEKKLKRAVEDNNFDAGGRVKTKKTSSVDKRRKKRKNYSSDSYSSETSDSQSYSSDSGSESESYSSASLDTSSSSDHRHKRRKGSKKVKRKPAKRKSSHKKSKSKSRGTKRSKRSYGSSSDASKSSSSSSDNESAGRRTKHPLKKDQENTKIINLEMGKSLEYADKGK

SEQ ID NO: 106269 - protein, 417 aa, Triticum aestivum
  Clone ID: PAT_TA_687.pep
GTRRVTITKPALVREVLSNKSGDFEKLKLGRLQRMLHNGIGSHEGEKWAKHRRIINPAFHLEKLKRMLPAFAACCTDLVDRWEGLAAGDAPCEVDVWPDMQNLTGDVISRAAFGSSYLEGRRIFQLQGEQIELAASAMNKIHIPGYLFFPTKANRRMRQIAAEIERILKGIIAKRENALRAGEATSDDLLGLLLESNMAHTRAGGNSKAGITTDDVIGECKLFYFAGMETTSVLLTWTMIVLCMHPEWQDRARDEVVHVFGDRTPDYDGLSRLRIVTMVLYEVLRLYTPLTALQRKTYRPTELGGVRYPAGVVLMLPLLSVHHDKEVWGADAHEFRPERFSEGVSKASVDAPAFFPFGWGPRICVGQSFALLEAKMGLAMILQRFSFDLSPSYTHAPFTVGLLQPEHGAQVRLKRLH

SEQ ID NO: 106270 - protein, 364 aa, Triticum aestivum
  unsure (1)..(364): unsure at all Xaa locations
  Clone ID: PAT_TA_688.pep
MSRTLVQPVGQKRLTNVAVVRLRLGGHRVVDRLLPQLGGSRGAIRRDEDTAKEGHRXTFCDCVPWSEYALAQDFIAMFNSXHYMNASSQFSQKGWIKLQRREMYEQRCDGLDXLALSVARNTSSTGTRRPYTMNXIERIMHEILVAVVPYVTSKEQALKVMKNASHHLKVQYXRAPITRSFIAPKSNLAGLMEKLDGWNAIVLSKDESADQSSVVCEIEPSVLHSCEEKLKDVQGRVEVLSVSAHKEGGSSTDQYDNVEDNVEKAQPVPAKESGAVAQLSETMQKQSLSSEVESQGQAPGKPQKRCKECDIFMEDKLYRDHCKSGWHKHNYTRHKNGLPPLSQEECLMEMEMADSQRGLKDYDF

SEQ ID NO: 106271 - protein, 256 aa, Triticum aestivum
  Clone ID: PAT_TA_689.pep
PRGAPASSSRTCSRASRDSAAARLRLLRPASVCAGAVSGREPCPASRRPTPRRRVQAELGEEKPQVSSSSSSTPQEAAAEPPVPDRGLNRRIAVLTTLAAVGLFGSQRLQLGGFSLKDLAANAVPYEEALSNGKPTVVEFYADWCEVCRELAPDIYKIEQQYKDRINFVMLNVDNTKWEQELDEFGVEGIPHFAFLDKEGNEEGNVVGKLPRQYFLDNVVALSSGDPTIPHARAVGQYSSAEFRKVHQVADPRSHG

SEQ ID NO: 106272 - protein, 179 aa, Triticum aestivum
  Clone ID: PAT_TA_690.pep
MAGVLLSAAVACVLLAGAASASSSSPRVFTVGGVERGWRQPAPGEETYNHWATKNRFHVGDFLHFRYDKNDSVLVGDARRLQALRRGHAGDSASDGRRRRGSGSSGEACFPSAPARRPSATPAAPAPCAAWRRFTAPPPPRRSPPPCLPGGSFNSTPGSGHHAHAAARERRRGRRRRCL

SEQ ID NO: 106273 - protein, 127 aa, Triticum aestivum
  Clone ID: PAT_TA_691.pep
GAAGADACARSAVGRPAFFLRQEGCSLLLKPLFFAPCRGEAWAPPHLRDGRGHEAFVERTRWPPQHPHAADAEIPILSAPDNHFGGAMNGNNRLFMAGADRMVVFLSGFFYTIRLRPSPAPSPSASL

SEQ ID NO: 106274 - protein, 164 aa, Triticum aestivum
  unsure (1)..(164): unsure at all Xaa locations
  Clone ID: PAT_TA_692.pep
QGVPTKQAEAITSAITXVLNDSLESISESFVSKTEMQKSEMLQEANISKFKSQVQSSQENHFSLLQRETEKLRGDIDKMRSELKYEIDKVTAGQRLDLNLERGRIRDELAKQNEETTDLTTKLDKEIHSLKAQLEAAKYDVIKYCIGTIVSISAVGLAVLRIVM

SEQ ID NO: 106275 - protein, 215 aa, Triticum aestivum
  Clone ID: PAT_TA_693.pep
KRRRRGGGQKSVSEAGEPNQRKPQIPNPSCPLPPEMAAVWMALAVMLVAAAQVAVAAPVTAPAFLWAPKNYGLSPNEVKEVVHYQTISPKSLADSVLEEGGWSNLVCSKDGPQKNVDVAVLFLGSKLQSSDISKDKQVDPALADILKLSFSSSEFSMAFPYVAMSDDEALENSLLSGFTENCEDGSGGNHITYTDTCTASSESVKKPLNMDSVQD

SEQ ID NO: 106276 - protein, 125 aa, Triticum aestivum
  unsure (1)..(125): unsure at all Xaa locations
  Clone ID: PAT_TA_694.pep
MGNNQPTELIVFCSGGFKDSTXSEGQLLLDLVSVLDKSGAKYTVLYASQPYGLLENPSDLPLARYLAEKTNTTKPVLEKCDGECQLKSTLLEGVFVGVVLLIILISGLCCMMGIDTPSRFEAPQD

SEQ ID NO: 106277 - protein, 260 aa, Triticum aestivum
  Clone ID: PAT_TA_695.pep
QTISNEAKEVVHYQTISPKRLADSVLEEGGWSNMVCSKDGPQKNVDVAVLFLGSKLQSSDISKDKQVDPALADILKLSFSSSEFSMAFPYVAMSDDEALENSLLSGFTENCEDGSGGNHITYTDTCTASSESVKKHLNMDSVQDLVKSRMGNNQSRPTELIVFCSGGFKDNAKTEGQLLLDLVSVLDKSGANSTVLFARHLAEKTNTTKPVLEKCDGECQLKSTLLEGVFVGVVLLIILISGLCCMMGIDTPSRFEAPQD

SEQ ID NO: 106278 - protein, 288 aa, Triticum aestivum
  Clone ID: PAT_TA_696.pep
MFAHASADAWAPTRPMASAEGGDKYRSFLHGDGEKNTVWRHGAPPNYDLVNKLFEEERTKEWAEGSLEEKVQRLLKTWEMELVHKVRPEDQKSVHPKNYSATTNGLKPLTREEVMAMGGYNAFLGTTLPPEHRIYDPDAESVESATSTFLTGFPRGFAIEVLDVYSGPPNPRIAFKFRPWGYMEGPFKGPPPHGPRVEFFGVCVFPVYEGPKVEKGGFFFEGGNFLASFLSGPAFVAASASGCPVMKGDLSAKELGKRAPCFVSRISDLVKFLVRARNFLINKIFFPP

SEQ ID NO: 106279 - protein, 236 aa, Triticum aestivum
  Clone ID: PAT_TA_697.pep
MASGEGGDKYRSFLHGDGEKNTVWRHGAPPNYDLVNKLFEDERTKEWAEGSLEEKVQRLLKTWEMELVHKVRPEDQKSVNPKNYSAITNGLKPLTREEVMAMGGYNAFLATTLPPEHRIYDPDAESVESATSTFLTAFPRGFAIEVLDVYSGPPRIAFKFRHWGYMEGPFKGHPPHGRRVEFFGVCVFHVDEDTKVEKAEFFYERGNFLASFLSAPASAASAAAASASGCPVMRGD

SEQ ID NO: 106280 - protein, 234 aa, Triticum aestivum
  unsure (1)..(234): unsure at all Xaa locations
  Clone ID: PAT_TA_698.pep
MASAETGGDKYRSFMHGEGEKNTVWRHGAPPNYDVVNKLFEEERTKEWAEGSVEEKVQRLLKTWEMEMFHKVRPEDQKSVHSQGFTGSTNGMKPLTRKEWTAIGGYNAFLATKLPPEHRIYDPDTETFDSGMSTFLTAFPRGFAIEVLDVYSGPPRVAFKFRHWGYMEGPFKGXPPHGQRVEFFGMCIFHVDEEMKVEKAEYFYERGNYLASFLSAPEPETAASASGWPGEEGN

SEQ ID NO: 106281 - protein, 162 aa, Triticum aestivum
  Clone ID: PAT_TA_699.pep
MHPTQAEELFDVASRYLLFPLRRAVADLLLPNLEHVSPAELCHWLILSDIYGVMKIREYCLDIIAYNFEMFADIREFRALLLTLPPPSANDALRTTRPSQPGAAGHTDQGNILDDLREKWLEAEAAELDERDQSAALFDQRLEMLMLVAEREACDDDNAALH

SEQ ID NO: 106282 - protein, 197 aa, Triticum aestivum
  unsure (1)..(197): unsure at all Xaa locations
  Clone ID: PAT_TA_700.pep
ARPRPRWGLAEHYGVPIDKIDIITAGMGNALATDGGFCTGSARVVDHQRLSSAGYVFSASLPPYLAXSAAVSAVNYLEENPSVLANLRSNVALLHAGLSDAPGLEISSHALSPIVFLKLKKSTGSLATDLDLLETIAEQVLKEDSVFIVASKRSTLDRCKLPVGIRLFVSAGHTESDISKACSSLKRISASVLSDHV

SEQ ID NO: 106283 - protein, 150 aa, Triticum aestivum
  Clone ID: PAT_TA_701.pep
SDRSVARASNASLLSNGKGGSGLTDQVHHPSPSRGATGKNTALIRRLWRSAISESRKKTAGSAGATPTSEQRSTLITPTLPVGERCSSSYLVKPQQQRQRSHESKGLERGPHKHKQKQSLQEKLLEARMDDRKPSPSSAAKHKTQLAACN

SEQ ID NO: 106284 - protein, 196 aa, Triticum aestivum
  Clone ID: PAT_TA_702.pep
TAHASHRGGAKRGFADSLDGSAARAAGEEDKKKGEAAAAAGAGAPPAAKAQVVGWPPVRSYRKNTLAANATKTKAENEGRSEAGCCYVKVSMDGAPYLRKVDLKTYSSYDNLSLELEKMFSCFITGKSSSCKTSTRDRLTDGSRADALQDQEYVLTYEDKDADWMLVGDLPWDLFTTTCRKLRIMRGSDAAGMAPR

SEQ ID NO: 106285 - protein, 440 aa, Triticum aestivum
  unsure (1)..(440): unsure at all Xaa locations
  Clone ID: PAT_TA_703.pep
VLSADVFARYCRLRGHNVLYVCGTDEYGTATENKAIEEGCSPLEICDKYHAIHKEVYEWFNISFDHFGRTSTPQQTEICQSIFHKLLDNNWLSENTMQQLYCESCQRFLADRFVVGSCPMEGCGNDTARGDQCDRCGRLLNSTELIDPRCKVCEGIPVVRHTDHLFLELPLLEEKLEKYIDEASATGSWSQNAVRITDAWLKEGLRPRCITRDLKWGVPVPHEKYKDKVFYVWFDAPIGYISITACYTPEWEKWWKNPENVELYQFMGKDNVPFHTVMFPSALLGTGENWTLMKNISVTEYLNYESGKFSKTKGIGVFGNDAKATNIPADVWRYYLLSNRPEASDAVFTXXGLQIKHNNELLKNLGNFIYRVLSFIAKPEGAGYGSIIPEAPNADIHPLSQSLAETVGNLIQQYTDAMDKVKLKQGLKIAMAISSEGNAY

SEQ ID NO: 106286 - protein, 317 aa, Triticum aestivum
  unsure (1)..(317): unsure at all Xaa locations
  Clone ID: PAT_TA_704.pep
MSEGAAAAAAAEDGATRAGRAWAFRRDLAAGALMXGXVHTVVAPIERVKLLLQTQDGNAALLGRSRRFRGFADCVARTVRDEGVLSLWRGNGTAVIRYYPSVALNFSLKDLYRSILKDAGTSADNKFASIALTNFIAGAAAGCTTLVIIPPRPPTRPRLAADIGQTDARQFKGIRHFIQTIYKKNGIRGIYRGLPASLHGMVVHRGLYFGGFDTAKDTLVPLDSPLWQRWVAAQAVTSTAGLISYPLDTVRRRMMMQSGMEAQMYSGTLDCWRKIYRAEGVRSFYRGALSNMFRSTGAAAILVLYDEVKKFMNGGRL

SEQ ID NO: 106287 - protein, 257 aa, Triticum aestivum
  Clone ID: PAT_TA_705.pep
PRFRPRVRPRVRAGKSTCPKTGQVLTNLELVPNKALKNLISRWCRENGVAMEGSEPGKPEPAPPVAANKAAVEAARMTASFLVKKLSASFSPGSDNRVVHEIRLLAKSGSESRAFIGEAGAVPLLVPLLNSEDAALQLNSVTALLNLSILDANKKRIMHADGAVAALCEVMGSGATWRAKENAAATVLSLSAVHTYRRRLGRNPLVIEKVVLLVRTGPPSTKKDALAALLCLSAERENVGKLVGAGAAEAALSAISE

SEQ ID NO: 106288 - protein, 225 aa, Triticum aestivum
  Clone ID: PAT_TA_706.pep
CSIAAPPISIASPSQLPQPWWFSIAAGSFGGAPLQPRRSSIAAPVVKLQGSRRNSIATPWPSRRGRRRSTGEAPLQRHGRPVTVVIVAPAKLRCNAMAGPPWSSSQARSTGEAPLQRRSCKRHGRRGRRCSVGDAPTQHRRAHAILWRALQQRRRTRRSRSRRSATPSAAGPRANATGRRLLGYCMSLVFWGLQCRPWLLRRDQREDCERRRRRLETKGIDKVAP

SEQ ID NO: 106289 - protein, 279 aa, Triticum aestivum
  Clone ID: PAT_TA_707.pep
MEDDDDCPPLAVELPPQTTSPLVPASSSASASAPVGVTVITGYLGAGKSTLVNYILSGQHGKRIAVILNEFGEEIGVERAMINEGQGGAVVEEWVELANGCVCCTVKHSLVQALEQLVQTKERMDHILLETTGLADPAPLVSILWLDDQLESSIRLDSIITVIDAKNFRRQIDEHTNSSSFPEAFHQIAFADVVILNKIDLVKDDLEDLERQIHDVNALVTVVRSVRCQVDLNTIFDRQAYGVKNSSQLQELLEYSKSAPPNSRHDNSISTLCIYEQDP

SEQ ID NO: 106290 - protein, 311 aa, Triticum aestivum
  unsure (1)..(311): unsure at all Xaa locations
  Clone ID: PAT_TA_708.pep
CRRAARWPCLAFHHGAGRPTVTFDVSEKKPIAGYIDELENKEICPATHGFMLARCPASMSTFLWTPQSRGKIELPPLPIEQDLFIDCICLLSNKPTASNCVVLLVEPYATFIWYCHIGDDQWRKHDYDIGTQPALDLQSEDKEVITPIAACGGKFYFNSTQIELGVLDFCPAPVFSSIKINDVVDDIYGVELAPAQVFLVESDGELYMVSLLWAETIYGARVHRMDFLXKQRWRKVYDLGDRTFLLSLFNFGALCSVGKSGLRENCIYMAYPWEQTVHIFSVKDGSMETHKLDDAPSSDKAFWMLPANHID

SEQ ID NO: 106291 - protein, 310 aa, Triticum aestivum
  unsure (1)..(310): unsure at all Xaa locations
  Clone ID: PAT_TA_709.pep
MGPSHSQAKPKPDRHATRQPPADDQHPTRHGATRAGPPGPPHMDTFFLAHDSPSLSFDAAXRARHFFQPWPAAAGAGPEGPRSIXVRWVRAGAGGPRPRAGTRRVHAAHAQTSSRLPHVHVPPHVPLRPDGTYQLQVRSALAPLREDGTLRLDPGPGLHLIARVPHADIPPGHLSVQSHRSAPNDCDAACALDPRKEEAPLGDGSGRVPRSRRAIGPPRSPPPHSAPHLQSASDFNTWLKDSLLGGRYDDVNGYEEKAPNAKTAHPRPEHLYPLHVALGAAGDESKAELIHNSWTNASLSYASYRFTTKN

SEQ ID NO: 106292 - protein, 71 aa, Triticum aestivum
  Clone ID: PAT_TA_710.pep
QLNHYLFLFANQPFYFCNLSIFGYFCDDSELDLCILLYCGCHNATVMPKKKKKKKKKKKKKKKNKYKKKKI

SEQ ID NO: 106293 - protein, 217 aa, Triticum aestivum
  Clone ID: PAT_TA_711.pep
MRRQSLSQDRLPIDLHGRPDTVTMHLTEAICGLISQKVIMGKESETTSRLQTMLTDLGDKTAIVFCNTKKSADNRAKDLDKAGFRVTALHGGKSQDQREISLDGFRNRRFNVLVATDVAGRGIDIPDVAHVINYEMPSSVDTYTHRIGRTGRAGKKGLATSFLTLDNTDIFFDLKQMLTQSNSPVPPELARHEASKFKPGSVPDRPPRRNDTVYASH

SEQ ID NO: 106294 - protein, 111 aa, Triticum aestivum
  unsure (1)..(111): unsure at all Xaa locations
  Clone ID: PAT_TA_712.pep
LAGLDYIVXALQSDVFMYTYDGNMAKAVQGHRRFEDFRKTINPDRMDFVNLVDEFDEGRIPWEEFSSEVKRLHKDRTGAPYFREPGEFPKLEESFFANPLPGCICEKHSEQ

SEQ ID NO: 106295 - protein, 69 aa, Triticum aestivum
  Clone ID: PAT_TA_713.pep
VRENQVLKVGMDNMRMRLAELEKECSGMRQEIEKLGRGGGGKGGGGGGGWASHVPRRFSLKMKPQMCST

SEQ ID NO: 106296 - protein, 263 aa, Triticum aestivum
  unsure (1)..(263): unsure at all Xaa locations
  Clone ID: PAT_TA_714.pep
ARALAMMLLMAIALTTTMSAASTMDITDKDLASEESLWAMYERWCENHSVEREIGDKTRRFNVFKENARMIHEFNQQDVPYKLSLNLFGDMTDEEVERTYGRCSNIRSNGRKRRHQGRLTQGSIIAREDLPAAVDWRMMGYDQRPSAVTNVKRQGTCGGCWAFAAIAAVEGINSIRTRNLTSLSVQQLLDCDKGNEGCRGGNAEGAFEYIIHHGGIEIEAEYPYVGHEHGRCSVPKQSRNTVVTIDSYKQVPPNEVALMXAVA

SEQ ID NO: 106297 - protein, 174 aa, Triticum aestivum
  Clone ID: PAT_TA_715.pep
ADDVPRLSYLQCIINETLRLYPAAPLLLPHESSADCKVGGYDVPSGTMLIVNAYAIHRDPAVWEDPAAFRPERFEDGKADGLLLMPFGMGRRRCPGETLALQTVGVVLGTLVQCFDWDRVDGAEVDMTEGVGITMPKAVALEAVCRPRAAMGRCPSEALRIELVGILYVQYVYQ

SEQ ID NO: 106298 - protein, 140 aa, Triticum aestivum
  unsure (1)..(140): unsure at all Xaa locations
  Clone ID: PAT_TA_716.pep
RNIPAAPPKYKPFMPRGDTFWDTKAIGKSALTSPLPTLITITLLPPPSFCIYNKVAAIATTEFSKCCKKPQRKSSKNYPDAWADAWDSLSCSRNDESRNFATNAHNLXTSSKFVRNPREAVXTSIPNNGIFAIFLLMXAV

SEQ ID NO: 106299 - protein, 205 aa, Triticum aestivum
  Clone ID: PAT_TA_717.pep
MALGSIWARLRGNGQAGLARSTALRVFGFATWIPVIAMFNLHVAELTFVDGASMYPLINDEKDSTLQRDVILNWKWSPQENLERGMVVTLRSPLHPETIAVKRVVALENDVIKTKAPHPLPTVRVPQGHVWVEGDGPPGSSLDSNTYGPVSKQLITGRVTHVVFPFRKCGALPWREHKRPLVEVMVVEDVLYVSNLRRHKQQGVS

SEQ ID NO: 106300 - protein, 83 aa, Triticum aestivum
  Clone ID: PAT_TA_718.pep
SSPLAKLNVSYPRGNIHKIASLLLYSNNILYISVASKATYQLSLVCFILDHYQYKKMFQTSQLEKSPTNRIRTIYTGNIYELL

SEQ ID NO: 106301 - protein, 166 aa, Triticum aestivum
  Clone ID: PAT_TA_719.pep
QSTQESSPGRRKTRRRAMASVVETHDSAVPGGGDVVFCVIILFMSVLSLVILATSSAVGSGDGEEEGRQRQRSGSRGNGPVFVGGRGCACGGCRAGAGVLRHLPLVITADRARAPRALRMYMRGRTYRITKEEHRSELSPGLRKATQFFFFLCLCILLLIAAHHVM

SEQ ID NO: 106302 - protein, 146 aa, Triticum aestivum
  Clone ID: PAT_TA_720.pep
FMSDHQSVPQTQDGSTEQSFVDSDYSFNVFGADFGGFSLPLVTSHESVDQWLNVSSWSQDAASLGSMDQENGFGATASSAPQSHDSFSEAIFSSPMTGMDSHLSNIDSTPFVFSSSPVPFLDLPTAPGDAYKMASLTGSPNTAAAL

SEQ ID NO: 106303 - protein, 116 aa, Triticum aestivum
  unsure (1)..(116): unsure at all Xaa locations
  Clone ID: PAT_TA_721.pep
MFRRKHASHFNSDDAEQRQAKINELRAALGPMSARGEKYCSEACLARYLEARNWNVDKSRKMLEESLKWRALSRPEDIRWPDVSVEAETGXMYRATFTDREGRTVVIMRPAKQNTS

SEQ ID NO: 106304 - protein, 292 aa, Triticum aestivum
  unsure (1)..(292): unsure at all Xaa locations
  Clone ID: PAT_TA_722.pep
MFRKKQASHFDSDDAEQRQAKIKELKAALGPFSARGKKYCDEACLVRYLEARNWNVDKSRKMLEESIKWRAAKRPEDIRXPDVSVEAETGKMYRATFTDREGRTVVIMRPAKQNTSSHEGQLQYLIYTLENAVLXLPEGHDKMVWLIDFTGWTLAHATPFKTARDCMNVLQNHYPERLSIAFLFNPPKVFEASFKVLKVLVDPKSAQKLNFVYKENEESMKTMYSHIDPEVLPVEFGGKNNVVYNHEDYSKLMIKDDIKRASFWAADVSHVVNVDSVPEVKPQSSLIVAKAS

SEQ ID NO: 106305 - protein, 252 aa, Triticum aestivum
  unsure (1)..(252): unsure at all Xaa locations
  Clone ID: PAT_TA_723.pep
SGRSLVRYRQAQNNNVDKSREMLEESLXWRAASKPDDSRXTRVKCTGKNTQNXRETFTDREGCKAEYIISGKQVTSSYVDHVRYLIYTVENAXLSLPQGLDKMVWLIDFTGWTLANATPIKTARNHYPELLSASSMCNSPAFCATPFKVLRLXVWPVIGPLDPKSIQKVNFVYKDNEESMKTMYKHIDPEVLPVEFGGKNIVVYNHEDYSKLMTKDDTKTTSFWAADGSHAVNGGSVPQVIPQSSPIVAKAS

SEQ ID NO: 106306 - protein, 141 aa, Triticum aestivum
  Clone ID: PAT_TA_724.pep
RDQEAAGRESRRTKRVASATAFVLPYRSWLGGATWTWFFCSLYWRSFCSLRRRPEGWRIRVPVGLDVTKVILTGPDVFAAQDFVLAAVNQDCTSLKKYIKIVLYMFRALAPIRYKVYHSSLSKEDLLFPQRKKERRSCVAG

SEQ ID NO: 106307 - protein, 92 aa, Triticum aestivum
  Clone ID: PAT_TA_725.pep
CSVLILGTEGMGLNCAISSYFHVVYAFLPFYLSYINTLLTYFHSLIFLRYYIACCLKTLASSFNSPLHMSQIVEVFLLFCYVLSSPDLVTFL

SEQ ID NO: 106308 - protein, 230 aa, Triticum aestivum
  Clone ID: PAT_TA_726.pep
MKDIENDFVDLKEQGGFDGIGMLDVLEETNRLHDEYDTMTPKGSSCRRYQNWGSESSPTFPRVGYGRSLSLPARRSLVVSFEESLLSGRLSYGKDNQTIDGFLAVLNIVGGSFSPPTQKLPFAVASIDEDSSLLYYSSIDLAGRLSTSATNSNSPKLQRSLSNNNSRSAKSRLRIPAKGRIQLVVSNPEKTPLHTFFCNYDLTDMPSGTKTFMRQKVTLSPTVSPSNTVK

SEQ ID NO: 106309 - protein, 304 aa, Triticum aestivum
  Clone ID: PAT_TA_727.pep
RFVNVPFVIADAGVVGVAGAPPWYIAAHNMILAHASATRLYREQYRAVQMGVVGINVYSLWTYPLTNSTVDLAATKRYQDFLFGWTLGPLVFGDYPRVMKTNVGSRLPSFTKSQSEFVKGAIDFIGINHYYSVYVNDRPLKEGVRDYAADMSVYQRGSRTDPATSEYVPTAYPDDPQGLQCVLQYLTEAYGGLPIYVQENGKASANDILDDTDRVEYLKAYIGSTLDALRNGANVKGYFAWNFLDIFEFLAGYKIGFGMYRVDFDDEARPREARLSARWYSRFLKNNGISAQSEVDDTGHHAQQ

SEQ ID NO: 106310 - protein, 143 aa, Triticum aestivum
  Clone ID: PAT_TA_728.pep
ELGILSKSEPRIITTFKRVRKGTNGGVTIDGLLAAAAAGCSIGLAFVLIGFLTTQCASDVFWRQLLVIPLATAAGLCGSLIDSLLGATVQYSGYCSVRKKVVGVDGPTVRRISGMNILDNNGVNVVSIFLTSLLTALVCTCIF

SEQ ID NO: 106311 - protein, 254 aa, Triticum aestivum
  Clone ID: PAT_TA_729.pep
MLLSPPTPWPRVKPVRLNRLPQCKDRLLSLPRGRRPRAPRRLGVCMAEMAWVGSESPRELGVSDGEGDAMLGGDKLPGPRAEAAAIRWTPVEAALNRMSKWLVAVSFALAALWKRDAEIMWALMGAVANTVLSSILKKLLNHERPAPALRSDPGMPSSHAQSIFYAATFLVLSVFSWLGTNYLAMILGATTVALASYLSWLRVSQRLHTLNQILVGAAVGSAFSALWFALWHLLVREAFASSLWGPNSNPSLGQ

SEQ ID NO: 106312 - protein, 184 aa, Triticum aestivum
  unsure (1)..(184): unsure at all Xaa locations
  Clone ID: PAT_TA_730.pep
KREXSXXSVLVLLEKTXXGXLPXXSXAKMSGTLKEILFINNGLESCLPPELGRXRELTVLDVSHNQLAGPLTQEVAGLRKLEQLNVAHNLLSGPIPQAVCALPRLKNFTFSYNFFTGEPPACARVVPRGSDRDNCLPNRPSQRARQQCAAFYAHPPVNCAAFQCKPFVLXSPPPSPPPPLPSPP

SEQ ID NO: 106313 - protein, 251 aa, Triticum aestivum
  Clone ID: PAT_TA_731.pep
DGSCGSDIVLSPGGSTDVFDVSRTPITDFHYQERHQQGKFAKVPRSLLDFILISKAVAVNSSKTEQLLSHHTCHCSALNQNPVWWLMEGPRTITHDFSKSCCEANIQLVIHNSSDHNTSVRVVTSDCMPEKSQTAPSHESASGQGGWYDVSLENDVKAISSTKGAHSQKQSSESISPFVWCSLSSAQVDLKPDSSAKIPLKVCIFAPGTYDFSTYELHWKVHSSESGHVDENVTSGGGQGYPFYVNVLPSA

SEQ ID NO: 106314 - protein, 349 aa, Triticum aestivum
  Clone ID: PAT_TA_732.pep
MGSLPVPSVQALVEATGGDDVPPRYLRPDAAEEAVTGDGDGEAQIPIIDHRRLLLELDHGGEESARLHRACQDWGFFQLVNHSVPDDVVESMKANIQQFFQLPAETKKRFAQERGQLEGYGQLFVVSEDQKLDWADMLFLYAQPPERRKTKFWPDQPATFRSTLDRYSGALKDVSDSLLATMAKNLGLKRETIADKCIRGMQSFRMNYYPPCAQAEKVVGLSPHSDANLLTLVLQVNHVQGLQIKRNGSWLPVKPVPGAFIVNIGDMFEVFTNGRYRSIEHRAVVDPKEERLSVAAFHFPDMDAMIGPLKELTAHEDDAYKTLDLESFMKIFFATKLEGKSFLDRMKLN

SEQ ID NO: 106315 - protein, 164 aa, Triticum aestivum
  Clone ID: PAT_TA_733.pep
RVIWLGDLNYRISLSYEDTKKLLTENNWDALFQKDQLNTERNSGRVFRGWSEEKIYFAPTYKYTFNSDSYSGETATSKKKRRTPAWCDRILWHGDGIAQSSYFRGESKFSDHRPVCGSFTVEVYLLDGKSKRRTSNTNIRIGAEELLPTSKNKVTKGAGTKTTK

SEQ ID NO: 106316 - protein, 277 aa, Triticum aestivum
  Clone ID: PAT_TA_734.pep
HEAPSIHVDEFMARQRERQNPVPAPSGDAPQVKSQTSLDDNVRVKTEKPRQPKADLDDDQEIDIVFDEELESDDKLPFPQPDDNLQPPVIVGENSPGPVVEETENQQNEKSPFSRRDIPVSRTMRVLVLTYLLGQLCFQKLMFLWSEKVQFLAQPQRRVHSVIMLMNLHTFPLITSVRQKHLCNNCVLILIRREVHISCLRVLCHLDLMDTIIGFPETNHLCHQCHCQLLPCLHEVLSQVKGGHHLTMQGTALGMDHQLTHLIILYNLLRLVCLPLL

SEQ ID NO: 106317 - protein, 161 aa, Triticum aestivum
  Clone ID: PAT_TA_735.pep
LPTPPLSGIYASEGWFMKLLKESRRFVVADAAKAHLFYLPYSSQNLRLSLYVPDSHNLRPLSVYLRDFVKGLAAKYPFWNRTRGADHFLVACHDWGPYTTTAHRDLSRNSIKALCNADSSEGIFTPGKDVCVPETTIRTPKRALRDLGGLPICRRGMLGLF

SEQ ID NO: 106318 - protein, 209 aa, Triticum aestivum
  unsure (1)..(209): unsure at all Xaa locations
  Clone ID: PAT_TA_736.pep
RTRCLKHVSYLLFFFDRLFHTPVVLLYYQSNELITTQSYTVGLLGPTAASARTTSTLAILDSRRNALQPSLLMVAAANGESGALPGEDGTELDSPGREGKRRRPGDGDAAGHRRRDVFGRRARGREGGVFPELAEAVVRPRAGDRVVPELVEEPHATGSAYLCVSPSSFFLGWEWRARGGARGPEVSPWRRASGRQGTRERGQIWRGRX

SEQ ID NO: 106319 - protein, 185 aa, Triticum aestivum
  unsure (1)..(185): unsure at all Xaa locations
  Clone ID: PAT_TA_737.pep
MAQLLWLALGVLLLASSVADAATANYTFTVQSMKINQLCNSTDIIAVNGQLPGPTIDVFEGDEVVVDVINASPYNLTIHWHGILXKLTPWRTADMVXQCXIQPTVLHYRXNVTGHXGTLGGHATLFWAQRVRGLIIRPGTDRYPFRAGQKXPCIXGGDAKDAQCQPRLHKGYGYKKRGGQTKLWG

SEQ ID NO: 106320 - protein, 149 aa, Triticum aestivum
  Clone ID: PAT_TA_738.pep
GPEFPGRPTRPVSGSEDGNVRVWDTRSQQVTRKFKHSQGPVTNVLIVTPKRLNLPPLQPLRKVCAASGEVVPRAVILPNPENDVHIAGNLSSNLLEQLLDAQQHGSSRLFDSGVSTLNGVPNQQGAEWRSKYLELQDLFVHEVLGDMSS

SEQ ID NO: 106321 - protein, 341 aa, Triticum aestivum
  unsure (1)..(341): unsure at all Xaa locations
  Clone ID: PAT_TA_739.pep
ERQLKTSVGANKLGEGGFGSVFRGMLKDGTLIAVKVLSATSRQGVREFLTELTAISDIKHENLVTLVGCCAEGSHRILVYNYLEKNSLSQTLLGSGYSSIQFNWRARVKIAVGVARGLAFLHEEIRPHIIHRDIKASNILLDKDLTPKISDFGLAGLPPANATLVSTRAAGRCGHFVPENALRGQVTQKSDIYSYGVLLSEIFSGTCYAHXRNGAPPPLPLRQTWAFYEQERLEEIVDPDIDEDQEIEEACRFLKIGLLCTQDAMARRPHMPTVVRMLTGSKSISMEKITRPAMITDFAELKVSTKPHGANQARSNTSRSFSTTEISEPFSSSENHTQTSV

SEQ ID NO: 106322 - protein, 93 aa, Triticum aestivum
  Clone ID: PAT_TA_740.pep
STVQLIKIRCNPHASEGERRQVGGKFSYTPFSAGRHFCLGEDFAYTQIKVIWSHLLRNFELELISPFPKEEWDKFIPGPKGKVMVSYKRRRLT

SEQ ID NO: 106323 - protein, 171 aa, Triticum aestivum
  Clone ID: PAT_TA_741.pep
MDSNPPSPPPPQAGDGGGGEKQQLAFEAPPQPVREEYVQNAVKFLSHPKVRGSAVVYRRSFLQNKGLTADEIDEAFRRVPDPPPTTASPPTQTQTQAPAAAAPPQAYAQPAAGPIVVAAPQPRLTWYRAFVAAGLLLGFGASAAVFVKKLLLPRLKSWIRRVVAEGDEATE

SEQ ID NO: 106324 - protein, 171 aa, Triticum aestivum
  Clone ID: PAT_TA_742.pep
MPPPSHEITTRAAGTTTRPRPTHTRSAAADPPPIPQGSRRVAADPSMAALGSKLAQLQAKACEATRFVARKGCAYHKTLMEKNKQFVVQPPTVEKCQELSKQLFYTRIASLPGRCEAFWKEADQVKQLWRNRKDLNVEHAGIMALFGLELYGWFCVGEIAGRGFTFTGYSV

SEQ ID NO: 106325 - protein, 226 aa, Triticum aestivum
  Clone ID: PAT_TA_743.pep
MFFPLRRRRPRRRRCLRFGCCEARHLNKFIRGLCSDRQTEPLAFECYRRALQQPEFRPDKKTMNALTVQLLRSKQWSSLEHLVQDFMAYGVLPERRTCARLVATCVKARKFGLADVVLGVLEGKKGPAAAVCFSSALQAYNKLHMYRSTVLLYERMKAACLSVNADAYRAVMAAFGALGEPDTVTSLFKQYRSRKWYPSETCLETYTIACDALGRPGRALDALKCL

SEQ ID NO: 106326 - protein, 333 aa, Triticum aestivum
  Clone ID: PAT_TA_744.pep
MSKARVYADVNVVRPKEYWDYEALAVQWGEQDDYEVVRKVGRGKYSEVFEGINVNNNEKCVIKILKPVKKKKIKREIKILQNLCGGPNIVKLLDIVRDQHSKTPSLIFEYINNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRLTAREAMAHPYFLQVRAAENSRTRAQ

SEQ ID NO: 106327 - protein, 193 aa, Triticum aestivum
  unsure (1)..(193): unsure at all Xaa locations
  Clone ID: PAT_TA_745.pep
MGPQLLLVLLLVVSGGVAAAGADEAGLPRLEFQGVVDWGRGNASVAPEELAFMDVISADGACGRFARLVAETGNAGEVFRGRVAGGGGLTVLCPEDKAFAKFEPTFRSLGADDRLAVLLYHATAACYGREHFQAFDWVAVSTLAVDGATNKGIAITLRDDGDTVEMWPSPPSWESAXRVTKTASEEPPLAVYV

SEQ ID NO: 106328 - protein, 309 aa, Triticum aestivum
  Clone ID: PAT_TA_746.pep
MATGEITEGSSSSPELPKIFSFQSLEGITNNFSRIFCKDPFGPVYKGTLPDTDKEIAVKKLEQSAEIPPEDFENKVQSVYEIKHENIVELIGFCNQTLQITTERLLCYDFDPNESLQQHLFGPKATDGSNSADPSTDWDTCFKIVKGVCQGLLYLHKLEDPITHMDLNLNNIWLDRAMVPKIANLGLSRIFSKQRIKYYKEESTRYMAPEYLNSTGMSVSIDIYSLGVMMIQITTREENNDNLDKASRIYIKDIRKRWTAEHIASVYSSLDSECLHQVHTCIKTGLECMQIDQKNRPSIDVIVDRLNTI

SEQ ID NO: 106329 - protein, 152 aa, Triticum aestivum
  unsure (1)..(152): unsure at all Xaa locations
  Clone ID: PAT_TA_747.pep
HSNFLHAVDDXCLRTKSERAHLVDHPPKVNPNKRRKVESDPSSADAMETEKTRNQAERYPGEEGSSESQQGLPRGKRKGRKRTSHVMKSSGSKKRRKITNMDSSSENAAPPLSNSSSNPMVDESQEHDSSGGDRQPNVCRFIGYRLRQCCLQ

SEQ ID NO: 106330 - protein, 462 aa, Triticum aestivum
  Clone ID: PAT_TA_748.pep
RSELPPPLKVIGASLRDQPAMVWLSVWNRLSREDSISEPHWPKSLARWAASAACLSGPARECFLDLGCFPEDKKIPLEALINIWMEIHDLDKPDAFAILMELSNKNLLTLVNDAQNKAGDLYSNYHDYSVTQHDVLRDLALHMSGRDSLNKRRRVVMPRRDESLPRDWQWNKHPPFAAQIVSIHTGEMKESDWFQMSFPKAEVLILNFASSVYYLPSFIATMQNLKALVLINYGTTSAALDNLSAFTTLSDLRSLWLEKITLPPLPKSTIPLKNLRKISLVLCELNNSLRGSTMDLSMTFPRLSNLTIDHCVDLKELPPSVCEISSLESISLSNCHDLTELPYELGKLHCLSILRVYACPALWKLPPSVCSLKRLKYLDISQCINLTDLPEELGHLTNLEKIDMRECSRLRSLPRSSSSLKSLGHVVCDEETAMLWREAEQVIPDLRVQVAEECYNLDWLVD

SEQ ID NO: 106331 - protein, 188 aa, Triticum aestivum
  unsure (1)..(188): unsure at all Xaa locations
  Clone ID: PAT_TA_749.pep
STPSRHHVRTRGLCCRSLGLGVLVATMFMQAQIGLRNANRGGEDHASPWGWVRQLAARRQSFVVGRRCRRRHLHRPSRWERRDAPLIWSCRKEVVADTKWGHTTPSHNILYLGSLFGDGRINLIALSSMPNGSLVRRCAVPTMTTFLSTQGQQELMTLLMPPPCTXVDASAITNGGEHXTSIEGTVIL

SEQ ID NO: 106332 - protein, 226 aa, Triticum aestivum
  unsure (1)..(226): unsure at all Xaa locations
  Clone ID: PAT_TA_750.pep
MGMGCLHQRLGRTRALPFVRRFKPSEIEAATRGFSTALETGGPRGTAYRARFADGLVATVRRAGSGDPDQEGQEGAFYRELQLLGRLNHRHVVRLRGFSEGHNRFLVFDQMENRSLKECLHDPLRTPLNWRTRLQVAIDVAAALEYLYYFCDPPVFHVTVNSSNVMMDADFVAKLSNVSVVGHDSXEGSHAEERIQQMRXRSLVFQYGXVLLLELVTGQSXRGRRR

SEQ ID NO: 106333 - protein, 157 aa, Triticum aestivum
  Clone ID: PAT_TA_751.pep
PHASDESEKSAWAGVDKVVGCGFEPTKRKVYFTVDGQLVHAVSCNADAFSSPLYPVLASSFDVMALVNLGQSKFRYAPANARRTANPCFVRSASLGEGRSGSMGLDFDDSGDLFSMGRVDSGWTEASRVSKSRKESGGGTTAAGDLEAESDLFEISL

SEQ ID NO: 106334 - protein, 186 aa, Triticum aestivum
  Clone ID: PAT_TA_752.pep
VVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNAGSDGGDLDSQSSEKKPGYVIVIGATNRPDAVDQALRRPGRFDREISLGVPDEIGRKQILKMLTQNLT

SEQ ID NO: 106335 - protein, 131 aa, Triticum aestivum
  unsure (1)..(131): unsure at all Xaa locations
  Clone ID: PAT_TA_753.pep
CIARNFDPNACGWGCRMSEFDXYEWKNKDHTGISEEWQFSNEDRVLWKLGTLPPGLMTFYKLTHPLDKSWHVLGLGDNPSVHASEIDNAAVAHYNGNMKPWLELAMTKYRPYWTRYIKYDHPYIRGCNLSE

SEQ ID NO: 106336 - protein, 180 aa, Triticum aestivum
  unsure (1)..(180): unsure at all Xaa locations
  Clone ID: PAT_TA_754.pep
IYXRASPDTCHKRMMLRKRSEEGGVSLDYLQGLHEKHESWLFPSKGGGRGVLSVSQLPTQMEGNLPPGIRDRVFYLEGDHMHSSIQKVPALVLDCEPDIDFNRDIQAKRQYAQQVAEFFEFVNNKKEAPSEQASTEKDRMNPKIMFPNKGGLWVPEGVPPFAGSAMNLDFRRAMSSYLPT

SEQ ID NO: 106337 - protein, 273 aa, Triticum aestivum
  unsure (1)..(273): unsure at all Xaa locations
  Clone ID: PAT_TA_755.pep
MARAKAPRRKPPQAVSRRLLGFCGLSFAAALYVGIDYLRYLSPTWHDRLQPVLWAALALAAAARAPFYRHWDVELRAXLPFLGSIVFMLSAFLIEMISVRFVSVLMGLQWHGSAAPLPDTGQWLLLALNEKLPGSVVDLLRAHVITLHHYWMLFMMLGFPVLFDCIKAPGLGIXTRYMFTMAVGRLLRTATFVXXILPSAKPWCXAGRYQIPGHXSSWAQKYYVQXLLINAIVRHNDMAMLCQALMSSDDSNIEGNPERDGHLLKHVQDVGKA

SEQ ID NO: 106338 - protein, 223 aa, Triticum aestivum
  unsure (1)..(223): unsure at all Xaa locations
  Clone ID: PAT_TA_756.pep
AIGACRVHDMVLDIICLLSKEQNFITILDSNGNYSSSKGNARRLAIQTRGEEQYNHFGNTSMPKLRSCYANKCPRSMMPPLSCFEVLRVLDLKNCISIENCDLEHIGRLHQLRYLSLESTNISELPKDIGDLKFLQTLDLRKCKIKELPQSTSLLRKLKRLSVDETTKWTCVRITVPNWIGNLTSLEELSLKXXVVKFSTLVEETRKLTELRVLDCHLRGTSE

SEQ ID NO: 106339 - protein, 127 aa, Triticum aestivum
  Clone ID: PAT_TA_757.pep
MVAPGLQPDIITYSTISSGLCREDRIEEAIKAFCKVQDMGIRPNTVLYNAILLGLCKRRETHSAIDLFTYMISNGCMPNESTYTILIEGLAYEGLVKEAREMLAELCSRGVVSKTLVNKGAIRLLDA

SEQ ID NO: 106340 - protein, 64 aa, Triticum aestivum
  Clone ID: PAT_TA_758.pep
KNELVKYTWDDFLAITRNTITSKKQRKGGSRRHNKADLFIGDTEMVNGGGSSNSDDGDVDTSVS

SEQ ID NO: 106341 - protein, 378 aa, Triticum aestivum
  unsure (1)..(378): unsure at all Xaa locations
  Clone ID: PAT_TA_759.pep
KEEQSKMPPKKAAASKADVAKKQKVVEDKTFGLKNKNKSKNVQEVRPVAAPGRPAAARPEHDRRLXKKVEEKAREKEXLNDLFKVAVSQPKVPVGVDPKSILCEFFKAGQCQKGLKGKSSRDMNVRRKGEKMDLYCDTRDGEEEDTMDDWDQETLEKVIASKNAEYQQNKPTDIVCKHFLDAVEKKQYGWFWVCPNGGKECRFRHALPPGFVLKSQMKALLXEEESKKVAIEDEIEDQRRKVQTTTPMTTELFMEWKRRKAEEKEAGLAALRADRAKNDRMSGRELFMADASVFIDDAEAYEVYERREEPQANQEQGKKSQDEGPSSSTSNGKEADEELDDEDLDDDDDLDLDELNELEASLSRTSIQIQEPGEGTSS

SEQ ID NO: 106342 - protein, 137 aa, Triticum aestivum
  Clone ID: PAT_TA_760.pep
WSPRSDQKSKQNRLAATLNQSSKGSEYGTDINETDGVKPPGLRPRDRRKEHHDDRDRTLAWNTIGRRTAKGTDYEYRTCDLPVAERWKRREEKRTQSNPPLPPPKGSEGENYVMLNEVIATELLNGGLTRRGEGAEN

SEQ ID NO: 106343 - protein, 99 aa, Triticum aestivum
  Clone ID: PAT_TA_761.pep
MMPHITEIKMAMRMPMPPADIGESVTAGNGSSDLSRIFSMSYWKDTNSSIMFFTPGRKKAKLFGDSDDGMVTSFSNIDSQERTSINKRVRRLHNLMTNM

SEQ ID NO: 106344 - protein, 246 aa, Triticum aestivum
  unsure (1)..(246): unsure at all Xaa locations
  Clone ID: PAT_TA_762.pep
MASSVEGGGDAGEGEWLKVAELKAMAEAQDPHVKEVDNMTLRRFLRARDHDVGKASAMLLKFVAWRREAVPGGVGGVMPADLVRXELSQDKARMGGVDRAGRPVLLVFPARHLSADRDMAEHKRLVVYLLDRISARIPRGQDKFMCIVDLKGWGYANSDVRAYIAAIEIMQGYYPERLGKALMVHVPYIFMKAWKMVYPFIDTNTRDKFVFVDDKNLEETLRREMDESQVPEMYGGKLPTVPLTDD

SEQ ID NO: 106345 - protein, 88 aa, Triticum aestivum
  Clone ID: PAT_TA_763.pep
PDHRKWHRHTWRRCRLSRFMCGNHKVSNPPVTITERPQRRKRGSWARTPASRKKSGSRASITHWSNQSPWCLLHYSQDRWALSGVSST

SEQ ID NO: 106346 - protein, 148 aa, Triticum aestivum
  Clone ID: PAT_TA_764.pep
MPAIACGACAAAFLSSAHARSPPPPSGSFRKLVSPTPRRLGHRLAAPMASTVDSPGSSSDFAKRMDRAWLISKQPSPTSCSSCQSTGDVECRWCAGTGFFILGNNMLCEVPSKNTRCVICSGKGFSRCADCKGTGFRAKWLEEPPVDK

SEQ ID NO: 106347 - protein, 188 aa, Triticum aestivum
  unsure (1)..(188): unsure at all Xaa locations
  Clone ID: PAT_TA_765.pep
MTLRMMEQRFRRWKAEHNRTYSTPEEERHRLRVYAHNVRYIEATNEDAGAGLTYELGETAYTDLTSDEFMAMYTSRAPPLSDDDDAPMMMITTRAGPSAGAPASVDWRERGAVTAVKNQGQCGSCWAFSTVAVVEGIYQIQXGKLASLSEQELVDCDKLDHGCNGGVSYRALQWITSNGGITSQEDYP

SEQ ID NO: 106348 - protein, 152 aa, Triticum aestivum
  unsure (1)..(152): unsure at all Xaa locations
  Clone ID: PAT_TA_766.pep
MKSWSRTFELEGEVVEPDNDPLQKMGDPSVEVSEEMRDKAQLYKKKXVDALSEGKLDEAVEHLTEAILLNPTSAILYAARAGVFVKMKKPNAAILDAEAALQINPDSAKGYKSRGMAKAMLGKWEDAAHDLHLAAKLDFDEEISSELKKVRY

SEQ ID NO: 106349 - protein, 224 aa, Triticum aestivum
  Clone ID: PAT_TA_767.pep
EGRDRENIPGSPDKNGRRRLVRLGRVYSRWFYQARARRPSGLQRATPALSTSEDLLRAAAQEGMAKAGENSFEDEIMESDIELEGEVVEPDNDPLQKMGDPSVEVSEEMRDKAQLYKKKGVDALSEGKLDEAVEHLTEAILLNPTSAILYAARAGVFVKMKKPNAAILDAEAALQINPDSAKGYKSRGMAKAMLGKWEDAAHDLHLAAKLDFDEEISSELKKVM

SEQ ID NO: 106350 - protein, 277 aa, Triticum aestivum
  unsure (1)..(277): unsure at all Xaa locations
  Clone ID: PAT_TA_768.pep
MRDGAQVLSKDERDIRVQHLTWTVLLNPPSPILSAPGAGFSEQMKKPKVAILDEKATLHIITDSAKGYKSRGMAKAMKMLLMDFAQELHWILKEDSDDLFRTAKLKFEEEISTELEKIEPNERKIXKKADXERQRREAGDMKKADLERQRRHAEEVSAASAVLKPGDVITIHSSNQLEEIFTAASKLSKLVILYFTATWCGPCRFMGPVYKSLSEQHRNVVFLKLDIDQQGNIAHRWNVSSVPTFSCVINGKEIDKVVGADKTGLERKIAEHGSRKH

SEQ ID NO: 106351 - protein, 234 aa, Triticum aestivum
  unsure (1)..(234): unsure at all Xaa locations
  Clone ID: PAT_TA_769.pep
MGTLLRRVLLSLALLAAAATPGAAAAAARLSTSYYSRSCPRVEQIVSDVVAAKQQANPSTAAGTLRLFFHDCFVSGCDASVLVSPLSSDRTPERAAEINLSLPGDAFDAVARAKAALXEAACPGTVSCADILGLAARDLVXILGGRGPRLLGRRDARRSTRAVGRATPRAPTCRRAHTAVPRTRARASRRWRAPTWVSSVQSRTGFLPLLPSSRTRGVQLQGQGRGAPAGTTRR

SEQ ID NO: 106352 - protein, 217 aa, Triticum aestivum
  unsure (1)..(217): unsure at all Xaa locations
  Clone ID: PAT_TA_770.pep
DAVGLKRHSARDPDEIEEEQRDRARRKKINGQFELFVKRVVSVWSQPRFQQLGLHFERPSQKLGFNGVHGRTTCFIVPTPSCLVQLVESPFLVTSLREVEIVCLERVALGQKSFDMVFVFQDLKRDVVRIEVIPMASLDKIKDWLNDSNLKYYESKLNLNWRMVLKKLDEQVVTQMTXGFLNPNATDPNSGDSETDDDKYEPSEASQPLIPMIKKRR

SEQ ID NO: 106353 - protein, 121 aa, Triticum aestivum
  unsure (1)..(121): unsure at all Xaa locations
  Clone ID: PAT_TA_771.pep
GSWLGKIVRETAVSGSVPITFPMLTRSNYSSGXLIIGVQPPCGEPLGSIXGRLWSRERRTXKAGGGTHARHAAGRCTACSRAKASAREALGSPSVHSASAATVCAKRTHRSCERTFETSPS

SEQ ID NO: 106354 - protein, 68 aa, Triticum aestivum
  unsure (1)..(68): unsure at all Xaa locations
  Clone ID: PAT_TA_772.pep
IKMMQVLSANLTMLNMTRNNTAYVANLATLPPHWHANSPSSQFTSQTSGWDAPXARLLRRSGEHLSCL

SEQ ID NO: 106355 - protein, 134 aa, Triticum aestivum
  unsure (1)..(134): unsure at all Xaa locations
  Clone ID: PAT_TA_773.pep
EGKVVEKLVXLLGYNNEKVVEASLTALSTLLDDGLDIDQGVMVLCDAEGVKPILDVLCENRTEALRQRAVWAVERILRTDEIAYEISGRAAARAGLVEAFRHGDFRTRQIAERALKHVDKLPNFSGIFSKIGAQ

SEQ ID NO: 106356 - protein, 151 aa, Triticum aestivum
  unsure (1)..(151): unsure at all Xaa locations
  Clone ID: PAT_TA_774.pep
PRVRLAKETAMMTILIALFVLGFVAGAQQTDAAYDVTWSPRGPSSTIPPLHPSDGVFPTQWCNPRPQHLKADKGILFLRRNLFDGAVLPAGTKLGHARRAGTASTVTGTNLAPPPFDYGSLRNILTYYNIAPGSEQARQVXXTLRFCGRNE

SEQ ID NO: 106357 - protein, 107 aa, Triticum aestivum
  unsure (1)..(107): unsure at all Xaa locations
  Clone ID: PAT_TA_775.pep
TWLFLMIFMTVYFFXVVRRKWSPHFLRYHIILAILLDTGSQALATMCNWNPSIVFQGKPMAYFWMTLAFIQIFTVVECMRCALSGMYPNVPFISHTAFIHSDLNLFR

SEQ ID NO: 106358 - protein, 126 aa, Triticum aestivum
  Clone ID: PAT_TA_776.pep
MARDFSFLKNRVTILEPFHLNSVNLFRITMWYFCIISPRLPPSPPSTARPALSSPCQPRHCPHGPPQPPRPPNLRPPRAGRRSTRGAAGGPHRHRARPPLRPRRLPHPPPHRRPGGGAGPALRRGR

SEQ ID NO: 106359 - protein, 128 aa, Triticum aestivum
  unsure (1)..(128): unsure at all Xaa locations
  Clone ID: PAT_TA_777.pep
MGNALAGRRRAAKVMTVDGATFRYKTPAAAGAALRGYPGHQRLESRAVRLDRVRARPLGKLYALKPGKLGGAVHLRRRGRRRGGPXGPHKTWSGALHVGARERLESLMLSRRTVSDVASLMPSAGREA

SEQ ID NO: 106360 - protein, 197 aa, Triticum aestivum
  unsure (1)..(197): unsure at all Xaa locations
  Clone ID: PAT_TA_778.pep
STYLNDPAYTELAPSFDSQVREKTATLSASTPFEYCYQLARGQTXLFVPEVSLTRLARGAIPVTPPFVLTAGEITGGQMVAVGECPAVRKHDITSDIIGENFMTGLKXVFDRERSVLGWHEFDCYKDVEVAGPCGSPGAAPGPSPTPRIKPRQSATTPYPKPVPVTPRQSCSRGSRLSFSIALLFFMLAFVRARGLT

SEQ ID NO: 106361 - protein, 68 aa, Triticum aestivum
  unsure (1)..(68): unsure at all Xaa locations
  Clone ID: PAT_TA_779.pep
VEVEKYLTVAFRPFHGRHFLLVLYLKLYESLXXXXXXXXXXXXXXXXXXXXXXXXXXXXXXXXXXXXX

SEQ ID NO: 106362 - protein, 150 aa, Triticum aestivum
  Clone ID: PAT_TA_780.pep
CTNTRGGSHGRSAASTRKGAPAVLFLVGGAAGEAGAKHSAIGEAKGGGLPCACAETVLVGGHCRRGAGCGELRVAASVAALVTGGLRRLPPGFFPTARVAQPLVVKTKRAREHHRARRPRPRTRRTARMQAVLYRGHGYSRGKRGCERCG

SEQ ID NO: 106363 - protein, 232 aa, Triticum aestivum
  unsure (1)..(232): unsure at all Xaa locations
  Clone ID: PAT_TA_781.pep
HASASFSPDNALPVRVLVLRARLALGQAEDVLDEVKGESEPEFQALGALAELNLGKTDSAVQTIEKLVSSAADNTTVQVIGGTVLQAAGKSEEALALLTQHQGSLDAVSLIVQIHLQQNRTDLALKEVSAARRWAQDSLLVNLAESWVGLRVGGXKYQQAFYVYEELAQAPSTSSVRSLVSQAVCELHLGRTEEAQAALDQALEKDANNADAIANLLVLNVISGNKSDEFTQ

SEQ ID NO: 106364 - protein, 89 aa, Triticum aestivum
  unsure (1)..(89): unsure at all Xaa locations
  Clone ID: PAT_TA_782.pep
LPGHVAFTMFVAITFPFGGLLXFGGFAFAPTTYFLPCIMWLAIYKPKRFSLSWFTNWVCIVLGVCLMILSPIGGLRQIILDSKTYKFYS

SEQ ID NO: 106365 - protein, 156 aa, Triticum aestivum
  unsure (1)..(156): unsure at all Xaa locations
  Clone ID: PAT_TA_783.pep
MRGLHGEKAIDDWLPITSSRKAKWWYSAFHNVTAMVGAGVLSLPYAMSELGWGPGIAVMTLSRIITAYTLGQMVEMHEIVPEKGFDRYHELGEHAFGDKCGLWIVAPQQLVVEISLNIVYMNTEDDSLEKLLQEICDVKCKEIXVTYLIMIFARYT

SEQ ID NO: 106366 - protein, 310 aa, Triticum aestivum
  unsure (1)..(310): unsure at all Xaa locations
  Clone ID: PAT_TA_784.pep
MATNDVYCYHRINKGKSKNIQPSYHVMISACAHLILIFGENLVSSLRMVFVSXLYMEVVFNVCWGXSINSFNAQNVNDDLRASTTPGQVFGFLGGLGDVAFSYSGHNVVLEIQATIPSTPGNPSKKPMWKGVVVAYIIIAACYMPVAFIGYWAFGNSVDDNILITLNKPKWLIAMANMMVVVHLIGSYQIYAMPVFDMMETFLVRKLEFAPGITLRLITRTIYVAFTMFVGMTFPFFGGLIGFFGGLAFAPTTYFLPCIMWLIICKPRRFSLSWFTNWICIVLGVILMIIAPIGGLRQIIISAKTYKFYS

SEQ ID NO: 106367 - protein, 72 aa, Triticum aestivum
  Clone ID: PAT_TA_785.pep
RKQVIPTRARILQWVIQLDRHHNSWVPGNTYSTLQHIYTYTHVLSFMRNKRYVSIYVYVCRCQRKCLYLRVD

SEQ ID NO: 106368 - protein, 78 aa, Triticum aestivum
  Clone ID: PAT_TA_786.pep
LIICIYIGHKATSSCATQLRSQGAPKPFSTLAPYGTTSHSAELLRSRFLHRLRRTESHGVRDCEEYMTASTHAFADAW

SEQ ID NO: 106369 - protein, 332 aa, Triticum aestivum
  Clone ID: PAT_TA_787.pep
SSVHKIYFTGPFVAKGFKIGVVCGIVGLTEAVAIGRTFAAMKDYQLDGNKEMVALGTMNIVGSMTSCYVTTGSFSRSAVNFMAGCKTPVSNVVMSVVVLLTLLVITPLFKYTPNAILGSIIISAVIGLVDYEAAILIWKVDKLDFIACMGAFFGVVFVSVEIGLLIAVAISFAKILLQVTRPRTALLGNLPGTTIYRNISQYPEAKLTPGVVIVRVDSAIYFSNSNYVRERILRWLTDEEDRAKALGLPKISSLIVEMSPVIDIDTSGIHALEDLYKNLQKRDMQLILSNPGSVVIEKLQASKLTEHIGSSHIFLAVSDAVRFCTSKAMQEP

SEQ ID NO: 106370 - protein, 259 aa, Triticum aestivum
  unsure (1)..(259): unsure at all Xaa locations
  Clone ID: PAT_TA_788.pep
RLIPVRSSDAGNMRFRIRKKPASAPPDASSTAAVPDTAAGGGGRATIVASPDRYGTENGARSDESVFDSRPALHSDSEDDVQSMSGDVTTSSRSTPDHQMQTSFASRVAAHFPSSAGEDHSQLVRLHFTPSSDGAHDDQTQIACAARISVHAPEQLNSSWKVEKAKQPAKPGCFACSASTGTGNAPGNNTQGPKVRRGWSQLSHFACLPCLSPAGRGLVYPFFAPVSLAAPCRSLRSVEGLFNSGMNXKQLCRVKYXAY

SEQ ID NO: 106371 - protein, 70 aa, Triticum aestivum
  Clone ID: PAT_TA_789.pep
QQSMQIDTVVHVIFISKKKNRIIFQTSSFLISRRTTQIIMHTSNIEHTTRVHTQKDVSVHYYDSDAWADA

SEQ ID NO: 106372 - protein, 93 aa, Triticum aestivum
  Clone ID: PAT_TA_790.pep
NLTHIICLLGTHIFLYGNTTSMKENVTSSVLKVVVLLALSIVDLSSTIHTCIPQGHNPIPNHSPSCNKSHNHCYYTSPFRSEGSRLHVPRWFP

SEQ ID NO: 106373 - protein, 350 aa, Triticum aestivum
  unsure (1)..(350): unsure at all Xaa locations
  Clone ID: PAT_TA_791.pep
RGRVDLERPLKLAKEAIGIVYVSPYEVATCPLCCEERRGSHMIKVGCSHKFCYSCLIVYVEGRLHASKLPIRCPQLRCKYHISAGECKSFLPVSSYESLERAFAVGGCTFDMEGLYRPYPNCSVSLDLSQHFSRASSSSEPASDCIECPECHRDICINCGVPWHIMMGCDEYQSLPVEEGGAGDLSLHRLAQNNSWRRCQRCRRMIELTQGCFHMTCWCGHEFCYSCGAEYNNGVQACQCVFWDEDNAEPSAAQSCQASEIWAWDTFDCMPTAADGYSEQERAQLALIQRFLAGGFSLSGDHHHLSQQSSPPRCAXDSYIVDTMKDLHQLPWLERFVSVMSDTYNDDYIQ

SEQ ID NO: 106374 - protein, 204 aa, Triticum aestivum
  Clone ID: PAT_TA_792.pep
MACLHDHECGDHNCAADWSLYNHIDIPKVVALNESVAGSVKSVFKSWDQRLETSGGFLESNEGDPELLVFIPFTSDVKIKSIAVVGGADGTSPSRMRAFINREGIDFSDAQNMQPVQEWELAENLQGVLEYQTRYSRFQGVANLTLHFPDNFGGDTTKIYYIGLRGEATQNKRDVVATIVYEVMPNPSDHKTKSETGGGFSHVE

SEQ ID NO: 106375 - protein, 216 aa, Triticum aestivum
  unsure (1)..(216): unsure at all Xaa locations
  Clone ID: PAT_TA_793.pep
HQKFKMKIQDRTFIISGGASGLGQACVEDICANGGNVAILDMNEESGQELVKKLSTYTKFFECNVLETESVAKAVQDAAKWAKETGKPLGGVIAAAGVSTPATILDRNGTAFDLENFDFVLNVNLRGTIDLVRQTLEHLAKVEPQGPDGERSVVIMVASSAAFDGQKGQVSYSASKGAVTAMTLPMARDLARFGXRVVTIAPSLFESRRRAVMSKG

SEQ ID NO: 106376 - protein, 54 aa, Triticum aestivum
  Clone ID: PAT_TA_794.pep
RPSNLLSGFSPESSRFVIVILDPIYLLSSLSPESSRFVIVILHTIFIGALLIIH

SEQ ID NO: 106377 - protein, 237 aa, Triticum aestivum
  unsure (1)..(237): unsure at all Xaa locations
  Clone ID: PAT_TA_795.pep
TARRAWELTVGPHASDGLAFGIKRHMKRQGNLQHEYSGSDCLQLKGHDAHTEVAYLLEHLKLCMFYSKNRFSEFLKFGGYSQEDVLIHKSRARLMQPSFVLVRDQKAKCFLLFIRGAISPRERLTAASSVEVPFHHIVLNEGQIENVILGYAHCGMLAAARWISNLVMPPLRNAVREFPDYQIKVIGHSMGAGIGAILTYILREHYDFTSCTCLAFGPAACMXWELAESGKDXITSS

SEQ ID NO: 106378 - protein, 87 aa, Triticum aestivum
  Clone ID: PAT_TA_796.pep
VLYLAPLTYLFVSFFIASYVKRSNAASKKSHDVNANIALAEKAGWDAAKGIEKEIYDGANTANGSSADEASRASTPKKANGKSRRKA

SEQ ID NO: 106379 - protein, 58 aa, Triticum aestivum
  Clone ID: PAT_TA_797.pep
IKRIKGFGSGILGPLDHATGKRVVARARRHRRGNHRRCRILEHRSRSSVHIGLTSGFA

SEQ ID NO: 106380 - protein, 284 aa, Triticum aestivum
  Clone ID: PAT_TA_798.pep
MMQQQQQQQPLPPPPPQHPPPQPGGGGGDFYRGPLQPPMRQLSAASSPHLAPASSTNLPPDYAAHPGPPPQQQHQPPYDAYGDSFGAKRMRKPVQRRTVDYTSTIVRHVQARMWQRDARDRFTLQPTPAAVLDMLPSVAYPDNPSTSFAAKFVHSSINKNRCSINRVLWTTTGRRLITGSQSGEFTLWNGQSFNFEMILQAHDLPVRSMVWSHNENWMVTGDDGGAIKYWQSNMNNVKVNKTAHGESVRGLSFSRTDLKFCSCSDDRTVKVWDFARCQEEKSLT

SEQ ID NO: 106381 - protein, 385 aa, Triticum aestivum
  unsure (1)..(385): unsure at all Xaa locations
  Clone ID: PAT_TA_799.pep
PASAKAPARPHTPHLPPRASAPARWPLLRLRLGAPPAPPGGAQRTGWGWPQPRRGVAAPAAWGPNTSPWAAHQLRVACPSSARARPLLMGGLERLPQGLQSLPPVSGISSPQDSXTLQATAMHFRSDWQVIPEETRGAAFQGCPRTLFDVSTNPTEAQVFLEAVEHGLDGVVLNVEVMDDVIRLKDYFDRRNEAKSQLQLTKXATVSKVEVVGVGDRVCVDLCSIMRPGEGLLVGSYARGMFLVHSECLETNYIASRPFRVNAGPVHAYVTVPGDKTSYLSELQSGREVIVVDQNGLWRTSIVRRVKIESRPLILVEAKENSGNGTYSIFLQNAETVALIGPDRGSGGRTAIPVTSLKVGDEVLVRKQGGARHTGIEIQEFIVEK

SEQ ID NO: 106382 - protein, 121 aa, Triticum aestivum
  Clone ID: PAT_TA_800.pep
MTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQDEIL

SEQ ID NO: 106383 - protein, 129 aa, Triticum aestivum
  Clone ID: PAT_TA_801.pep
MKKPNFSRKTGSHQIASPFESPLTDPFASCFPSHSPQAPTPSSSRSDFTAGELAMSIRPLLLPEPPGEVDRAPEIFAGGVAAVRRAVVIGNGCAGAENQCLGLVRALGLADRLTLYVSRAPPLSFPLVL

SEQ ID NO: 106384 - protein, 413 aa, Triticum aestivum
  Clone ID: PAT_TA_802.pep
MLPPPRRGPAYKTKMCALWQNGNCDRELCSFAHGTAELRRPPSSRPTFPPHHAGRRDYRGGDFRGRIERRFSPRRRHSPGRDFRGHRSLHDRRPTSRERESSFSRSPSRKSERRHEKKMDDGETNSSKDGDEKEDYEKELKQVRSDMEALRDDKSHLEIVLDEKMDEVRRISSQVSDLDQQLRREKEECHRMTSKMKKFLKAHVRFMKAREELKRSQARFERLGDMLASEILKRGANEEASSVHVDEDLNGPYERSPNATPAKKRSIPYSTSDEAKAAKKRRERETDTFTRSDKYRSEGDITDYDKTIKGSDGTKSIYLKKRLWEDEKNKLGNAASSADQVKDSPVKHALPSTGMAARALYDLNEAVELDDRNEQIDALLENDADGTRSPVPPVGQNAFEQYEDLDEEVDVDV

SEQ ID NO: 106385 - protein, 195 aa, Triticum aestivum
  Clone ID: PAT_TA_803.pep
LSLDHESGVRMVALFDHEEVGSDSAQGAGSPAMLDALTRITCCFNHSNSKLLEKAIQRSFLVSADMAHALHPNYMEKHEENHQPKLHGGLVIKHNANQRYATNAVTAFIFREIAERHQLPIQDFVVRNDMACGSTIGPILSSGVGIRTVDIGAPQLSMHSIREMCAVDDVNYSYEHLKAYFEEFTELDNKVKVDC

SEQ ID NO: 106386 - protein, 82 aa, Triticum aestivum
  Clone ID: PAT_TA_804.pep
FFFFTAKKHSMINSSNLHPTFNNQRIIIRFCLTQEPRITSLRQTYNGYWCVTKITGTTRPTTTPELLFSFPSFIHKQDGMAR

SEQ ID NO: 106387 - protein, 83 aa, Triticum aestivum
  Clone ID: PAT_TA_805.pep
TNSWEAWSTTIWFTFTEISRQTQQSIEVDYHSKRDGRLEINGPAWSNFVSQHEIYVDVWVVILVIPGNNRPEVTLRFKAITIV

SEQ ID NO: 106388 - protein, 187 aa, Triticum aestivum
  Clone ID: PAT_TA_806.pep
MAMASIVVQVSALLLNLIAFGLAVAAEQRRSKATVTPDLAKEYDYCVYDSDVATGYGVGALLLLTAAQVVVMLASRCFCCGRGLKPGGSRACALMLFLFSWLTFLVAAACLLAGSVRNAYHTRYRGIFNGDPLSCETLRKGVFAAGAAFTFFTAILSEFYYISYSKSRDAAGGAPYGGSSIGMGPYN

SEQ ID NO: 106389 - protein, 213 aa, Triticum aestivum
  Clone ID: PAT_TA_807.pep
MAMASIVVQVSALLLNLIAFGLAVAAEQRRSKATVTPDLAKEYDYCFYDSDVATGYGVGALLLLVAAQAVVMLASRCFCCGRGLKPGGSRACALMLFLFSSRCFCCGRGLNPGGSRACALMLFLFSWLTFLVAAACLLAGSVRNAYHTRYRGIFNGDPLSCETLRKGVFAAGAAFTFFTAILSEFYYISYSKSRDAAGGAPYGGSSIGMGPYN

SEQ ID NO: 106390 - protein, 197 aa, Triticum aestivum
  Clone ID: PAT_TA_808.pep
PDVPSHLSLVANFLPNISNRNTQNAFSKMPAPPPFIVNTDPKRVAESQTTLIVGVITAINFVALAVVAARTYTRLVISKSPGAQDVLMILSACTGLAGTIILYLQIPHGLGKHADTIERADFTKFSRYSFILTVVPLLGGIGLLKIAIALELIKYNGNSWKVVQDYFTVHDCFWWLRIQLRRAFRSFFSVIQSQANG

SEQ ID NO: 106391 - protein, 141 aa, Triticum aestivum
  Clone ID: PAT_TA_809.pep
MVRGKLEVLLVSAKGLDDSDFFNSMDPYVILTCRSHEQKSTVASGAGSEPEWNETFFFAVSGDAPELRVKIMDSDALSADDLVGEACIPLEAVLQEGSLPPAVHRVVKDEEYRGEIKIALTFTPAEENEEEESYGGWNQST

SEQ ID NO: 106392 - protein, 200 aa, Triticum aestivum
  unsure (1)..(200): unsure at all Xaa locations
  Clone ID: PAT_TA_810.pep
VHWHGVKQRLTCWADGAGMITQCPIQPNTTFTYRFDVTGQEGTLWWHSHVSALRATLHGIIVIRPRSGTYPFPKPDVEVPVIIGEWWQRDLVKVDKNFSIGGSFDDNPAAATINGKLGDVHNCTGVAEDNFVLDVEPGKTYMLRLVNAALFSEYYFKVAGHKLTVVGADANYLKPFTTDVXAVAAGETFDVLMVADAPPC

SEQ ID NO: 106393 - protein, 62 aa, Triticum aestivum
  Clone ID: PAT_TA_811.pep
LGPHIVGNITTMGNANFGCEFSIEATICSFWSSVASKNICNFPFVAQHPYIWAFLETYVFGR

SEQ ID NO: 106394 - protein, 101 aa, Triticum aestivum
  Clone ID: PAT_TA_812.pep
APPRPNRTLPRPPPRPPPPPPLPLTTPSTTTPLADLCTPIRPHRGLPPRPRQARCPLSTGVVQYLPQIRLGGNPMQVLLVKGLETGSSTVSFVRGVPGARV

SEQ ID NO: 106395 - protein, 211 aa, Triticum aestivum
  unsure (1)..(211): unsure at all Xaa locations
  Clone ID: PAT_TA_813.pep
VAPWPGDTAPHVVEDLLRLVQILSDGSVVRGDESVLGPKEPFPDVPGVQWKDVVYHAAHGLRVRVYRPTSVVAGGDKLPVLVYFHGGGYCLGSFAQPTFHSFCLRAAAELPAVVLSVQYRRAPEHRLPAAIDDGAAFLSWLRGQAELGAGADPWLAESACFARTFLSGVSAGANLSHHLIVQVXSARLEVSPVRIVGYVLLSGFFTGAERT

SEQ ID NO: 106396 - protein, 244 aa, Triticum aestivum
  Clone ID: PAT_TA_814.pep
RAAARAGSDEAEARRERAKHSLKRYMHYYERWASNQTSRQKAIADLQKAEKEQLAKLTDIYGIPETQLKFIIEAWSQIIECRRVLQWTYAYGYYLEDKVKSGFFEYLQGEAESGLERLHQCAEKDLLAFLPFSKHDTTEDHPSPAEFGEFRVKLAGLTSITRNYFENLVRALEDGLEDVQCAGEAATSSKATNSKKAGAKGKVAKKQPSRSSSDHSDDTWPCERCTFLNPSSADACTACDKQRY

SEQ ID NO: 106397 - protein, 185 aa, Triticum aestivum
  Clone ID: PAT_TA_815.pep
MAARRSGAVVAALMALLVGLAGADFAADRAECADKLMGLATCLTYVQLAATARSPTPDCCSGFRQVLGVSKKCLCVLVKDRDEPTLGIKFNVTRAMNLPSACNIPATFSDCPKILNMSPDSKEAEIFKQYGIEHEGKNATAGGSAAVTGTSGAKSADAAAGAGRHTAVVFAVVVSALLASVLVLA

SEQ ID NO: 106398 - protein, 173 aa, Triticum aestivum
  Clone ID: PAT_TA_816.pep
AHASAHASAHASVRPEEGYGSGYGSKPQVEQTYGGSEYGSGYGRKPQVEESYGSGYGSRPQGGGEEYGSAGYGGRKTEEEGYGGSGYGSGRKVQGEDEGAYGSGGYQKPKPYGEETQGSYGGGYGQGNYGRKKQDDDSDDEKKNRYAKRDDSDDEKKERYEKHHHHRRHNYDD

SEQ ID NO: 106399 - protein, 170 aa, Triticum aestivum
  Clone ID: PAT_TA_817.pep
MATAYNLRSRDEPDDFDEFDSTPYGGGYDLFVTFGRPLPPSDETCYPCSAPSTSYDAPHYAAEEPSPYAHHQKPQPAYGFRPQNEQQQQPSYGREDDDSGYVSKPKPKPQPAYGFRPQAEEEQRPSYGGGEEDDQQEEPAYGSGYGSGYGRKPQAEESYGSGYGNTTQPE

SEQ ID NO: 106400 - protein, 221 aa, Triticum aestivum
  unsure (1)..(221): unsure at all Xaa locations
  Clone ID: PAT_TA_818.pep
LVSPPIPHPRPPTPAAPPPSRPTPDVPPAPIAPPAQPRPSRPLPPAGLATRRRPLPRLPPRPPAAPAPPPSXSPPSPAPPSCPATPAPPPPPPPPRPPPPPTTRPPXPTTPEPRPPPTAAPEDQRPAPSLHPEPAGRPRTGLWFWPPTENRSRPATRPRVPRAGGVASATRGGGSRMTTLRMRRRPVTRTAMTLMMRRRNVTRSTTTIAATTTMTKHPAWS

SEQ ID NO: 106401 - protein, 297 aa, Triticum aestivum
  unsure (1)..(297): unsure at all Xaa locations
  Clone ID: PAT_TA_819.pep
IQQVASCIYHNLPDEVTLFEDHKCHEEQIPSDCTQILCAHKNEVWXFVRFSNDGNYLXASSSSDCTAIICEXVKKDDTLTKKYCLRGHKSPISFXVLGSPNDRMLLTCGXNGESXRLWNVDTXXECILKFXLQVKHIIASCAWFPNXXKIVCATSEPESSPNMIFTCDLEHQRLVARACAKIPKXSDLAVTPDGQHLICVCPNEIWIRELRKGREWKIPERQTISSLSLSGDGQSMIVNLNSQEIHLWKTNGSSRVPDKYKGHKQGKFVIRSCFGGSDYLFIASGSEDSQVVFLNKE

SEQ ID NO: 106402 - protein, 59 aa, Triticum aestivum
  Clone ID: PAT_TA_820.pep
MPDSTATAGDGGGLLFEGIQPDEVFAELEELETDNNPMTTSANVYGSRGVSSNYEWHKF

SEQ ID NO: 106403 - protein, 240 aa, Triticum aestivum
  Clone ID: PAT_TA_821.pep
MAPPPEGERGGGGCRARWLRREVLLALALGQLVSLLITSTGFSSSELARRGINAPTSQSLLNYILLALVYGGILLYRRQPLTTKWYYYLILGIIDVEANYIVVKSYQYTSLTSVMLLDCWSIPCVIVLTWIFLKTKYGFRKFFGVGVCVAGLILVVFSDVHASDRAKGPKPLKGDLLVIVGSMLYACSNVTEEYLVKKNNRIELMAMLGIFGAVISGIQISILEREELHSIKWNAGRGVP

SEQ ID NO: 106404 - protein, 173 aa, Triticum aestivum
  Clone ID: PAT_TA_822.pep
MESDKMVQVEAAADPEERTASGDPKACDDCNTTKTPLWRGGPNGPKSLCNACGIRYRKRRRVAMGLDPEAKRKPKRDDAIKAAAEAAQASSKEEEEEEEDKAKAGDEKAGEEKASKKTKARTTHTVELHMVGFAKDAVLKQQRRRRRRKPSCLGEEERAAILLMSLSSGVIYA

SEQ ID NO: 106405 - protein, 266 aa, Triticum aestivum
  Clone ID: PAT_TA_823.pep
HREEAHQRCRGGRPQDGSGVFLARGERHEEDGSALLLARGRRLHPTSVPRPPLLLPPPRAVAAASHAELHAAAPRPRLGLPGRCLVVQCASFSCLCFCLPCRRRPTLRRCFGCPPPYRSGGVVPLGLPRRLRGGRRPPSASSWPPGPARWPPAVSSGTGSRKRCTATLVRWVRRARAASWWCCSRRTPWGRRRRCAPQDPPPPPPRPSCRTPSPPATAPRSADRLIARGREGKKFGFRGRRLGFRSNGGAGVWVYRRERGRGSSSE

SEQ ID NO: 106406 - protein, 321 aa, Triticum aestivum
  Clone ID: PAT_TA_824.pep
MAASPCFSLAARCSLLLTAALVLALSHGAHGYGDAGAGLSSSFYDDSCPGARDIVRRVIQNARVADARIPASLIRLHFHDCFVQGCDGSLLLDNDLPAILTEKEVPANDRSARGFKVVDSIKRALENACPGIVSCADILALASEISVELAGGPRWSVPLGRRDGTTTNIESANNLPSPFDSLETLQEKFKNLGLDDTDLVALQGAHTFGRAQCQFTQRNCSAGQDEETLVNLDTVTPDVFDNKYYGNLLRGRAPLPSDQVMLSDPVAAATTARIVRRFSGSQKDFFKNFAASMVKMGNISPLTGRAGEIRNNCRRVNRKPY

SEQ ID NO: 106407 - protein, 197 aa, Triticum aestivum
  Clone ID: PAT_TA_825.pep
MSPPENPNGGAAAAAPSEPAPPAKPSSSKGKKKDDKKDDDLSEEDLALKEQLELYVVRAQDVDPGVQRLALESMRQEIRSATSSMTSVPKPLKFLRPHYGTLKSYYETMPESELKKYMADILSVLALTMSAEGERESLRYRLLGSEGDIGSWGHEYVRNLAGEIAQEFQKRQGDDMPIDELMELVQQIVSFHMKHNA

SEQ ID NO: 106408 - protein, 76 aa, Triticum aestivum
  Clone ID: PAT_TA_826.pep
VEMKAKNLEYIADVPSNILPFEFPNGKCFREPSHATLTLPRKKCSRIPSKATEKRGEAYNMSSTLAPRHGSARPPA

SEQ ID NO: 106409 - protein, 192 aa, Triticum aestivum
  Clone ID: PAT_TA_827.pep
MENLAGAIRDLAALSTRLLLQLSGDGEKRNLAISPLSIHSVVVLLAAGATGDTLDQIVSFLGLSGGAAHAALASEVATLVFGRDAGVEPQIRCTVGVWVESSLRLRSAFADKVTSEFKAGVRAMPFRENVEEARVEINRWFEDKTGGFIKDLMPEGHLDAISTVLVIGNALYMRGTWLDPFIPYNTLDDDFF

SEQ ID NO: 106410 - protein, 229 aa, Triticum aestivum
  unsure (1)..(229): unsure at all Xaa locations
  Clone ID: PAT_TA_828.pep
MPETRNDLPMEPSFGSNSASTEEASTRRVANRIIRALQHHLQLLHRAGADFFVLGATGNVYTVTLATTPACTCPDPGAPCKHILFVLLRVLGLSLDEACVWRQSLRPCQVARLVAAPTYPEVLAGPRARERFHQQWAAHAAAAAAKAADQRRQESAGPSLGRLDGAACPVCLEEMAPSAEAQGGAAATGPAPLLTCGTCRNSVHAECFARWKRHRARRAATCVVCRAXW

SEQ ID NO: 106411 - protein, 270 aa, Triticum aestivum
  unsure (1)..(270): unsure at all Xaa locations
  Clone ID: PAT_TA_829.pep
LAQIAASHLQEKDLVYVSGQLTGDVPPFKHTDGQANIQVVAHLLSFRDKKAVETDLMVQEXEGLWSIAEAEKKVEQTKPFSKYPARTFADYKAKQDKYRTLWNDVLANPLNWTDNRAEKANGSKNPNYPVFMALPPDEALWLDSAPHYVLEKLDGLTFNSGYNAAKTYKPFNSSMGKGTNTGWSKFKTSQAASPEKQKKEAELWQNLVDSPQSWWDNRADKRSPKAPDFKHKDTGEALWLSPKTPSSVTDALPPVKGGSRGFRRPETLLS

SEQ ID NO: 106412 - protein, 207 aa, Triticum aestivum
  Clone ID: PAT_TA_830.pep
TAIPIAAIVLIPSSIMVQFLHFHVNITENYVTEAGPIIWSLFSCHACIIIHRWFSWWDTGLHCFIMRNLPLSLLNVCSELCSLCSDNLLQQSVVFVLYILPCKSSCTSNIITKTKYEDHEPSKIRYKPWLVFLRPPAPKLHHAPLVHIQYKWQHMLIKLTRHLPRLKIMLSVSPNSCNDHQLYKNGSSSFSINYAHLERSCSSRDAL

SEQ ID NO: 106413 - protein, 134 aa, Triticum aestivum
  unsure (1)..(134): unsure at all Xaa locations
  Clone ID: PAT_TA_831.pep
LPGTPCXXGQGXEXFRRKAPDLWQTXXTXPDPRCPPWRRRQRVPVATLHAAPLHLGDAVGAVAAGASHGRQGVAGFGVRRGVAGRGGPGSGEVRGGGEHAEAAGGRTAQGISQSSVPNSPADAAPGILILLRIC

SEQ ID NO: 106414 - protein, 113 aa, Triticum aestivum
  Clone ID: PAT_TA_832.pep
VPTLDGKTEIKIPKGVQPGQVVVLRGKGLELPNQAGYFGDQHVRFKIHFPLKVNERQRALLEDFAAEEATKEQSFFATGNWSELIAENMKSQNFMIGLGFVMLIYLMLSKTLS

SEQ ID NO: 106415 - protein, 35 aa, Triticum aestivum
  Clone ID: PAT_TA_833.pep
INRNKLEEMEQLYASAYEQPMCVGCKIDRRERLLS

SEQ ID NO: 106416 - protein, 352 aa, Triticum aestivum
  Clone ID: PAT_TA_834.pep
DKQAAYGWMFKLSEWANFSSYDVGLRSGSTASHILVFDRRTKRLVEEAIDGKIVLSMRALYQSKVGLTLIDSGVKDILKNLSEKQGKKMNSPESAKDIPKFLELFAGQINMDETKDPIESFKTFNEFFIRQLKPSARPIAQIDDGSIATCAADCRLMAYSSVDESTRFWIKGRKFSIEGLLGADAHHNAFKNGSLVIFRLAPQDYHRFHVPVSGTVEKFVEIPGCLYTVNPIAVNSKYCNVFTENKRVISVISTPEFGKVAFVAIGATMVGSITLVKKEGDYVHKGDEFGYFSFGGSTVICVFEKDAIQFDADLLANSERSLETLVEVGTTLGVSKRNRGLKVSELQKCSIE

SEQ ID NO: 106417 - protein, 309 aa, Triticum aestivum
  Clone ID: PAT_TA_835.pep
ARGSLLLHAQDCVDIPSKTKETPLFLAVKNGSLSCVRLLLRYGANPKAQNLRKQRPIDVATSQDMRFLLNSANVVPMNHGSMEKNHAMKKERHKELPGDDFHDYDNGDYYESCVVPKASVGHRDFPVKSKGNTAPKEGPKLSRPNDHWEKHDYTRKIFVGGLPLSVDHAYLTTFFTSEFRPVEEAIVITLKIDERIQSRGFGFVKFEREKDMISAKEAHHVYVLGKRVEIKDAVARPSLPELERATSFRHHVRESPRVTHSELEDEQPEQYNFGKRRPMPEKHLPSWFFIFRRWLPRFLMKATERYGEK

SEQ ID NO: 106418 - protein, 146 aa, Triticum aestivum
  Clone ID: PAT_TA_836.pep
RLPESTAPRVSRLACGAQERFRRQGKGGRGCCLGSILTVRFGLPLLSRGLRVCRWWPLPWDRVTQLLVAVDFGCAGDDYCRGLEVLSLIRIRYQAIRDQIWLHAKKESGLRERPGRKLHRLSREGAIWKVEVAISLLGLMWILPMP

SEQ ID NO: 106419 - protein, 308 aa, Triticum aestivum
  unsure (1)..(308): unsure at all Xaa locations
  Clone ID: PAT_TA_837.pep
NAQQGQLHASQSLGPGSFGQNIPTMQLPGQLPVSQPLTQQNASAGALQAPSAVHSNPMQAVPGQQQLPSNVTALMLLQPVLPMLLQAPQFQLEEPQPVIHCSYQSSQQTIFLIQIPLGLLHQQQQQHQQQHQLQLLPXPPVPKQQGQPVQSNTPXGAPAAMMTTXLNAIPQQVNSPAVSLTCNWTEXHTSPEXGFKYYYXNSITRESKWEKPEEYILYEQAAAAPRNLFYFKQHQQKLVAQQLQSPPQAQTIPPMQSMQHHPQSQQGHNQMQMKQQDLNYNQLQATGTIDPSRIQQGIQAAQERSWKS

SEQ ID NO: 106420 - protein, 115 aa, Triticum aestivum
  Clone ID: PAT_TA_838.pep
SGHRRSTIDIALSIARPLSSHLAGSRGDRPPPDRPRGQRRGQPTDSTLPPGATSPTMSSRACARALGLPGLPPQDLYRQAVVVSIQPPATYGSSGRVRQLGTWIVALVVQHTQDP

SEQ ID NO: 106421 - protein, 345 aa, Triticum aestivum
  Clone ID: PAT_TA_839.pep
MAGAVNGVEAAQAQGGGAAAGEAAIRHRTVEANGIAMHVAESGPEDGRAVLFLHGFPELWYSWRHQMAHLAARGYRCVAPDLRGYGGTEAPADVASYTAFHVVGDAVALLDALGIGKVFVVGHDWGAIIAWYLCLFRPDRVTALVNTSVAFMRHVFIRAGAAAVKTTDYFNQAYGPTYYICRFQEPGVAEKEFAPAHARHLMTRILSDRFSERAAGKEPKDGGGDDADAALPPWLTEADIDYFAAAFEKTGFTGAINYYRNMDRNWELAAPWADAKVTVPTKFIVGDGDLTYHYAGIQDYLHKGGLKADVPLLEELVVVPGAGHFIQQERAQEVSDHIYSFIAKF

SEQ ID NO: 106422 - protein, 262 aa, Triticum aestivum
  Clone ID: PAT_TA_840.pep
VHPNSYALVISMENITLNWYFGNDRSMLVSNCLFRMGGAAIPRVRPRVRRRRSKYELVHTVRTHKGADDKCFGCVTQQEDEAGKVGVSLSKDLMAVAGDALKTNITTLGPLVLPLSEQLLFMATLVAKKAFKVKIKPYIPDFKLAFEHFCIHAGGRAVLDELEKNLGLTEWHMEPSRMTLYRFGNTSSSSLWYELAYSEAKGRIGRRDRVWQIAFGSGFKCNSAVWRALRTVAPEAEESNPWADEIDRFPVEVPRVSRVGNA

SEQ ID NO: 106423 - protein, 260 aa, Triticum aestivum
  Clone ID: PAT_TA_841.pep
MARLLVLAVTATVLMAQSGQPASAARTSPAEAFWRAALPDATMPDAILELLPQGDHHASTEQGAYMNAETDTPEGAVEAVEDKDPPPPMNFNYDYDDALPRSEATSAPSPDVLLNRAAVVTPSSTVFFLEDAVRVGESLPFHRIHRATAAAEASAEQPLELYTVRSVRAVEGSSFVLCRGEAGEGAVYGCRATGPARAYVLALAGERGDAAMTAVAVSRWDPEHAAFRLLGVKPGGAAVCHAVPDAQVLPAMNGKSPAAN

SEQ ID NO: 106424 - protein, 387 aa, Triticum aestivum
  unsure (1)..(387): unsure at all Xaa locations
  Clone ID: PAT_TA_842.pep
PTRLPGTPRPSGTITGFHQPQGCQKTPLSQRIMASPAMGCCTGRPDNGFGQMQVRSSVIGHSHQAXPSFPCIADIGFXRSHRMLLMHYRGLSNRQCLHGIEIVNSPNLSAVPEADMKRWAELTGRDLNFSVPAEASDFESWRNLPSTDFELDRPQPAASKSVAHTSHNNNHKKALNGSGLNLSTPPSSDDGMDLSPKCHKRRKDFFGHGVEEDCAMANNSCSEREQEVEVHTGEPSWMHDFTGVAKHASGPVTAAKTIYEDDEGYLIMVSMLLSDPHSVKVTWRNTLTHGVVKITCVSTARMPFIKRHDRTFKLTDPSPEHCPPGEFVREIPLATRIPENAKIEAYYDETGTGLEIMVPKHRVGPEEHEVQVCMRPPHLGDNDLVLS

SEQ ID NO: 106425 - protein, 210 aa, Triticum aestivum
  Clone ID: PAT_TA_843.pep
WFALNSVSPAIVEVKGVHQFDWLTRENVPVLEAIENHRGVRNHYHGDHGTVSSASDNPRVLASKLQARSPKYISLLNHLRIYLPELFPSLNKVVFLDDDIVVQRDLSPLWEIDLEGKVNGAVETCRGEDNWVMSKRFRTYFNFSHPVIDRSLDPDECAWAYGMNIFDLEAWRKTNIRDTYHFWLKENLKAGLTLWKFGTLPPALIAFQGS

SEQ ID NO: 106426 - protein, 204 aa, Triticum aestivum
  Clone ID: PAT_TA_844.pep
IFGTFIGGSDTTSVTILWAMAELTRNPRLLKRAQDEIRAVVGVNERVRPDDLAKLVYLKMVVKETLRLHPPATMLLPREAMRDIRIGGYDVLAKTRIYVNVWAIGRDPASWPDEPEEFKPERFETSEIDFKGGHFELTPFGAGRRICPALSMSTATVEFTLANLLYSFEWALPEGIVVSMQEEGKLIPLLKTPLLLVPTPYQHI

SEQ ID NO: 106427 - protein, 218 aa, Triticum aestivum
  Clone ID: PAT_TA_845.pep
GDHAPAHRRSKRGLPSGSHTSCLWQQQRWQQGMARGVPDIVRRAVIADVRLGRARAHPRELKDLLRTTLLMMMMMMPPVSVSSSPGGFILPAYLGFGVILYMRVVYLSQWQQGIAGPFEGLLKRTSILFQGPGSGTYILRYIMQLVSLFLLFFSLLIKKMCLFKTWARNAGQDTLGHVEEMEWRQMIPSSCKQSTTCICCGHSSSFRGLVWTYILATL

SEQ ID NO: 106428 - protein, 111 aa, Triticum aestivum
  Clone ID: PAT_TA_846.pep
RPIRTDLAPATASRGSSTPHASPRCNGARPSTNPHRRAARCSATTSATRIPPQPPPPPNPRRSSPIRTPTPPSPTRPPRAATIDPEGETPPPDAPRIGSTSGEIPLVWVWV

SEQ ID NO: 106429 - protein, 213 aa, Triticum aestivum
  unsure (1)..(213): unsure at all Xaa locations
  Clone ID: PAT_TA_847.pep
LLAFATRPRRPTVDIISSGGLRFALAPYGGIRRQMRKICIMELLSARQVRRIDSIKQAEVTHLMESVLTASSASSSAIIDIGKELSRLTNNIIARAAFGGKCRQQEVYLRELAVLASHVGGFSLVELXLSSPLGRWLTGDCRQTRGSHARIQRILADIIQERKEKKQHNASAAAAATATPTEYEAPLDVLLGQHAKRPLSFPLTNRQXVHCGS

SEQ ID NO: 106430 - protein, 63 aa, Triticum aestivum
  Clone ID: PAT_TA_848.pep
SCLALGSNGGAVNGTPNRRPSVQQQNGVRSASRDGRRESVRPSAPVNYVAIAKDDAASQASST

SEQ ID NO: 106431 - protein, 211 aa, Triticum aestivum
  Clone ID: PAT_TA_849.pep
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILIGNKADMDESKRAVSTAKGQALADEYGIQFFETSAKTNLNVEQVFFSIARDIKQRLAETDSKPEDRTIKINKTEGSENPESQKSAC

SEQ ID NO: 106432 - protein, 276 aa, Triticum aestivum
  unsure (1)..(276): unsure at all Xaa locations
  Clone ID: PAT_TA_850.pep
LSLSPSLIRSHSPHRPISPFRRYHHPTSLPVPVPDSTRSASPPRQLSRRSPVRIGTAGARSPRRARADYDYLIKLLLIGDSGVGKSCLLLRFSDGSFTTSFITTIGIDFKIRTIELDXGKRIKLQIWEYSRXKSQERSSTTTKAXDRGGIGILLVYDVTDESSFNNIRNWIRNIEQHASXDNVNKILIGNKXDMDESKRAVSTAKGQALADEYGIQFFETSAKTNLNVEQVFFSIARDIKQRLAETDSKPEDQTIKINKTEGSENPESQKSACCGS

SEQ ID NO: 106433 - protein, 209 aa, Triticum aestivum
  unsure (1)..(209): unsure at all Xaa locations
  Clone ID: PAT_TA_851.pep
MMSHHQIWSATSSWIQPSTGFAEPLSSDPWLATQPMRTRPRSGVPPPPPTAAPXRTPPPAPTTPLNSRHRPAMHHHPATTPRPPAEIRARRPKAPRAAAGVDPGVPPPSTPRACRCRSAPVAPPWPTQPHGPPPRSPFPHRRQDLAALLAYRARRGPLTCLACSSGKHDVQLPQRSLAVRRLIVHVLGFIDGACAPRKQPPCCSLVDAS

SEQ ID NO: 106434 - protein, 361 aa, Triticum aestivum
  unsure (1)..(361): unsure at all Xaa locations
  Clone ID: PAT_TA_852.pep
MTSSMACLVLLLGIACLLQTSLTAAAPPPPPSWELPESEVRSRWTRWQTKYSKRYPTPEEKEKRFQVFKTNTNSIGAFASQTTVNAVVGGFGPQTVTTVRVGMNRFGDLNPSEVAEQFTGFNNSVFTPEPPSPLPYDSWKPCCVDWRSSGAVTGVKFQGSCLSCWAFAAVAAIEGMNKIRTGELVSLSEQQLVDCDTGSSGCSGGRTDTALGLVASRGGITXQTKGYPYSGFKGTCDGQYLAVETWTSFKSITRLPPNDXRQLALAVARQXPVTVYIAASXWEFQFYSGGIFRGPCSADAATVNHAVTIVGYCEEFGEKFWIAKNSWSNDWGDQGYICLAKDVFWPTGTCGLATSPFYPTA

SEQ ID NO: 106435 - protein, 199 aa, Triticum aestivum
  Clone ID: PAT_TA_853.pep
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLTGNALTFAHNNGAGVLPPFTLPPILDASDAFASCCQALVAKPKKH

SEQ ID NO: 106436 - protein, 91 aa, Triticum aestivum
  unsure (1)..(91): unsure at all Xaa locations
  Clone ID: PAT_TA_854.pep
MEAAAAAAASPDSSSLEAVATVFRSRVNELQDLALARNMYPXTAVTDLTAVDTSVTAMEAQVQAIRRRLQEELDAIPKAKVSLPVLVIYWT

SEQ ID NO: 106437 - protein, 277 aa, Triticum aestivum
  Clone ID: PAT_TA_855.pep
MEAAAAAAASPDSSSLEAVATVFRSRVNELQDLALARNMYPATAVTDLTAVDTSVTAMEAQVQAIRRRLQEELDAIPKAKKLVEKSLKQQQKLQHMLANMPPGMREDIVATPLEQSLMLPECFNFNTAVPEFLDSDFKIKEEPVAAPKKGKGSAPRWYISTEELDSLSSYMRGRLTLEKVNISINEVATYADANAHLVACPKKKLSEDTWEKALELRDIAATEAVKGKHFFLEADIKGPGLKLDHTGKAILTVLRHLGRVHETRIGHHRVFILSKQC

SEQ ID NO: 106438 - protein, 177 aa, Triticum aestivum
  Clone ID: PAT_TA_856.pep
SSEKLIIAMDAAFGMEYLHSKSIVHFDLKCDNLLVNLRDPQRPICKVGDFGLSRIKRNTLVSGGVRGTPHASAPELLNGSSSKVSEKVDVFSFGIALWEILTGEEPYANMHCGAIIGGIVNNSLRPPVPETCDPEWRILMEQCWSANPDIRPSFTEVTDRLRAMSATLQSRAQAPGS

SEQ ID NO: 106439 - protein, 208 aa, Triticum aestivum
  Clone ID: PAT_TA_857.pep
MASTGVSRRSSIMASRLSASAEAMRASEGGKQRHAVVARRVEYDEESLAGEPQYDVFINHRGVDTKRTVARLLYDRLAQSGIRGFLDNMSMRPGDRLRETISAGISECSVAVAIFSPSYFDSEYCLWELATLVESRKTIIPIFYNIKPSDLVLPEALAASDDYLPQDVERYKYALREAKNTVGLTYDSATGDIAELVSAAADAVLYTW

SEQ ID NO: 106440 - protein, 89 aa, Triticum aestivum
  Clone ID: PAT_TA_858.pep
HASAHASAHASAHASDDYLIFNYNPKMHNVLEVATSEYKACNISAAPSRNFTSGHDRVQLFGVVASYICGTPGHCGRGIKIHMPIEDKE

SEQ ID NO: 106441 - protein, 54 aa, Triticum aestivum
  Clone ID: PAT_TA_859.pep
TSTKLLAQSPRVCLSKRQSHQDSHPSACRKPCCQQSISFRQQDMMIKCNNTGFL

SEQ ID NO: 106442 - protein, 215 aa, Triticum aestivum
  Clone ID: PAT_TA_860.pep
PYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKVKEIDLQVTERFRDRVVDDGYNPSYGARPLRRAIMRLLEDSLAEKMLAGEVKEGDSAIVDVDSEGKVIVLNGGSGVLEPLTPILST

SEQ ID NO: 106443 - protein, 189 aa, Triticum aestivum
  Clone ID: PAT_TA_861.pep
MAAARGGGSAARVGDWDVELGPGWDWRSIPQLLSSACIFICSGGCFGCCEKAAKHVGDLSKSLMAHAQNPTVAEEFWSTTTIEVDPADLRAPYNTSSWDLDLHGVGSSHNLGDSANHGFSLWQQTRDEWTENTRLRQEPVVKQIQEPVLSWNAAYESLLGSNKPFPQPIPLHEMVDFLVDIWEQEGLYD

SEQ ID NO: 106444 - protein, 101 aa, Triticum aestivum
  Clone ID: PAT_TA_862.pep
PAPAQPPAPKRRKIEPSRRSRPPSQTAIDKDKVAASSNSSVSGTPLARVDLNKVREAKRFAVLQAQHEGCLGSFKSFDSLFGNYLVPVTPSDDFFEQIAKE

SEQ ID NO: 106445 - protein, 234 aa, Triticum aestivum
  unsure (1)..(234): unsure at all Xaa locations
  Clone ID: PAT_TA_863.pep
FSHFVTNLPAFHQILVFVCVKSVPVPYVPADERYLIGRIGPRQYRMYRCIVRYGYKDVQKDDENFENHLVMSIAKFIQMEAEEAASSGSYESSNEGRXIHTTDTTXTGLIMRDSNEGTSFTRXSKSETLQSLQSIYEQESGGLSRRRVRFQIAEEEQINPQVRDELSDLLEAKEAGVAYIIGHSYVKARKNSNFLKSFAIDYAYSFLRKNCRGPSVTLHIPHISLIEVGMIYYV

SEQ ID NO: 106446 - protein, 234 aa, Triticum aestivum
  unsure (1)..(234): unsure at all Xaa locations
  Clone ID: PAT_TA_864.pep
MGQKSFMKLYMLYNVAEARLRSHIEKGNEDGLFISSVASTAKLWALIMDAGTGFTSQVYELSQIFLHKDWIMEQWENNYYISAIAGATNGSSLVLVVVQYAFAPVPLLLYRVXSRPPPLRETVNCECMLHXMATAGTRWGVVMSRNSGYSEQVVELDFLYPSEGIHRRWENGYRITSTAATGDQAAFILSIPKRKLSDETQETLRTSTFPSNHVKEKWAKNLYIASICYGRTVS

SEQ ID NO: 106447 - protein, 447 aa, Triticum aestivum
  Clone ID: PAT_TA_865.pep
MVESEVDASAADTGTATARASAAVLTAAAVAGKGASPAEAPGGRAIRHVSVESEVDASAAETATSHASAAVLTAPLSLEGGLAAELQQAILGQRGLRHFGNVRPGADLSHFQLPATFNLPKSQLQLYGEIVYCDGDDYLSRCGKGKDSLERFTAVVAWSISTTRPPIFGFAPYNPVLGETHHVSRGSLHVLLEQVCHKPPVSALHATDDGGNVELVWSQHPVPKFNGASIEATVHGKRQVRLPKFNETYEMGCPNLLIRLLPGPSVEWSGTVRIVCKDSGLEAELSYHRSNSFMGMGGDGRCVKGKVFHSSSPQDTVFEIDGYWDRTVSLKDVESGEVLVLYDANLSIANLVTPEVKDEEGLSSTESAVVWSEVSEAILAKDWEKASEAKRKVEGTARSLEKERNEKGEVWMPKHFSLSQDKDGNWDCCPLEKSVRPAPIVVPSPSS

SEQ ID NO: 106448 - protein, 160 aa, Triticum aestivum
  Clone ID: PAT_TA_866.pep
MAHGQESSTQAAAAPALCANGCGFYGSAAAKNMCSKCYLEHLKATDTATPAVEGKTKIKADVANLVSNFKTSLTLQDSGAAAAAEAPAAEAPAKKAAPTRCMACKKKVGLLGFACRCGGTFCSLHRYVDGHACDFDYKKVDREKIAQQNPLIAPSKIDKI

SEQ ID NO: 106449 - protein, 298 aa, Triticum aestivum
  Clone ID: PAT_TA_867.pep
GNAQAFNLTALRKLNDVKSTDGGTTLLHFVIEEVVRAEGKRLAVNRNYTIRRSGSLAKSSVDGGISAAGSAGQGPSREDRQNEYLNLGLPIVGGLSSEFANVKKAATVDYDVTANECTILGNRLAGIKKLLETCGDDGFSRGLRGFVNAAEQELKALSGVQEKVLDLVQRTTEYYHAGATKDRNAHPLQLFVIVRDFLGMVDQACVDIKRRLQQQKKPTPPSSQPTTAAAAKGPAEAAKGAADGAKAVAGGAAAAPPAHKPPPEEADSKRKRVMPRFPNLPAHFMKDGADSDSSSDEE

SEQ ID NO: 106450 - protein, 107 aa, Triticum aestivum
  Clone ID: PAT_TA_868.pep
RLQPATGIDSMRVNLLATTKKSDAKEKFATTMILHQAGMFVNSIIKLKSRTCFWCCFQYLDNKTPIFVDHLICVFLLYISIKSASRRLTSSIIGHLIQSSVPSYYIV

SEQ ID NO: 106451 - protein, 145 aa, Triticum aestivum
  Clone ID: PAT_TA_869.pep
RRTPRDVLLWRWPRRRASSARSARPTSPGGRRPGRPAGRRRPKPRRRRRRPGRRLRGGSGRGRRALAPRPTRTRGDGPAAAPRLRSTTAAAPAPARPPAAARTAPSARRRRRSPSPAGTPWSHPPPPQLLPAWPRLALREEHGAH

SEQ ID NO: 106452 - protein, 219 aa, Triticum aestivum
  Clone ID: PAT_TA_870.pep
GPSPSSSAASSQPPPSLLAEWNSYAAARSAGEDVGGGFGIDIEAAVRSANDRVTGTFGVVSKGVRGFPGSFQSSTSSVPSGKSLMYFGLFLASGIFLVFIAFTIFLPVMVIMPQKFAICFTMGCAFIIGSFFALKGPKNQLYHMISRERLPFTIGFVGSMFATIYVSMVLHSYILSVLFSCLQILALVYYAISYFPGGSAGMKFLSSTLVASVLRCFGR

SEQ ID NO: 106453 - protein, 196 aa, Triticum aestivum
  unsure (1)..(196): unsure at all Xaa locations
  Clone ID: PAT_TA_871.pep
TCCGGEPPVPAAARAAGGGCRGPPRRSSPGPLRRHWRRRTASTWRSSTAKAGYSSRLPARDRSRGPVPGQHPGYKDVIEPLESVSINMIPTTKEDIRDLGPPDQVPGPSGRNVLSPHMQNTKLNDAKVTVVERKARYALGYLAHAPGCPRHGLGTFARANGKFXTLATGANERRWDKMKDRLHTIVDXSFKIETKV

SEQ ID NO: 106454 - protein, 163 aa, Triticum aestivum
  Clone ID: PAT_TA_872.pep
NGLPYKYNPSTVKHQFITLSQMKCGASFCDQSKLQKARLPPNKFEQLIVVLVKVALLIGVFRTLKHLIKVHLDLLIKLHQLVYKHYTQTHSQHMLPGMAHVGELPEGVGVHLGAQPQQGTDDGRRRRHVAVACGCALLSGWTGRCGSGSAMLEPGADAWADAW

SEQ ID NO: 106455 - protein, 192 aa, Triticum aestivum
  Clone ID: PAT_TA_873.pep
QTDFHYEKAFILKSFSAYTAAKLCLSSKSPASLSQPSWSCILFSGVELAVIGTPGRSLHAALSDVELAVIGTPGRNGHAALVCNGVDKIGQWRHVRSSSSTRASLETMLEAFLHADEVVAWLRANVKAPIVEHAVAVCRQFPRCPLDHKEGDQHGQGEGLPSASRHCAIELASHTGRALLVGGGDLADVGSP

SEQ ID NO: 106456 - protein, 145 aa, Triticum aestivum
  unsure (1)..(145): unsure at all Xaa locations
  Clone ID: PAT_TA_874.pep
MYCQSCKNVYDEEDAGTCKECYEEASETEEELKREIDDLRSRLLFLRLPSPTLDASAAGHSDLLLHAIPASSSSSSPSPSXDADGARLDTPAVPANRVILASKSPSFKTNCLSNGKRAGSNQCYERVLMNVLRCFSFQLTMHGGE

SEQ ID NO: 106457 - protein, 263 aa, Triticum aestivum
  unsure (1)..(263): unsure at all Xaa locations
  Clone ID: PAT_TA_875.pep
MADPAEETVAAPPPTPAAPAEGAPPLSAEPPASTDASPEKAAPPAPAPDTTVRSRGFRLLGEDTSVHKVLGGGKTADVLLWKDKKTTAXVIGGTTVIWVXIEVLDYHLLTLLSHVMDLVXLAILFVWSKAMTFIKKSPRYCPVVEIPEDLXLNVSRALRSDVNRSLHLLREIAMGHDLKKFIGVIAGLXWVLSEVGSCCHFLTLRHIAVLVIHTVXPILYDKYQDKVDHFAGKAHTEACKHYEVLDQKVLSKIPRGPAKTKKT

SEQ ID NO: 106458 - protein, 106 aa, Triticum aestivum
  Clone ID: PAT_TA_876.pep
MSSSSLSPGGGRLSGSDGDSGATFSAGDNRREKRRLSNRESARRSRLRKQQHLDELVLRVVEEFSGVAMDIQEECPPDDPLLRPWQIPYPATAMPIAATATHMLQY

SEQ ID NO: 106459 - protein, 238 aa, Triticum aestivum
  unsure (1)..(238): unsure at all Xaa locations
  Clone ID: PAT_TA_877.pep
EGISQEVVGDLLGEEFEGYIFKIMGGCDKQGFPMKQGVLTPGRVRLLLHRGTSCFRGHGRRVGERRRKSVRGCIVSQDLSVINLVIVKKGKNDLPGLTDTEKPRMRGPKRASKIKKLFNLGKDDDVRQYVNTYRRSFTNKKGKTVSKAPKIQRLVTPLTLQXRKRARIADKKKRIAKKXQEAAXEYQKLLAQRLKEQXRDRRSQDMAKRRQSFRLLQSPCAPLKMSFNKWAKPQLQLP

SEQ ID NO: 106460 - protein, 91 aa, Triticum aestivum
  unsure (1)..(91): unsure at all Xaa locations
  Clone ID: PAT_TA_878.pep
MTPRCNPNSSTGRXYTIGLXDQGVFPEIPYEVGGKKNGMTSPLSPSAKTDNEAQRLLALLGMPFAENIKSDQFKKKRLKRHHFMSKGRGRK

SEQ ID NO: 106461 - protein, 124 aa, Triticum aestivum
  Clone ID: PAT_TA_879.pep
EGNTIGIAVTLRGRVMFNFLDRLINLGLPRTMDFLGVNPNSFDGHGNYTIGLRDQGVFPEIPYEVGGKKNGMDVTIVTTAKTDNEAQRLLALLGMPFAENIKSDQFKKKRLKRHHFMSKGRGRK

SEQ ID NO: 106462 - protein, 148 aa, Triticum aestivum
  unsure (1)..(148): unsure at all Xaa locations
  Clone ID: PAT_TA_880.pep
TTARPRGPEKTHFGDLKDEDRMFTNLYGLNDPVLKGAMNRGDWARTNDLAIKGADCIVNEMKKSGLPGRGSAGFAFGLKWSFMPKVADGRPSYHVGNADESEPGTXCKDREIHCVMDPHKXFLKGCLIAEIRLTALTAHIFLXGEYVK

SEQ ID NO: 106463 - protein, 180 aa, Triticum aestivum
  Clone ID: PAT_TA_881.pep
GTRYNVPLMNSLVLYIGIQAVQQLQANKANASASAQQINHNTMDIFQIETATEFFRYLVTNLDTEGRYLFLNAIANQLRYPNSHTHYFSFIILYLFAEAAQEHIQEQVTRVLLERLIVNRPHPWGLLITFIELIKNPRYNFWNRAFTHCAPEIKQLFESVAKSCGGGAGKAVDDGSDGGH

SEQ ID NO: 106464 - protein, 216 aa, Triticum aestivum
  Clone ID: PAT_TA_882.pep
MKKFESKSRMFNITSTSKSQPCYMNREVISLLSTLGIRDEIFESMQQNDMRELDEMLTNREAALSVLGKIGSAETKTASKILLQGYEPSLEPYLLMILKAHQDNRLTDIRTRCKIHVPKGRVLIGCLDETGELEYGQVYIRISKNSKEQKDNCQPYFSEDNGTEKTAVVVGRVAVSKNPCLHPGDIRVLEAIYDHGLYAKNLVDCVVFPQRGERPH

SEQ ID NO: 106465 - protein, 129 aa, Triticum aestivum
  Clone ID: PAT_TA_883.pep
TEFFRYLVTNLDTEGRYLFLNAIANQLRYPNSHTHYFSFIILYLFAEAAQEHIQEQVTRVLLERLIVNRPHPWGLLITFIELIKNPRYNFWNRAFTHCAPEIKQLFESVAKSCGGGAGKAVDDGSDGGH

SEQ ID NO: 106466 - protein, 173 aa, Triticum aestivum
  Clone ID: PAT_TA_884.pep
LMNSLVLYIGIQAVQQLQANKANASASAQQINHSTMDIFQIETATEFFRYLVTNLDTEGRHLFLNAIANQLRYPNSHTHYFSFIILYLFAEASQEHIQEQVTRVLLERLIVNRPHPWGLLITFIELIKNPRYNFWNRAFTHCAPEIKQLFESVAKSCGGGAGKAVDDGSDVSH

SEQ ID NO: 106467 - protein, 89 aa, Triticum aestivum
  Clone ID: PAT_TA_885.pep
TRVESGLCSRRLMQYLYHKRYRPDNNPITYWRKLIDEYFAPRSRERWCVTSYEKPGNTSAAIPQTSPVSKNFISEIILNRCLNNTPSVN

SEQ ID NO: 106468 - protein, 465 aa, Triticum aestivum
  unsure (1)..(465): unsure at all Xaa locations
  Clone ID: PAT_TA_886.pep
MSVAPHFNLGLVPRDMNGGIPVSSANSSGPSIGVSSLVTDGNSSLSGGAQFQHSTSMNADSFMRLPSSPMSFSSNNISGSSVIDGSTMQQSPPQEQMQKRRSSSATSQPGIEADGAFHGQKKPTVDIRQDDILQQHLIQQLLQGQSSLHFQGQHNPQLQALIRQQKLAHIQHLQQHQLSQQFPQIQQSQVGIPRQPQLRPPLAQPGMQLPGXFRTPVESGLCSRRLMQYLYHKRQRPENNPITYWRKLIDEYFAPQARERWCVSSYEKRGNSSXAIPQTAQDTWRCDICNTHTGKGYEATYEILPRLCQIRFDHGVVDEYLFLDMPNEFRLPNGXLLLLEHTKVVQKSIYDYLHVTHEGQLRIIFTPELKIMSWEFCSRRHDEYITRRFLAPQVNHLLQIAXKYQAAANESXGPAGVSTNDAQXICNMFAXSITTTXEKXLEPPQALNEHGAFLKXYVPGACKIS

SEQ ID NO: 106469 - protein, 151 aa, Triticum aestivum
  Clone ID: PAT_TA_887.pep
TKHKTTGMAKMMTMIMLFLVSSLLSHSSESSQSHLQITFNVHKQKFSELDQAMQMVLPLRQPPQRRLVGADAALKESLLSLMQAIAHRMETPHGLPSIDEGAKPHPSSWMNMKTDDEEAHPATPTAGAMMAQRDDLHFRNSCPVPCCPRAP

SEQ ID NO: 106470 - protein, 160 aa, Triticum aestivum
  unsure (1)..(160): unsure at all Xaa locations
  Clone ID: PAT_TA_888.pep
FYTNLPGKCVDEIGMYIGKLTDLKFDSSKKHYHVKVFDKQRSDTTMSCKCTVQEDGKLVIHKVELNQIRQLVEDISCLSKDFDLRLMLRTKRILKNIDTHLXHLQPEVENAIKSLVSSAIVDPDAKGGLKWPLGFESIGVLTGLTTGAPLERFPMKLPSN

SEQ ID NO: 106471 - protein, 293 aa, Triticum aestivum
  unsure (1)..(293): unsure at all Xaa locations
  Clone ID: PAT_TA_889.pep
QVLLHDFPEFLCDYHFXFCDVIPSSCIQMRNVILSAFPRNMRLPDPSTPNLKIDLLAEISLPPRIMSDVDGALKSKHMKAEVDEYLKRPEGSSFLNDLKQKLLLPQNEANVAGTRYNVPLINSLVVYVGIQAVQQLQHNKANASASAQQMNQXPQVDVFQIETATEVFRNLIVNMDTEGRYLLLNAIANQLRYPNNHTHYFSFIILYLFAEATQDIVQEQITRVLLERLIVNRPHPWGXLLITFIELIKNPRYSFWARSFTRCAPEIERLFESVARSCGGKAAEEGVLADGSH

SEQ ID NO: 106472 - protein, 195 aa, Triticum aestivum
  unsure (1)..(195): unsure at all Xaa locations
  Clone ID: PAT_TA_890.pep
LGQFQHPMSFQAXMSQHQHNNFQGLGASPQFQQHVINQLLQEAKNTNSRALAHQQQQQQHHQQQQQQQQQHQQQQQSPSTPNANXGLASGAAVANIAASGEQAQHMNNGAAKGAVLMGMTGPSNLINSGARMVQRSSSFKSVSSNPAASGGNAATPKAESVHDMDDLEHLISHELVESGLFMGEQPGDGGFSWNI

SEQ ID NO: 106473 - protein, 79 aa, Triticum aestivum
  Clone ID: PAT_TA_891.pep
MSSTGWLWMIMERLKVGNAKLEEIDMLQEVTKQIEGHTICALGDAAAWPVQGLIRHFRPELERRIRDRAHSELLMAASA

SEQ ID NO: 106474 - protein, 225 aa, Triticum aestivum
  unsure (1)..(225): unsure at all Xaa locations
  Clone ID: PAT_TA_892.pep
IXYPITSLPLIAYCVLPAICLLTNKFIIPEISNYAGMFFILMFASIFATGILELRWSGVGIEDWWRNEQFWVIGGTSAHLFAVFQGLLKVLAGIDTNFTVTSKANDEDGDFAELYVFKWTSLLIPPTTVLVINLVGMVAGISYAINSGYQSWGPLFGKLFFSIWVILHLYPFLKGLMGKQNRTPTIVIVWSILLASIFSLLWVKIDPFISDTQKAVAMGQCGVNC

SEQ ID NO: 106475 - protein, 169 aa, Triticum aestivum
  unsure (1)..(169): unsure at all Xaa locations
  Clone ID: PAT_TA_893.pep
GVGIEDWWRNEQFWVIGGTSAHLFAVFQGLLKVLAGIDTNFTVTSKANDEDGDFAELYVFKWTSLLIPPTTVLVINLVGMVAGISYAINSGYQSWGPLFGKLFFSIWVILHLXYPFLKGLMGKQNRTPTIVIVWSILLASIFSLLWVKIDPFISDTQKAXAMGQCGVNC

SEQ ID NO: 106476 - protein, 250 aa, Triticum aestivum
  Clone ID: PAT_TA_894.pep
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTDTEKPRMRGPKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 106477 - protein, 275 aa, Triticum aestivum
  unsure (1)..(275): unsure at all Xaa locations
  Clone ID: PAT_TA_895.pep
MAATAVTLPTSAPAPFPVAAPSARRGLQLLRSPVPRRAIRVAASAATEAPPKPPPATPSGIILXDPAEAQKVHRLKTVYDTKVIPIITEEFGYTNVHQVPKLEKIVVNCGLGVDAGNNKGLEAAMKDLASITGQYPVKTKAKNSVASFKIREGNTIGIAVTLRGRVMFNFLDRLINLGLPRTMDFLGVNPNSFDGHGNYTIGLRDQGVFPEIPYEVGGKKNGMDVTIVTTAKTDNEAQRLLALLGMPFAENIKSDQFKKKRLKRHHFMSKGRGRK

SEQ ID NO: 106478 - protein, 500 aa, Triticum aestivum
  Clone ID: PAT_TA_896.pep
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEQPKGDDLEAMKVDTSFLNFAIDDPAKYPYIASMGVYVFKRDVLLNLLKSRYAELHDFGSEILPRALHDHNVQAYVFTDYWEDIGTIRSFFDANRALCEQPPKFEFYDPKTPFFTSPRYLPPTKSDKCRIKEAIILHGCFLRECKIEHTAFSRLNSGSELKNAMMMGADSYETEDEMSRLMSEGKVPIGVGENTKISNCIIDMNARIGRDVVISNKEGVQEADRPEEGYYIRSGIVVIQKNATIKDGTVV

SEQ ID NO: 106479 - protein, 150 aa, Triticum aestivum
  Clone ID: PAT_TA_897.pep
PSERIEPTSPPTHPAAPTSGAGRDGRRPLGEHQSSAQGAPVKSKFAESKLPKFKFLPEHRSPKPQVNRLISKYIDYLNTIQAKREDTFNTLQDQNMSKESLANASKTMNKKLHAMVKSAKEDLSEIVKLGGNAPAVPARFDTDVKVPPRG

SEQ ID NO: 106480 - protein, 96 aa, Triticum aestivum
  Clone ID: PAT_TA_898.pep
MAIRNVTAATRSLDGDMTVDEFKEWLRRFDVDRDGRISRDELRCAMRTIRTRFSGYKSKRGIEYADADGDGYVDDGEVDGLIEYAQKSLGLRIVAY

SEQ ID NO: 106481 - protein, 154 aa, Triticum aestivum
  Clone ID: PAT_TA_899.pep
WDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 106482 - protein, 668 aa, Triticum aestivum
  unsure (1)..(668): unsure at all Xaa locations
  Clone ID: PAT_TA_900.pep
HASEKFNSEIIFALIRSDLLDVKEYNVHLAKLIDGGRNKIATEFAMSLVQTLITQDSASISELQDVVDVLSKISRRSGSPELMQQVNEIARNNANNAPGFAFGKDKKVLPNRANKEENSVSDATVADSVGFQDQVAHLFSEWCQICDHPNASDAAYSRFVMQLQHIGLLKGDEFTERFFRILTELAVAHSLVSEQINAPGGLSQQSSHISYFPIDSYSKLVSVVIKNCSVEIGPNKGSLLPKILSVTIRVIQKDAEEKKASFNPRPYFRLFINWAEXTLSTSELHHDGANFQVLAAFANAFHVLQPSRIPSMSFAWLELVSHRTFMARLLTGNSQKGWPFFQRLLIDLFKFMEPYLRTADLLEPVHLMYKGTMRVLLVLLHDFPEFLCDYHFSFCDVIPSSCIQMRNVILSAFPRNMRLPDPSTPNLKIDLLAEISLPPRIMSDVDGALKLKHMKVDVDEYLKRPEGSSFLNDLKQKLLLPQNEANVAGTRYNVPLMNSLVLYIGIQAVQQLQANKANASASAQQINHSTMDIFQIETATEFFRYLVTNLDTEGRHLFLNAIANQLRYPNSHTHYFSFIILYLFAEASQEHIQEQVTRVLLERLIVNRPHPWGLLITFIELIKNPRYNFWNRAFTHCAPEIKQLFESVAKSCGGGAGKAVDDGSDVSH

SEQ ID NO: 106483 - protein, 96 aa, Triticum aestivum; identical to SEQ ID NO: 106480
  Clone ID: PAT_TA_901.pep

SEQ ID NO: 106484 - protein, 96 aa, Triticum aestivum; identical to SEQ ID NO: 106480
  Clone ID: PAT_TA_902.pep

SEQ ID NO: 106485 - protein, 250 aa, Triticum aestivum
  Clone ID: PAT_TA_903.pep
MKLNIANPTTGCQKKVEIDDDMKLRNLYDKRISQEVVGDLLGEEFEGYIFKIMGGCDKQGFPMKQGVLTPGRVRLLLHRGTSCFRGHGRRVGERRRKSVRGCIVSQDLSVINLVIVKKGKNDLPGLTDTEKPRMRGPKRASKIKKLFNLGKDDDVRQYVNTYRRSFTNKKGKTVSKAPKIQRLVTPLTLQRKRARIADKKKRIAKKKSEAAEYQKLLAQRLKEQRDRRSESMAKRRSKLSAATKAPAASA

SEQ ID NO: 106486 - protein, 500 aa, Triticum aestivum
  unsure (1)..(500): unsure at all Xaa locations
  Clone ID: PAT_TA_904.pep
PRVRKTCYVQFPQRFDGIDLHDRYANRNIVFFDINMKGLDGIQGPMYVGXTGCCFNRQALYGYDPVLTEADLEPNIVVKSCCGGRKKKSKSYMDNKNRMMKRTESSAPIFNMDDIEEGIEGYEDERSMLVSQREXEKRFGQSPIFTASTFMTQGGIPPSTNPASLLKEAIHVISCGYEDKTEWGKXKIGWIYGSVTEDILTGFKMHARGWISIYCMPPRPCFKGSAPINLSDRLNQVLRWALGSVEILFSRHCPIWYNYGGRLKLLERVAYINTIVYPLTSLPLIAYCVLPAICLLTNKFIIPEISNYAGMFFILMFASIFATGILELRWSGVGIEDWWRNEQFWVIGGTSAHLFAVFQGLLKVLAGIDTNFTVTSKANDEXDGDFAELYVFKWTSLLIPPTTVLVINLVGMVAGISYAINSGYQSWGPLFGKLFFSIWVILHLYPFLKGLMGKQNRTPTIVIVWSILLASIFSLLWVKIDPFISDTQKAVAMGQCGVNC

SEQ ID NO: 106487 - protein, 157 aa, Triticum aestivum
  Clone ID: PAT_TA_905.pep
MSSSSLSPGGGRLSGSDGDSGATFSAGDNRREKRRLSNRESARRSRLRKQQHLDELVQEVARLKAENARVLARANDITGQFVRVDQENTVLRARAAELGDRLRSVNQVLRVVEEFSGVAMDIQEECPPDDPLLRPWQIPYPATAMPIAATATHMLQY

SEQ ID NO: 106488 - protein, 855 aa, Triticum aestivum
  unsure (1)..(855): unsure at all Xaa locations
  Clone ID: PAT_TA_906.pep
MSGAPRSNLGLVPRDMNGSLPVSTTNSSGPSIGVSSLVTDGNSSLSGGAQFQQSTSMNADSFMRLPASPMSFSSNNISGSSVIDGSIMQQSPPQEQMQKRRASSVTSQPVIDAAAAFHAQKKPRVDIRQDDILQQQLIQQLLQGQSSLHLQGQHNPQLQALIRQHKLAQIQQQQQHQLSQQFPQHQHSQVGIPRQPQLRPPLAQPGIQLAGPVRTPVESGLCSRRLMQYLYHKRYRPDNNPITYWRKLIDEYFAPRSRERWCVSSYEKPGNTSAAIPQTSPGTWRCDICNTHSGKGYEATSEILPRLCQIRFDHGVKDEYLFLDMPNEFRLPNGLLLLEHTKVVQKSIYDHQHVTHEGQLRIIFTPELKIMSWEFCSRKHDEYVTRKFLTEQVTHMLRATQSYQATVTKNGPAGLSNDEAQKACNEFASASRQLAKNIDHHSLNEHGLSKRYVRCLQISEVVNHMKDLIEFSHKNKLGPIEGLKNYPKQXAGPKLTVQNLHDSKAVKTEMSPHVNNEVPGVGATSNNPAESCSTKQLPTHSEKLKCKSGFASAGGXQNAAAMNSYQNLFRSSSANQGLLQQEASQNAAALNNYQNMLRGSSPNQSLLQQEASSIFKGPTAVHXGIQLEASRSFRAAQLGQFQHPMSFQQGMPQHQHNNFQGLGASPQFQQHVINQLLQEAXKNTNSRTLAQQQQQQQQQHHQQQQQQQQQHHQQQQQQQQQHQQQQQQQQHQQQQSPSTPNANGGLASGAVVTNSAASAEQAQHMNNGTAKGAAPMGMTGPSNLINSGAGMVQRSSSFKSVSSNPAASGGNAVATPKAESVHDMDDLEHLISHELVESGLFMGEQPGDGGFSWNI

SEQ ID NO: 106489 - protein, 250 aa, Triticum aestivum; identical to SEQ ID NO: 106485
  Clone ID: PAT_TA_907.pep

SEQ ID NO: 106490 - protein, 250 aa, Triticum aestivum; identical to SEQ ID NO: 106476
  Clone ID: PAT_TA_908.pep

SEQ ID NO: 106491 - protein, 168 aa, Triticum aestivum
  unsure (1)..(168): unsure at all Xaa locations
  Clone ID: PAT_TA_909.pep
MSSSSLSPGGGRLSGSDGDSGATFAAGDNRREKRRLSNRESARRSRLRKQQHLDELVQEVARLKAENARVLARAXTSPGSSCAWTRRTPXCSGRAPPSSATGXAPSTRCSASSRSSAASPWTSRRSARLTTPCSGRGRPRTLPPPCPSPPPPRTCSSTDRSGDDWVNN

SEQ ID NO: 106492 - protein, 157 aa, Triticum aestivum
  Clone ID: PAT_TA_910.pep
MSSSSLSPGGGRLSGSDGDSGATFAAGDNRREKRRLSNRESARRSRLRKQQHLDELVQEVARLKAENARVLARANDITGQFVRVDQENTVLRARAAELGDRLRSVNQVLRVVEEFSGVAMDIQEECPPDDPLLRPWQIPYPANAMPIAATATHMLQY

SEQ ID NO: 106493 - protein, 250 aa, Triticum aestivum; identical to SEQ ID NO: 106485
  Clone ID: PAT_TA_911.pep

SEQ ID NO: 106494 - protein, 250 aa, Triticum aestivum; identical to SEQ ID NO: 106476
  Clone ID: PAT_TA_912.pep

SEQ ID NO: 106495 - protein, 505 aa, Triticum aestivum
  Clone ID: PAT_TA_913.pep
MALRWALLRSAEISPGRKAALEYLHSLSKAQPTRSISCTGLHPAGRSFSTQAATTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 106496 - protein, 250 aa, Triticum aestivum
  Clone ID: PAT_TA_914.pep
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSIRGCIVSQDLSVINLVIVKKGENDLPGLTDTEKPRMRGLKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 106497 - protein, 250 aa, Triticum aestivum; identical to SEQ ID NO: 106476
  Clone ID: PAT_TA_915.pep

SEQ ID NO: 106498 - protein, 505 aa, Triticum aestivum
  Clone ID: PAT_TA_916.pep
MALRWALLRSAEISPGRKAALEYLHSLSKAQPTRSISCAGLHPAGRSFSTQAATTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAHASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 106499 - protein, 531 aa, Triticum aestivum
  unsure (1)..(531): unsure at all Xaa locations
  Clone ID: PAT_TA_917.pep
MSSMQFSSVLPLXEGKACISPVRREGSASERLKVGDSXSSIRHERASRRMCNGGXAPPPPARSACSPPTPAQQTPLFSGRPSXGITPIRTRSRPXILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMSLCEQPPKFEFYDPKTPFFTSPRYLPPTKSDKCRIKEAIILHGCFLRECKIEHSIIGVPSRLNSGSELKNAMMMGADSYETEDEISRLMSEGKVPIGVGENTKISNCIIDMNARIGRDVVISNKEGVQEADRPEEGYYIRSGIVVIQKNATIKDGTVVYSTAGSA

SEQ ID NO: 106500 - protein, 523 aa, Triticum aestivum
  unsure (1)..(523): unsure at all Xaa locations
  Clone ID: PAT_TA_918.pep
MSSMQFSSVLPLEGKACVSPVRREGSACEXLKVGDSSSIRHDRASRRMCNGGRGPRXTGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAXVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEAAGPGEGYYIRSGIVVIQKNATIKDGTVV

SEQ ID NO: 106501 - protein, 140 aa, Triticum aestivum
  Clone ID: PAT_TA_919.pep
CQKEREPDDRPPHPAGRLGERQGATRDRVHVFQVVVHPVHGSPQAAFPSSPGEAESKIAGAVGAGSRHSEGRSCRPTCNRPYTKRAACRDRRPAMQPRVASLARRRGLTKLLSSVQRGTRLAVRRGRRQAMRPGKPPSAS

SEQ ID NO: 106502 - protein, 184 aa, Triticum aestivum
  unsure (1)..(184): unsure at all Xaa locations
  Clone ID: PAT_TA_920.pep
GPPGPRNPAGGPEKDALFTSIRRTVKNIPKEAPAQFYVDNVLPRIKEKKIMSIKPFVRVRGYDNVPMKINRLRCRVNYHALKFLPGIEEMADKLATRMRNRTGSVNPYMALHLRFEKGMVGLSFCDFAGTREEKAMMAEYRQKQWPRRFKNGSHLWSXALEKRKEGRCPLEPGKIGFILRAMGY

SEQ ID NO: 106503 - protein, 304 aa, Triticum aestivum
  unsure (1)..(304): unsure at all Xaa locations
  Clone ID: PAT_TA_921.pep
LVLLAVLACVALAALVSAPSVWSRLNAPYLCRXDGIRLQCPGVSNSLWENPHAAATSWKPCAERGSDEISDLVSENETSGYIFIHAEGGLNQQRIAICNAVAIAKIMNATLILPVLKQDQIWKDQTKFEDIFDVDHFINYLKDDVRIVRDIPDWFTEKDELFTSIRRTVKNIPKYAPAQFYVDNVLPRIKEKKIMSIKPFVDRLGYDNVPMKINRLRCRVNYHALKFLPGIEEMADKLATRMRNRTGSVNPYMALLLGSVEGMAGGSFWHFAASSQGSALAAECRPNPSPSPLMVTGPYARSGQ

SEQ ID NO: 106504 - protein, 73 aa, Triticum aestivum
  Clone ID: PAT_TA_922.pep
MPFELMEVEFRMHRARFELRKSNSGCIELVNKTDQRVAFKVKTTNPKKYAVRPTSGIVPPGGSCGITITMQAP

SEQ ID NO: 106505 - protein, 162 aa, Triticum aestivum
  unsure (1)..(162): unsure at all Xaa locations
  Clone ID: PAT_TA_923.pep
PRVRLCALAVFLLGARTYRYYASDGKQRSLFARAGEAFGAWRSRRRKSSPLAVSDSHEGQTQAHWTETSAPEGCSQIWATCLIYAVAFSQSSTFFTKPSATLDRHVGKRVQVPPASLSPSTFITXMRFMPIYDRAIMPLPRAAHGPLLEHHQALPVGLRARR

SEQ ID NO: 106506 - protein, 130 aa, Triticum aestivum
  unsure (1)..(130): unsure at all Xaa locations
  Clone ID: PAT_TA_924.pep
VLTSTDDNYSYPVQEQITELSAGKMSSSLATLQHLRYLDLSXNDFNGTSIPVFLSSLKNLRYLNLSSAGFSGRIPAQLGNLSKLEYLDVSWNYYYYYGNKPYIKKNAXLXLLRXLXDLXYVDLXFVREWV

SEQ ID NO: 106507 - protein, 330 aa, Triticum aestivum
  Clone ID: PAT_TA_925.pep
MASDQNKDSKSEGLSEAKKGASPTGGAGLPSPFDFSNMSSLLNDPSIREMAEQIASDPVFNQMAEQLQKSAQGAGEQGVPNLDPQAYMETMTQVMQNPQFMSMAERLGNTLMQDPAMSSMLENLTSPAHKEQLEERMARIKDDPSLKPILDEIERGGPSAMVKYWNDPEILQKIGQAMSLNFPVDAATSTVLSGPQETDEEGEDDDESIVHNTASVGDAEGLKKALDGGANKDEEDVEGRRALHFACGYGELKCAEILLEAGAAVDALDKNKNTPLHYAAGYGRKECVDLLLKHGAAVTLQNLDGKTPIEVAKLNNQDEVVKLLEQDVFL

SEQ ID NO: 106508 - protein, 361 aa, Triticum aestivum
  unsure (1)..(361): unsure at all Xaa locations
  Clone ID: PAT_TA_926.pep
MAGEGEVQVIESCFGMAGEEEVQVVESSFPPPPLVPPSRAFPPPPLVLRRPCSGDAPLVLAYRRPAPASALVPFVPRAGPPWADALGPFYPLAGRVGAALPRWLTVASTGKGLLRLLALSRRSRGDVFVPTPSSTQGRLFVPHVDNSDGLLWAAQVTFLKCGGGGLSXAHLLPAWAASAVVRDWAVVKTPYHDRNLLIARNPPFVHPDTLSLFCLKVNMSQLSGPVVNEVFTLGKGQVSTLKRICGGDMSTFSVVSAHMWQCMCLARRLPPNCTTRLVFPANVRRSMTPPLPDGYFGNAITYVSVANVARGIASGDLAYIVRRIRDSLSRVDDELVHSAVDYLELAKTDNRPATGVCQRQI

SEQ ID NO: 106509 - protein, 139 aa, Triticum aestivum
  Clone ID: PAT_TA_927.pep
SYRTLDFYTSMQVFIHRSNFCLLRYCTSYEPPDFFQALKVRAPEDIPCHAIVLVGAVKKKGKLSYYFLNAWKRFCARRSEDGTLLAYGIGKVNANRSYRNVIKVSCFKEAPNERSFTQNMKLNTALLVGDLPKREPTFR

SEQ ID NO: 106510 - protein, 141 aa, Triticum aestivum
  Clone ID: PAT_TA_928.pep
AGRSGNPTVNAAKEDAVERIKEITGGRGVDVAVEALGKALTFSQCTQSVRDGGKAVMIGLAATNVVGEVDITRLVRRQVKIIGSYGARARQDLPQIVKLAESGAFNLENAISRKCKFEEANGAYEDLNQGKIVGRAVVEIM

SEQ ID NO: 106511 - protein, 413 aa, Triticum aestivum
  unsure (1)..(413): unsure at all Xaa locations
  Clone ID: PAT_TA_929.pep
MSLSTASRRALSRIGGALRRSFSSSSVPDASGYHVSGGPSFMRAAVFWEPGRPLTMEEFRMPRPKAGEVLVKTKACGVCHSDLHVMKGELPFAIPCVVRSEITGEVDDHGMDTPGEIVKVFXVGNHVVGAFIIPGGIGFYCGKGQEAFFEFFFEKIVAKXTLYYGKTRLFLRSNGKPVYMYSMGGLAEYCVVPANALAILPNSCPYTESAILGCAVFTAYGALRHAAEMRAGDSVAVIGVGGGGSSSLQIARAVGAASIIMVVVLDDDNPKMQKLGAPPPVNAAKEPAVGSSEVRPGGGCPVGDLEAXCLPAPAAQCTQPATRPRDFFLGGIAAPSVVGAVDITRLVRRQVKIIGSYGAGARQDLPQIVKLAGSGAFHRENAISRKCKFEEANSAYEDLNQGKIVGRAVVEIM

SEQ ID NO: 106512 - protein, 194 aa, Triticum aestivum
  Clone ID: PAT_TA_930.pep
MAASSQTEESMMNYDSPACGGDAADTVIEDLPTDVLSLMLRRLDGASLAALGCASSSFHDLATDPDTWRGLCLALWPSVAGLLDNSCCRGTGDGFHRALFADAFPFPATTAAAPGTVAPALPSRLVSAVDLHHKGVCIMSRVVETDASSAWFLGSPFRVDALLQEGFSAASSITPAELTLSWLLLDPTSARVVN

SEQ ID NO: 106513 - protein, 106 aa, Triticum aestivum
  Clone ID: PAT_TA_931.pep
PRVRPRLASPPLPSSAAFLPHFPGAGLSDPGASFRETLVGLVLVPTTALDVKFVRVAHKITIHFGGAGLLKSDDQEAMWRGAMMLSENAKNMMCICAAAQDDGAMD

SEQ ID NO: 106514 - protein, 141 aa, Triticum aestivum
  Clone ID: PAT_TA_932.pep
ACSYLQRIIWIVICCTIHIRKPEYDTLFQREMTANTLVEALLLFAKLSLQDVYTESTNRLSVDTNKTDTSSTTIPLLRLELHLKKGRPIEKKRDHCPYALTKPFFCEKMESEKLDQQAKKEQGKEQGTSKTEKPKVGRKPM

SEQ ID NO: 106515 - protein, 284 aa, Triticum aestivum
  unsure (1)..(284): unsure at all Xaa locations
  Clone ID: PAT_TA_933.pep
MVAIMVERWAGFGSATATVIFLWPVVQKYVPPTFRLYLTAWAAKLAACFNPYLQITISEYGAERFQRSDFFLAVEAYLSEACTRRARKLKAELVKDSKNLRVTVDDHDEVTDDFSGTTIWWYASKRQSKAQVISFYPGEDERRFYQVVFHRRHRDLVVDSYLPFVLGEGRAVTVKNRQRRLFTNNASRNWNPYRSKSVWSHVPFEHPATFDTLAMHPDEKEAIVDDLMAFQESKDYYAKVGKAWKRGYLLYGPPGTGXSTMIAAMANFLDYVAHARGAGAIAPL

SEQ ID NO: 106516 - protein, 149 aa, Triticum aestivum
  Clone ID: PAT_TA_934.pep
SSILKTATPGILKKMPSPLVFQFWFFPRGVESAGSRVSGSSPASRRASCRFLLLLPHRHFLLLLLRHARAALTRRMLGGILRWARHLSPSIDSSPASSPRSRRDFVGNWGFARRRRSEEWSGNGEWEDGGKKSQSPSRSRAIRPCLVPN

SEQ ID NO: 106517 - protein, 101 aa, Triticum aestivum
  unsure (1)..(101): unsure at all Xaa locations
  Clone ID: PAT_TA_935.pep
AAAVALGRDGAPVGGVRGAGAGLLLALLLLQQGVVVGEXSRPKSRMVSLACCCCCCATAGRMNGSCENESTLRTSCGVAMAGETPSLLCYVREPGEFSAPW

SEQ ID NO: 106518 - protein, 177 aa, Triticum aestivum
  Clone ID: PAT_TA_936.pep
MAATLLRRALQLRRALPSPASLRTLLPAASSRLLSVTASTQQNTAGTAIDLSNDESRRRLVNSLMYRSKQRGFLELDLVLGTWVEQHVRSMDEANIRSLLQILDLENPDLWKWLTGQEQPPETVNSNPVFAAIKSKVTDNLSKHSSPETRSAPGQPWVRGWDDKDKRGLDGPKYGNQ

SEQ ID NO: 106519 - protein, 116 aa, Triticum aestivum
  Clone ID: PAT_TA_937.pep
TPARTGTSRPDPRVRPRVRRAGMGRGDTAHQPATPLPPRFAIPSLPPPPPRLPWRPRSSAGRSSSAAPSPLQLPCAPSSPRPPAASSPSPPPPSRTPPAPPSTSPTTRAAAASSTV

SEQ ID NO: 106520 - protein, 205 aa, Triticum aestivum
  unsure (1)..(205): unsure at all Xaa locations
  Clone ID: PAT_TA_938.pep
MPNSRDLDHLLARSPVLDTLAIVFSMMFERVHLRSQSLKCVLLRRCLVEEVAVLNSPLLERLVMWKLVVSEDDSVAVTVKIAAAPKLRVLGYLEPRIHQLQIGDNVIKPDTKVSPSTMVPSVKILALKVNFGVFEEVSMLASFLRCFPNVETLHIEVXITDEPTGRHHARFWRELRPIXCLKSHVKKMMIPEFXGEQSEINFLKF

SEQ ID NO: 106521 - protein, 212 aa, Triticum aestivum
  Clone ID: PAT_TA_939.pep
HSANSQSTSEFYRTKGRAEEVARSLFPETTIVRPAPIFGFEDNLLLKLAGVTNLFTSNNMQEKFYPVHSIDIGAALEKIFFDDTTAGQTFELYGPKKYSMEEISVMVDKEIYKQRRHLNVPKAILKPVAELLNKVLWWHTMSADEVEREFLDQVIDPKAKTFKDLGIEPGDIINFTYHYLQGFRRQNFYDLPPATEKEKREEKKYIHVLDEL

SEQ ID NO: 106522 - protein, 153 aa, Triticum aestivum
  Clone ID: PAT_TA_940.pep
CFALWSLRCIPCNFWAEGTKNCVLVSLSLVHLGYIISANFTKHFTSVVKNYDHAMPFVCVGTKPSAHVQQRENHRCKSFIRKPYLHGLIKENDICCDLTFRMSRRILSSNRSDNNCIPHHASNTNPTKITLTQAKNLTKQMFPQTNASIVHTV

SEQ ID NO: 106523 - protein, 74 aa, Triticum aestivum
  Clone ID: PAT_TA_941.pep
FHWSWCSELDERRHHNVGRNLKELSCAHLISLELTLNASLYVLSSYSRQLKQKFHNFHPVNERADFENLVVTHR

SEQ ID NO: 106524 - protein, 238 aa, Triticum aestivum
  unsure (1)..(238): unsure at all Xaa locations
  Clone ID: PAT_TA_942.pep
SSXSRGMESLSLYFLNXIKAGNSTSMEATSTSSSSTFVLDIFASHSSFSNAACFSCQHNLCAMQLGASRLNKRFLIIKLASQFIHLFVRNTDPANQVLLRTSELRLSQAVSPASHQAAPATQRALPSASAPDPAAAASWPAWFLLASQPSAQEPSWPDAEPPCRPSRPPSWRRARRGRARPGSWTWRPGPPASRPSRSSPKAAAAAVAGRAALGVDCRGGRSALVRCYHFLPACLRRG

SEQ ID NO: 106525 - protein, 57 aa, Triticum aestivum
  unsure (1)..(57): unsure at all Xaa locations
  Clone ID: PAT_TA_943.pep
DALEIXFSCQHGMPERKMCHPXQDHALLEEVSGWINEKAMMPIWXKMTPNIVGITDG

SEQ ID NO: 106526 - protein, 195 aa, Triticum aestivum
  Clone ID: PAT_TA_944.pep
DGFDPMRYLRIVRKEGLEISQPALDHRSQIHHRLTARARHGGTVHRRFYKTAGGGRCYGNSTGPPCTGWVEMMVPVFSRAAWRCAWRMIQNDLVFAWGLDFKLGYCAQGDRSTNVGIVDSEYVLHRGIPTLGDGGGKGPAPKAKASSATSADRYAVRLRSYKELQIFNKRWKEAVAEDMCWTDPYPQPPTPTPKG

SEQ ID NO: 106527 - protein, 72 aa, Triticum aestivum
  Clone ID: PAT_TA_945.pep
PASLFSSSTIHDVPCSNFDFSFRCYFLYKSASNTQFMFVVLVLLILDTFPCLFCERAPDVVSMLILKRYLFG

SEQ ID NO: 106528 - protein, 286 aa, Triticum aestivum
  Clone ID: PAT_TA_946.pep
MLFRTHPSGSPTTKVSYTITSSAVAPDGTEAIVGAQEGKLRIYTIGGDTVTEEAVLEKHRGPITTIHYSPDVSMFCSADSNREAVAWDRATREVKLKNMLFHTARVNCLAWSPDSRFVATGSLDTGAIIYGVHQQAANRTTIQPAHRGGFHGICYPDDDTVMSHFDNACMRVWKLVSSVGAQAPPDLFVAMDAKLRKHRYGRPLVPCFPQAAVAALSSLCFFFLCDVILSCAPGRKNPTVIVSFPRIVWFCGVLRIQGVMVCCECFVPSAVSWPRGRWTPARSSTT

SEQ ID NO: 106529 - protein, 169 aa, Triticum aestivum
  Clone ID: PAT_TA_947.pep
QQQQQQQQQHTGCDSFIHSFTATLQYVPTSIKYKYYKQTKLHTSRSSLEQCKCNGVPSPSRLISSHLISSHLLQHTHLNARSLPHLTHPLVLLLLAAACCCCCLVILEPGATTTFCAAAAADVQGLAGIDALFDLTSPPCRLLFLATAAAAAGSWFSTSPCMLLLFRPA

SEQ ID NO: 106530 - protein, 219 aa, Triticum aestivum
  Clone ID: PAT_TA_948.pep
TRGLAACGVMMSIVSTAADLMQDFKTGYLTLASPRSMFISQIIAAGLGSVVAPPVFWLFHPAVGGTGLPRAGPPAPAAVGYRNMAILGVDGFSSLPKHCLTLCYVFFAGAIIINLVRPTRPAKVARFIPLPMAMAIPFYIGSYFAIDMFVGTVIVFVWGIVNKAKADAFAPAVASGLICGDGIWTLPQSILALAKVKPPICMKFLSRSVNANVDAYLGN

SEQ ID NO: 106531 - protein, 64 aa, Triticum aestivum
  Clone ID: PAT_TA_949.pep
LGHQHACISPSHLRIRPTVNILKLVAKSKCATTSLLHRSDLCMQVMCVLVQCSYIKAWWPCAAS

SEQ ID NO: 106532 - protein, 96 aa, Triticum aestivum
  unsure (1)..(96): unsure at all Xaa locations
  Clone ID: PAT_TA_950.pep
CKKKCIVGCYKDLPPVCYKMCVSQTCLTLPPCKRGDCFKACGIKCFHNQPYPGPNPGPTPPRPMPPPPSPPKPXPRPSPMPPKPSPPKAAAKANGY

SEQ ID NO: 106533 - protein, 95 aa, Triticum aestivum
  Clone ID: PAT_TA_951.pep
MAWRASLSRNVKEIRFLFCQSSPASGPAREFVKKNYGDIKTRNPTLPVLIRECSGVEPQLWARYDMGVERCVRLDGLTEAQIDKKLEELAKAGVA

SEQ ID NO: 106534 - protein, 96 aa, Triticum aestivum
  unsure (1)..(96): unsure at all Xaa locations
  Clone ID: PAT_TA_952.pep
MAWRASLSRNVKEIRFLFCQSSPASGPAREFVKKNYGDIKTRNPTLPVLIRECSGVQPQLWARYDMGRKVTIFXLHGLTEAQIDKKLEELAKAGVA

SEQ ID NO: 106535 - protein, 100 aa, Triticum aestivum
  Clone ID: PAT_TA_953.pep
CEMFMSQKTAHHVIQMHVLFALQSVVRAARYSSVKRVPQSNRISKILVLRLLRVVCENIQEPVKERQAACGHGNGTQVLMVAAWSFLVFFHGRRCVQVSF

SEQ ID NO: 106536 - protein, 209 aa, Triticum aestivum
  Clone ID: PAT_TA_954.pep
MEKSSGGENVSSSVDHDAQVTNPLPDEQLKNMDRIFEGTTNLSNGITFRGPGVNGSNAVGEHEASGSNASSNPNMSTPSMVSESKTDPTPVNVTSNYAGSVTSNSTSLKGQHEQPVNSTAASNNQTQLLADLTSAELNSPPNGTTVASGSTDAQKATSRDGDNGGNNTDTSSTPASNKEDGGGDAQKEDQDVSTKIMNKAIGEGEVLLE

SEQ ID NO: 106537 - protein, 30 aa, Triticum aestivum
  Clone ID: PAT_TA_955.pep
TGFILNSQNSPWYFTKTLFNQNKRMQSAPS

SEQ ID NO: 106538 - protein, 188 aa, Triticum aestivum
  Clone ID: PAT_TA_956.pep
PRVRHASDHAGYQEQMSHWPEQPVNVIIKWLKSHNKSWTVADFGCGNAAVAKNVKNKVFSIDLVSDDPSVIACDMAHTPLEPSSVDVAIFCLSLMGTNFPSYLQEANRVLKPSGWLLIAEVRSRLDPNTGGADPDKFSEAISQLGFSLVSKDEKNKMFVLFYFRKKEKSKVAKNIEWPQLKPCLYKRR

SEQ ID NO: 106539 - protein, 207 aa, Triticum aestivum
  unsure (1)..(207): unsure at all Xaa locations
  Clone ID: PAT_TA_957.pep
LRCIRHDRCQRGEXVVXAVLVRAQHRVVAGLGLLLVLLLPLLLPVLLLLLVVLGSGANAGEEAAGREEVARGRRGGGAGVPLDDDVLRPARGHAAYHRGALLLPANMAACQGQGGREPAAGCVVAGARHGVEETSGDDQDQGGYGWVPCEEPQEVIHLPTSPFLFSTAVPLYCIFLSENLCNYKFGLRLTLTNTTFIFSKKKKKNKI

SEQ ID NO: 106540 - protein, 115 aa, Triticum aestivum
  Clone ID: PAT_TA_958.pep
MPRLLLLCLVSSHFAVTAVMARQFPVFLVDGGAMAADAPSASASDASRLHRHSLLESRFAGSPMGSSDHGLRHGPFDRHFAGGKIILGGLAVAIIAAVFCYIRITRAKKIVEPKT

SEQ ID NO: 106541 - protein, 69 aa, Triticum aestivum
  Clone ID: PAT_TA_959.pep
LVNLVEESQHYTCFGGLNLQKAQSVLFSDDQTKYFCSSKGLMCHLIAWCGRTPMFINSIMPTAVHLIPW

SEQ ID NO: 106542 - protein, 121 aa, Triticum aestivum
  Clone ID: PAT_TA_960.pep
AGPGIPKKTILSFLDQIKYCSRGRSAASWESALSKFTHRCYFFSYASLFMGSLKPSVSMASVFLRGAQRVQLYQSATQINIDAIVVFKIGNATKQWMSAESSVHIYLPPLPLYFHETGFLS

SEQ ID NO: 106543 - protein, 440 aa, Triticum aestivum
  unsure (1)..(440): unsure at all Xaa locations
  Clone ID: PAT_TA_961.pep
TGKHLAEHCRAEYPKVTNFILWILAELAVVACDIPEVIGTAFALNMLFKIPIWCGVLITGLSTLMLLFLQQYGVRKLEFLIAFLVFLIATCFLVELGYSKPNSSEVVXEGLFVPEIKGDGATGLAISLLGAMVMPHNLFLHSALVLSXKVPRSVHGIKEACRFYMIESAFALTVAFLINISIISVSGAVCSADNLNPEDRMNCNDLDLNKASFLLKNVLGNWSSKVFAIALLASGQSSTITGTYAGQYVMQGFLDLRMTPWLRNLLTRSLAIVPSLIVSLIGGSSAAGKLIIIASMILSFELPFALVPLLKFTSSKTKMGPHTNSRFISVLTWAIGSFIMVINIYFLITSFVRLLLHSGLSTVSQVFSGIFGFLGMLIYIAAILYLVFRKNRKCTLPLLESDAKLGDAGHTEGEGSLGHLPREDISSMQLPHQRAASDLD

SEQ ID NO: 106544 - protein, 142 aa, Triticum aestivum
  Clone ID: PAT_TA_962.pep
RDLTPACVRKVVPPSSPSEEMGSYWGYKVRYASNLSGVINDSPYKEGYDHIIGTSEHGETIISSELILPSFRHLLIAFGGLAGLEESIEEDPNLNGKGANDVFPSYLNTCPNQGSRTIRTEEALLISLQYFQDPIRRAGMAS

SEQ ID NO: 106545 - protein, 106 aa, Triticum aestivum
  Clone ID: PAT_TA_963.pep
ISGHKMLWIAYVLMSVAFHVFCLVYFIWIRRWKIKVTILGVVTIILTSRCLQQCRHTCPSCCHCHPDRQLECLVRGSQVQGKPPSSLSLFIVSRRTAVDISYRLYI

SEQ ID NO: 106546 - protein, 205 aa, Triticum aestivum
  Clone ID: PAT_TA_964.pep
MTAQTAEELAAHIEQEQLEAKKTEAEEVVVEDDDDDDDDDEDDDDNDDLDGQEGDASGTSKQSRSEKKSRKAMLKLGMKSITGVSRVTVKKSKNILFVISKPDVFKSPNSETYVIFGEAKIEDLSSQLQSQAAEQFKAPDLSQMISSPEASGMENDDNEVVNDEGVEPKDIELVMTQAGVSRAKAVRALKSANGDIVTAIMEVTT

SEQ ID NO: 106547 - protein, 156 aa, Triticum aestivum
  Clone ID: PAT_TA_965.pep
ELMAFYMNLRRSKNNETAMELFGDCSLTFDDDQPTLSCNLFDSMRVDISLTCSICLDPMFDPVSLSCGHIFCYLCCCSAASVTIVDGLKSADHRSKCPLCRQAGVFPNAVHLDELNMLLSYSCPEYWEKRMQMERVERVRLAKEHWESQCRAFLGV

SEQ ID NO: 106548 - protein, 78 aa, Triticum aestivum
  Clone ID: PAT_TA_966.pep
ASSDLCSKTTTKISRTCQCLQVQQTRCTTLSLHQLNCMSSKPSAAVELPNRQLLVCRSYKPPSTCVSLENWKLKMDLS

SEQ ID NO: 106549 - protein, 81 aa, Triticum aestivum
  Clone ID: PAT_TA_967.pep
VTSRSMVVRHSFLLQSRKRVPRGRRRVIQSAINQFDGDAAGWRPTCVAGEVGGATARSYVRTRCGSDALTRTASSRCGACA

SEQ ID NO: 106550 - protein, 296 aa, Triticum aestivum
  Clone ID: PAT_TA_968.pep
HISVRGYDIIDEAKKELEAKCPNTVSCADIISLATRDSVKLAGGPDYAVPTGRRDSLVSNREESDDNLPGPDIPVPQVTADFVKAGFTAEEMVLLLAGGHSIGKVRCIFIEPDASPMEAGYHASISKLCDGPNRDTGFVNMDQSNPNVVDNSFFANAIAEKMPRTRGRLLAIDEKTGPLLKDMLNKPKEDFMSAFGKAMEKLTVLKAITGKDGEVRKACNEFNNPMSSDGPSVIRISSVDPEVLDGLAAGNKQEQVSSIVSQGHADAQPEAAAGNADAKAEKPHKKASGKHKLRSD

SEQ ID NO: 106551 - protein, 75 aa, Triticum aestivum
  Clone ID: PAT_TA_969.pep
RNSGTRRVRHGGKAAYVLHSLVGFAEGRSATVEEGGIPVLVEMVEVGTSRQKEIATLSLLQIRDENAAFKTMVGR

SEQ ID NO: 106552 - protein, 84 aa, Triticum aestivum
  Clone ID: PAT_TA_970.pep
TLWLVPKWHMKIWDEFKHSAWSQHARVARMYPWTVVLGQRSRTHVVVCSEKTDTRLDPIFSPFVVQTIAPYPVPSNHLTHSRSC

SEQ ID NO: 106553 - protein, 142 aa, Triticum aestivum
  unsure (1)..(142): unsure at all Xaa locations
  Clone ID: PAT_TA_971.pep
AKTKMSSSNSKAHNAVRQXKLKKNNKQYEDLIQKCRDNPESFEDHIADKVSDDDSGDDGSDVDIVDPEPDPDDSSDDNKSELGGAWEKKLSKKDEIMDKQFLKDPSEITWDIVDKKLKEIVASRGKKGTGRIERVEQLTFFD

SEQ ID NO: 106554 - protein, 176 aa, Triticum aestivum
  Clone ID: PAT_TA_972.pep
FFPSDFDEPAMLLVDGPGARNGPSLTDLGAPQLWPMDYFQPARNRLRLRCYAVMSSVLAHKTIVPPSRGGRTRPAMEHGTSSAAALWGHEHLPLLARARSKDSVEYILQALWRTRRTGLDAADRAIVRDILQLPSDSELDPVRTYQLLISAPSPPSAPLLAPGARHFCKSSLAGRG

SEQ ID NO: 106555 - protein, 83 aa, Triticum aestivum
  Clone ID: PAT_TA_973.pep
KSTEDNINCIWPLQSTSPTQNTPTHQAHATQPKNAGPARARQPRRQGARAREQAEGSRRVLTFLRLTRRWGDSWGRRLASTSS

SEQ ID NO: 106556 - protein, 98 aa, Triticum aestivum
  Clone ID: PAT_TA_974.pep
PILMCIYSILVYLLLWFFIPEEMGDIKVPRLLCVLLLMPLLLVPCSEAKTCEVASSTYLTIACRVDPCAKACHKEGFTKGLCYIYPPFTILCICEKEC

SEQ ID NO: 106557 - protein, 191 aa, Triticum aestivum
  Clone ID: PAT_TA_975.pep
VPPAGTRVRYIPGTTHDVTAFYEFNGVRVHHKVCAHGEDEDSGGQSSGSAVARSQAGLPIVLLHGFGASVFSWSRVMRPLARIAGAKVLAFDRPAFGLTSRTRRSGDDTKPLNPYSMAFSAMATLAFIDQLGPGKAVLVGHSAGCLVAVEAYFEAPELVVALVLVAPAIFAPRKGEKENSVGAGRGRQEGF

SEQ ID NO: 106558 - protein, 142 aa, Triticum aestivum
  Clone ID: PAT_TA_976.pep
PTRPPTRPLDSCQLMHHVLCVLFPMNDGHRHALWLWRRYRGDGGGCIITSLSSYYVLADCLLLGHYLSFVGSTMTLVRWRWLPFPWFWCTRNRVLCASNITSECVGMRKPSLDTSLPPLRCMLLQLWHRLQRSWPCRGMGSR

SEQ ID NO: 106559 - protein, 165 aa, Triticum aestivum
  Clone ID: PAT_TA_977.pep
RCTRENEWGVCVGEGARDYWRVRRPALLLTDPSHIGPQLASTSLAGFGKQLLVPGPPAPVCVVRPTSPAIAAARAAPRPGTPPGPPRLPAFKAGVDLQAVRRRGGLPLQPQLTDTNCIGPLTPTTEGPEETTSCVRPPSPASQVAFASPPSVALLQPPCRSKTTA

SEQ ID NO: 106560 - protein, 198 aa, Triticum aestivum
  unsure (1)..(198): unsure at all Xaa locations
  Clone ID: PAT_TA_978.pep
VTLYQRLPTNVTLPKELHPVFFLFVAAPSVASMAWAKINGEFDNGARIAYFIALFLYMSLAVRINFFRGFRFSLAWWAYTFPMTGASIATITYATEVTNVLTRTLSIGLSGIATVTVAGLLVTTMFHAFVLRDLFPNDVSIAITRRKPKFSKILAHFRSSSSDMKELVLSVSKSPNTDFRXPSVTDTDPSVTKGKAEP

SEQ ID NO: 106561 - protein, 402 aa, Triticum aestivum
  unsure (1)..(402): unsure at all Xaa locations
  Clone ID: PAT_TA_979.pep
TAVGKKAPGRPSRALLLAAPHNNLVSANFGSIMSSPPPSPSLPLPVTSSPPATTMTVASLLPAPGSSVGPAPAVLTPEEVFGVLRDLTQAVQEIHMFLAGSYGPPPAAPPIAASAPPWQPPHQAAFAALAGPLQLSSIATTAQPWLQWQPPLLAASAAPGAXKQQPLPLPGATPQQPLQLQXPPPVSSTAQYGMPYDGTAMTLFPSAPPPSRGVHIQQIKSLLSPSRFPSWIATRHVSXAVRLQAAARGLLACRRVREMRGLQLPLLQVALRCAKDLDLVRCVGDLGHALFSPQAATSKSATSAVEGAHPSSSFSIASPPLFHVRCRPTAIHMHSFCPDGVHGSRWLYMCMSKIKRPSLFQIENNKTSRDVKDLFLGVRFVLRRVMVISWLGCSSRTSCMSR

SEQ ID NO: 106562 - protein, 240 aa, Triticum aestivum
  unsure (1)..(240): unsure at all Xaa locations
  Clone ID: PAT_TA_980.pep
QRHNNLVSASFGSIMSSPPPSPSLSLPVTSSPPATTTTVTPLLPAPGSSVAPAPAVLTWEEVSGMLRDLTQAVQEIHLFLAGSYGSHPIAPPIVAPAPLWLSWQPPYQAAFAALAGPLQQPLQSPSIATTAQPWLQWQPPLLAASAATAQQPLQQPPPVSSTAQYGMPYDGSAMTSFPSAHPRTSSSVPVVAVRLVAMSAAVRLPAAVRVRVCLGCAAHRRPRAVVVAVXSTEPGGFAGP

SEQ ID NO: 106563 - protein, 219 aa, Triticum aestivum
  unsure (1)..(219): unsure at all Xaa locations
  Clone ID: PAT_TA_981.pep
PGARGVREALLTKISGETASATVNSGSLSDMSNLVNATLYGFEDYHGVDIGVVKAARLWYSSTAGEMPLEIQLQEGDTRLGFAVSRTEEGFIYISSVVDDDEDSEAPSTRSGLRDLFNRAKVASKLLIISRVSNEKVLPWXMISSSGAVRCFDTISLSQKLSLHRLALQPIQLHLLMWEKPVGVAAQRVVLSPKMPFPLSLPPQVPLSIIESPDIRVDA

SEQ ID NO: 106564 - protein, 151 aa, Triticum aestivum
  Clone ID: PAT_TA_982.pep
REAKPHRSPHTAAAPPPPPPPPPGSAVVDAAEPWPAARPSSSPRSSSSHWPSRRWPMPRRPPRRRSPPTPPRPTRRPPTRPRRGPPTDRRLPPGPRASPASRPTTTTTTTSEPECMPFWKDPLHADQIVRMDFSFETIIIIILLRVGLLPC

SEQ ID NO: 106565 - protein, 227 aa, Triticum aestivum
  Clone ID: PAT_TA_983.pep
LAPIQYSPSPSGSPEKNRRRPSAPWPRTKHSANAIGAASMGLYSDSDHEFDEGLNLVCHSCIITGDAVVHSSPPTLMPTGSTTHRKGVAAPSQVGPLPDPSPPSQPGRADHRGHLSPPLVMSGRAMERRRRGVLIILEGQGAPPAVGSRLLLGLPPPFVGPPPWWCCPRQWSRLWCRADLCFPPGSVSARGSCRGCWRLPASAACNRWIGRILLVSLLCWVLPAEDL

SEQ ID NO: 106566 - protein, 141 aa, Triticum aestivum
  unsure (1)..(141): unsure at all Xaa locations
  Clone ID: PAT_TA_984.pep
MHMRAISAAASGNGKAKVVIVMGATATGKSKLAVDLALRFGGEVVNSDKIQVHDGLPVVTNKATVREQAGVPHHMIGGVHPNADYAAAEFRRDATRAVESVLARGRLLIIGGGSNSYLEALLDGEPXFGRRYDCCFXLWVD

SEQ ID NO: 106567 - protein, 229 aa, Triticum aestivum
  unsure (1)..(229): unsure at all Xaa locations
  Clone ID: PAT_TA_985.pep
MMKPAGAGAGPGTGTVEVRVERPQRPPVHPNSARLRARPYYRRWTPWLVPAASIACVAVFLVTMFVNDCPNRSAGNCTAGFLGRFAFQPLKENPLLGPSSTTLLKMGALDVSKVVQGRQGWRLITCIWLHAGGXVHLLINVLCLLFIGIRLEQEFGFVRIGLVYLISGFGGSLMSALFIRASISRGASGALFGLIGSMLSELITNWSLYANKVAALLTLVLVIVVNLAL

SEQ ID NO: 106568 - protein, 336 aa, Triticum aestivum
  unsure (1)..(336): unsure at all Xaa locations
  Clone ID: PAT_TA_986.pep
MAAKGHQIHPADGAMKLSIGTDPGIDASVAIVMAFQAPGVHGPGLSSTFGTCTTADATRNPFVPCGKGGRPHVTVAERSAEALKGRXTEVAAYVYVSAGVGNVSVTGTDHHDSKSKTSPKSGWVARXVAVSPGEGLRCMLVGPSLTKPAQVSNKWASLFSKVRMTPVLRGASXLFGAGNATPAAEANIHSDPEAADMVFTSGADIAVVGLNITTQVSFTEADLXELRSSGGKQAQFLCDICKFYSDWHLXSYGDPAVFLARTRVSLAALVRPELFTFRKGVVRVETQGICRGHTSMDMGLKKFKSENAWSGYTPISVAWTVDKAKVVAFVMELLKN

SEQ ID NO: 106569 - protein, 232 aa, Triticum aestivum
  Clone ID: PAT_TA_987.pep
SVVAAEVPNVSNMQRMHMLQTKVQQPQQQQHAQQPPMGLMQPQSQHSLPQQSQQHLMSQFQSQPNQLQHQSGMQPQSSMQRRLQASGGMLLQQNNMDPIQAQRGLQEVSSSTSADSTAQTGDEDEDADYWQEEIYQMVKIMKDQYFADLSELFNKVCVKLQHVESMIRPPIPSEQYDRMKSFKTMLERILQMLQISKSIIQPAMRDRVPQYEKQIITILNCLRKPVQPQVQQ

SEQ ID NO: 106570 - protein, 301 aa, Triticum aestivum
  Clone ID: PAT_TA_988.pep
YNVLEELQRTDGFRCLEKSVVETGETGPWSLCTVTQVEETKIVLRMVPIFLSSVLGYIPVPLILNFTVQQGNTMDTKLGGVHISPATLFVIPTVFQMVILVLYDRFIVPFLRRITGYVGGVTHLQRIGIGFLSATVATGVAALVEAKRKRVAEENGLMEATTGIPMSVFWLTVQFFLLGVVDVTSFVGLLEFFYSEASTGMKSVGSSIFYCILGVSAWLGSLLIQVANRVTRRADGTGGWLDGTNLNMGKLDNFYWLLAVLELVALFVYTFFARRYVYRNEQKGLWMWTPRFQRKVPPLVM

SEQ ID NO: 106571 - protein, 180 aa, Triticum aestivum
  Clone ID: PAT_TA_989.pep
TRLISFLSFFLRLSLSLAAGCSLSVPPPAPASRGERAAERALPTRSTPSGDTRTHSRAVPPPSPQLPARSPTFPNKPAGASRGWTSRPECAAGTEIKGRRGKGMDEAVQMARTMKEKLSRCFQRVRVPGPCKMSYAHASKARWFQFSTIRQPVILIQASLFLLTWRKSALKIIAAPMLKL

SEQ ID NO: 106572 - protein, 519 aa, Triticum aestivum
  unsure (1)..(519): unsure at all Xaa locations
  Clone ID: PAT_TA_990.pep
QHFEATIKSITTHNQGQAKASLPAGCRGRPRRMQRSAWGSLLGSCLGGGGGKTGKQVRPGPGPRKRESSAAAGAGQRLSFTDVMSAASEQELSVSLVGSNLHVFTVAELKAATQGFLDDNFLGEGGFGPVYKGAVDDKVKPGLKAQPMSRRQALGTHGYAAPEYILTGHLTAKSDVYSFGVVLLEILTGRRAVDKTRPSREHHLVQHMRSWLKDPEKLGKIMDPALEGKYATTAAHKAALVAYQCLSGSPKSSPDMSKVAEDLELLLNLVDDVPGEPGLHLASQDDPRKERTRNTQGAQGHNRXQSEVIFLGQLRHTNLVKLIGYCCEDENRLLVYEYMAKGSLENHLFKKFPPVLSWSTRLNIAVGAAKGLAFLHDAEKPVIYRDFKASNILLDPDYKAKLSDFGLAKDGPEGDETHVSTRVMGTHGYAAPEYILTGHLTAKSDVYSFGVVLLEILTGRRAVDKTRPSREHHLVQHMRSWLKDPEKLGRIMDPALEGKYATTGAHKAALVAYQCLSGS

SEQ ID NO: 106573 - protein, 367 aa, Triticum aestivum
  Clone ID: PAT_TA_991.pep
LLRPPAKSEDPDAAAPVVVGSLKERQTAASCSPRPFPGLVPSYKVHRMSVAGFSPHHPRKKSAVVRLSFRRRSYEGDEMTEMTGSAKYLYRPRAGLTLPYSAGEKPSEGCWSALEPSAFRVRGEGFFRDKRKSPAPNCSPYTPIGADMFACPRKVHHIAQHIALPSLKPHDAFPSLLIVNIQLPTYPTTMFGENDGDGVSLVLYFKISESFDKEISPQLKDSIKSVMNEEMEKVKGFPVDSNVPYTERLKILAGIVNPEDLQLSAAERRLVQTYNQKPVLSRPQHKFYKGSNYFEIDIDVHRFSYISRKGLETFRERLKHGVIDLGLTIQAQKAEELPEHVLCCMRLNKLDFADNGQIPTLITSSDE

SEQ ID NO: 106574 - protein, 196 aa, Triticum aestivum
  unsure (1)..(196): unsure at all Xaa locations
  Clone ID: PAT_TA_992.pep
MANDGSPKSGDIPPYPEMIIAAIEALGDKNGSXSKSAISSYIXEEKYEGLPSAXAASLPHRPNLASMKEAGKLAFRQGNTYPKADAPXATPAKRGRGRPPHGKPRRRARPQAAAQRPXNTPKRGRGRPPXVKDRMPDAGKGAVDRGPTGMARGPGGPTTPCTPNEARVXRAGGSVVRLAGSAPAKRGRGRPRKVAV

SEQ ID NO: 106575 - protein, 168 aa, Triticum aestivum
  unsure (1)..(168): unsure at all Xaa locations
  Clone ID: PAT_TA_993.pep
MTTTNMDQTTSVAACLTISIFFLTIKMIKRRTLHQEGPSLPPAVSVVSLSAYLPTFLSKGLSAVIQDLHTKMGSVFTISLFGLKKVTFLVGPRGHSHFFQGSRTRDQASDIYKXTVPVFGRRVLYDVDLATKSRQINFCLDSVKPMNFRGTFPPVGRGGDAPARHMGA

SEQ ID NO: 106576 - protein, 154 aa, Triticum aestivum
  Clone ID: PAT_TA_994.pep
YCPYGQLELHLHLNPPSAAQTESGFVELVAVILPSTKTFLFKHILEILAVHIFRFIILSVIASVNFQCLLELVCLGNEYFVHTCNGHIRGLVRIAKGFPVFSSFPFNSIYGRLVIDSFEVVHPEGVLVGEPGRTGRALHSTTFPLQCSSEFTGV

SEQ ID NO: 106577 - protein, 185 aa, Triticum aestivum
  Clone ID: PAT_TA_995.pep
MGSLHVSCSTTQHSKLQRVYQLLFFHVHPFWLHFLYFVTISFLGFVILKALPMKTSMVSRPIDLDLIFTSVSATTVSSMVAVEMESFSNPQLLLLTILMLLGGEVFTSMLGLYFTYIKSKKKEAPHDHGDGGGKVEPAPSSLELPATTFMDDSTAQNQMEQGFNKEQPRYGRAFLTRLLLFIVLG

SEQ ID NO: 106578 - protein, 149 aa, Triticum aestivum
  unsure (1)..(149): unsure at all Xaa locations
  Clone ID: PAT_TA_996.pep
PERPAAHRRRRLARPAPARPPQAGRPPHDSPAVDAYWGVGVGVDLNAPPPTGGDWRAQLLPEARSRVVNKIMECLKKHLPVSVPEGLNELQIIAVRFEDKIYAAATXSQSDYLRKISLKMLSMETNDTTVGNAQDDSTLKLKPRSSIIV

SEQ ID NO: 106579 - protein, 292 aa, Triticum aestivum
  unsure (1)..(292): unsure at all Xaa locations
  Clone ID: PAT_TA_997.pep
MGTVLDSHFLALTALVTVGYQLVFFIITALLRFDKVTDFAGSTNFVIIAVLVAALKGTWHFRQIVLTVLVIIWGLRLAVFLLMRILQWGEDKRFDEMRSNLGKLAVFWTFQAVWVWTVSLPVTIVNASSRNPSIEARDIIGWIMWAIGLAVEAIADQQKLKFKNSPSNRGKWCNVGLWSYTRHPNYFGEMFLWWGVFVASTXPVLSGAEWLVILGPIFLTLLLLFVSGIPLLESSADKRFGRSEEYRTYKKTTSPLIPLPPVVYGALPDWFKVAFLLELPLYNPGPERDPVS

SEQ ID NO: 106580 - protein, 247 aa, Triticum aestivum
  unsure (1)..(247): unsure at all Xaa locations
  Clone ID: PAT_TA_998.pep
MAALLCISTPAVVALPRLPHRRAPPCKIALTAPVSARLSLGLRRNKADAMAALLCISTPAAAALPHLPRRRAPPCDVALAAPVPARLSLRRRGLPTTGLRCSGTEVGVTEAIRMAAAAPFGHNLVAVDIGGDEVAADKRQLGLKEMATYVIYGTGAFFAGWVLSAVVSAIDSIPLLPKNTGRWWAYGXTVWFSARYLLFKENREELFAKAYELKMRIVGSGDAGCVHGWFVSWKKEINSLFEITITK

SEQ ID NO: 106581 - protein, 248 aa, Triticum aestivum
  unsure (1)..(248): unsure at all Xaa locations
  Clone ID: PAT_TA_999.pep
MRLFLIRHGETVDNVANLYAGSRDSALTAHGVMQAQKLASHLAEHVTIGRIFSSNLSRAVHTAQAILDAQKCAKDLKLVQAPELREKDFGTGEGAKFGSATKHEGSETPQAMRKRIDVFLDEHLPRLHEDSTVCIVAHGIILGTLYKALRDRIPSTSTAPDAAPEGRAESAFARPTWSNTGYVEALITTNASTTDKNVQMRVVKVNSVEHLKGLRKTRGRIGSAKFDAKQKTMDSXLQSVSRKRKIEE

SEQ ID NO: 106582 - protein, 100 aa, Triticum aestivum
  Clone ID: PAT_TA_1000.pep
IFLSLLIWTFYLFTPRIENLVSTTLDAKKNSRSRCCYFNKTSKIASGGTNSGEMDMGFAKCPGLLIRMPFRRVHHKSGPEKRSRSLASGLKRGATVTSAT

SEQ ID NO: 106583 - protein, 126 aa, Triticum aestivum
  Clone ID: PAT_TA_1001.pep
CKRGVGGEAWPKERGNRVAVIDVRDENGAYEAHIAGSHHFASGSFAARLPELVQATSGKDTLVFHCALSQVRGPSCARMFSDYLSESKEDSGIKNIMVLERGFNGWEISGQPVCHCKDAPCKGTCS

SEQ ID NO: 106584 - protein, 327 aa, Triticum aestivum
  unsure (1)..(327): unsure at all Xaa locations
  Clone ID: PAT_TA_1002.pep
TGCQNEYTPRRGRNKSTREILQLGASNITRGVPYHSMVHPHLFCLGELPSCFWXLSTCGGRTTTCIVITPPGTSPTVTRDSARVPVILKYPSSIDELHVIESFWNNVFVLRPPSEDELLERRDGGGGVVLVGPDVRAVEQAELHLDRLFPAGHLPPGRIAPRRKIPTTAGSVDGGWPGGGIQRRKEKLPDSTRRGQEPTRIPRRIRIRFLVLLSKNSEFFGARGKHNAAARNQAGASGEAEVLGPRERHGREQPPPPGPEPAVLPLAALVRAVRPAHRPPPRPQPHRRSCQIPQICLPPHLGRTPAYRAASPRPRLRSSCRVNSSDT

SEQ ID NO: 106585 - protein, 158 aa, Triticum aestivum
  Clone ID: PAT_TA_1003.pep
HATRLVYGYRPYIFLPLMSFRSLPPFGVISLILRPPGLRMNSLSAQAVGGGGRTLLGPMSGPSKSRNLTSIGSCPPAHLRAGLPAHRPPPAHPLPPKIREAPDQKSMAQKGPHGIHPNRPGVRFLRGILAFVRGVESEGTATRRGGGGGGGRWWRGGG

SEQ ID NO: 106586 - protein, 194 aa, Triticum aestivum
  unsure (1)..(194): unsure at all Xaa locations
  Clone ID: PAT_TA_1004.pep
KFIMGLQFHPEXRMRKEGSDEFDYPGCAKAYQEFVRASXKAKLAAAHAHVHVQSAVTTPAKLNHEMEKQRKVIGRSVSLAKNMYMFGNNNSAQHPAQHRDGDLDGGAEFLESNTALSVQQEKWLKQMGATVRNASGYMNRLKVSEEREAAARALMAKMSVAQLASLAAFYRAMGNVCSEVLDAKLQPPSTTLHE

SEQ ID NO: 106587 - protein, 310 aa, Triticum aestivum
  Clone ID: PAT_TA_1005.pep
MQPKINTFFKRQATGPDSNSEATEAKRLKSCGDGKVLNKKRNYGQFHLELGQPDFLLHMCAACGMMYARGNDEDEKVHRAYHKSYLEGVPFKGWREETVVMRSEGGDRIILASGENSCIRNSKVQEVIKVVEKELGFGEGQLLHKLCKVYLFVSGGRIAGCLVAEPIKAAHEVIPSSASENRSNLPDNKTESAQAKHTLEFGKISFKREVLRRHNHPDKSKEECQGPGAIVCEEEAVPALCGFRAIWVVPSRRRKGIASQLVDAARKSFCEGGTLGISQCAFTPPTSEGKELASTYCKTSAFLVYRDGDV

SEQ ID NO: 106588 - protein, 186 aa, Triticum aestivum
  Clone ID: PAT_TA_1006.pep
RAEFGTRVAARPRPGTTGCFRPHRGPRKRARKRPRQGPGPAACAGAGFCRAGSISRLPSQVAPGGGRPPCPLPVPEKKTEAPTQGSSEQGTSKGKQQEEIRITDEPPLPQGGQKRQRSDDAPGETADLQGKLVEILDRSSRMVAAQLEAQNINCQLDREQRKDQVSSLLGVLGKVADALYRIADKL

SEQ ID NO: 106589 - protein, 362 aa, Triticum aestivum
  unsure (1)..(362): unsure at all Xaa locations
  Clone ID: PAT_TA_1007.pep
QGQQKILTHPTRLARGVLDTVYKGRLRNGKLIAVKVLSVESRQGLKEFLNELMSISNISHGNLVSLYGYCVEGNQRILVYNYLENNSLAQTLLGSGRSNIQFNWRSRVNICLGIARGLAYLHDDVNPHIVHRDIKASNILLDKDLTPKISDFGLSKLLPPNASHIXTRVARTLSYLAPEYAIRGQVTRKSDVYSFGVLLLEIVSGRSNTSSRLPYEDQILLEKFPEVTNGVLLLQTWMYYEQGDLAKIIDSSAGDDLDIEQACRFLKVGLLCTQDVTRHRPTMSTVVSMLTGEKDVDSEKISKPATISDFMNLKIRSMRRENNIAFASSSTLLSTIMAHSSPLLSQETTQASITFTTISERE

SEQ ID NO: 106590 - protein, 179 aa, Triticum aestivum
  Clone ID: PAT_TA_1008.pep
MGCLPCFGSSGKGEPAKKGGARKDVPSDRRATGVGSDKPKPQGLLDSKKDTVIPREGNNQHIAAHTFTFRELAAATKNFRQDCLLGEGGFGRVYRGRLDNGQAVAVKQLDRNGLQGNREFLVEVLMLSLLHHDNLVNLIGYCADGDQRLLVYEYMPLGSLEDHLHDIPPEKEPLDWNTR

SEQ ID NO: 106591 - protein, 181 aa, Triticum aestivum
  Clone ID: PAT_TA_1009.pep
SLQLDDWVLCRIYNKKGVIERYDTPDSDVADVKPAPPPAAKIPRQGQYHAGPAMKVELSDYGFYQQPSPPATEMLCFDRSGSADRDSNSNHSMPRLHTDSSSSERALSSPSPDFPSDMDYAESQHAAGLAGGWPGDDWGGVIEDDGFVIDGSLIFDPPSPGAFARDAAAFGDMLTYLQKPF

SEQ ID NO: 106592 - protein, 323 aa, Triticum aestivum
  Clone ID: PAT_TA_1010.pep
MPPNSTPQRRAQQQQHHHRPVTAGGRSQEAAMSAVASDEEAFQEVDPTGRFGRYAAVLGLGSVKKVYRGFDQEEGIEVAWNRVRLRALAERDPSMVDRLHAEVRLLRSLHHDHIIGFHKVWLDRDAGVLNFITEVCNSGSLREYRDRHKHVSLKALKKWARQILEGLDHLHTHDPCIIHRDLNCSNVFINGNTGQVKIGDLGLAAIVDKDHTAHTILGTPEFMAPELYSETYTESVDIYAYGMCVLEMVTREMPYGECESVVQIYHSVTNGVPPAALRRLRDPEMRAFIQRCIGKPRNRPSAADLLRDPFFHGIDDDTTGTLS

SEQ ID NO: 106593 - protein, 194 aa, Triticum aestivum
  unsure (1)..(194): unsure at all Xaa locations
  Clone ID: PAT_TA_1011.pep
MAIAVSGRRERLRTRGCGALGCGASGAVVSACGGLRVGESCLRAESVRAADAAGIXRRALGILSGLSSPHVVACIGGGGARDGSSPLFLEFAPGGSLADEAARNGGRLEERAVRAHATDVLRGLAYIHGKSLVHGDVKSRNVVIGADGRAKIADFGCARALGEARPIGGTPAFMAPXXARGEEQGPAXDVWALX

SEQ ID NO: 106594 - protein, 147 aa, Triticum aestivum
  Clone ID: PAT_TA_1012.pep
MAAHGKPKPKPPGAPAPPPPPPPPTAAEAKKGFMRRMFPFLLAVNAFVGAYMLVRTYYKDSPAKTADAASATATASTAVESQEPVAAVAPVKPVLPPIPEDEQRRVYKWMLEEKRKVKPRDAAEKKRLDDEKALLKHIIRADTLPVL

SEQ ID NO: 106595 - protein, 172 aa, Triticum aestivum
  unsure (1)..(172): unsure at all Xaa locations
  Clone ID: PAT_TA_1013.pep
MSVIHADDIEISLCDGNSEDERRRRKIGSLRRKAIHALKKRGRRRVDFRFPPAISIEDVRDAEEERAVSAFRERLAAHGLLPDKHDDYHMMLRFLKARKXFDAEKAMQMWADMLRWRKEFGADTILEDFEFDELDEVLCYYPQGYHGVDREGRPVYIERLGKVDPNKLMQIT

SEQ ID NO: 106596 - protein, 317 aa, Triticum aestivum
  Clone ID: PAT_TA_1014.pep
MKCCSKTYLQSASVRIEEMRVKRRDTEQWMAHRLLPENLKGRILRHEQYRWQETRGVDEEGLLMNLPKDLRREIKRHLCLSLLMRVPMFENMDEQLLDAMCDRLKPMLYTEDSCIIREGDPVNEMLFVMRGYLESMTTNGGQSGFFNSNVLKGGDFCGEELLTWALDPAAVSNLPSSTRTVKTLSEVEAFVLRADDLKFVATQFRKLHSKQLQHTFRFYSQQWRTWAACFIQAAWHRYCRKKLEDSLFEKEKRLQAAIVSDDSTKLSLGAALYASRFAGNMMRILRRNATRKARLQERVPARLLQKPAEPNFFAVGE

SEQ ID NO: 106597 - protein, 155 aa, Triticum aestivum
  Clone ID: PAT_TA_1015.pep
MSPGSGKLRWLWRAPARAFGRARDFYVRSITGCARYVPADAAFGAYPVLVPAPLPRSQSCGSGADYGGEEDLRELIRAASQRRDGEQQRQADRLHAVPRSQSVAGAASMAPIDEDAPCEFAAGAGATLYSRSQSYAGGAMGARKSHCHSKASVLG

SEQ ID NO: 106598 - protein, 153 aa, Triticum aestivum
  unsure (1)..(153): unsure at all Xaa locations
  Clone ID: PAT_TA_1016.pep
VRNIRGHARPTNGSRLGDAGGESSPTLSTNLASVSHGCDDRSNAEQXKKDSGAPLPGAPNVRYRVPSKPLRFELWGARGDLLLPIHARTPRYESRLPDEQHKGHEVYTSSGHRCGVIPYSSVWCGGLPLGLMMNSTREEQPGEGLFLVSAMNY

SEQ ID NO: 106599 - protein, 168 aa, Triticum aestivum
  Clone ID: PAT_TA_1017.pep
SVPPPATRPPGPRAGPGLAARSPGSFLRCCLARLARGEAERSRRGTSRGARDASHDDPSQAGAGLGSVLVSSSVQMGQAQAKASGKGYHFGPTRPRPAERQDGGHRGAQDGVIVRAFGRRGPTLVRISVLDVPLQNGQLLAPFPLNIWEEDQGLCSINRTSHHRGRES

SEQ ID NO: 106600 - protein, 279 aa, Triticum aestivum
  Clone ID: PAT_TA_1018.pep
MNPRVVKTEAADERLTPPATGAGGGGPRAPVQFIELSSSDSDSDGGVGGSAKRSRSAAGDSAAGKRARVSAGPVVGVDVPPGFLDPLPAPPQPSRGATKQFWKAGDYDGNPAGGAEPPPSASGLEHVRVHPKFLHSNATSHKWALGALAELLDNSLDEVRNGATFVNIDMLENSKDKTRMLLVEDNGGGMDPDKMRQCMSLGYSAKSQVANTIGQYGNGFKTSTMRLGADVLVFSRSRGKEGKRPTQSIGMLSYTFLRSTGKEDIVVPMIDYEKNGLNW

SEQ ID NO: 106601 - protein, 87 aa, Triticum aestivum
  Clone ID: PAT_TA_1019.pep
NDVHKSCDKKSHFLPTISMHRVLCFQHLYQGVREAAKTMDMEQTRADMKVRLDTNPVCASSPQGMRHAAFSTGVAWRSRRAHTQESG

SEQ ID NO: 106602 - protein, 456 aa, Triticum aestivum
  unsure (1)..(456): unsure at all Xaa locations
  Clone ID: PAT_TA_1020.pep
MGVANAADHGAAPSGIHPACCRLLPPINRQQRTLPLHGLTFEDKDIFDVAVSVTGFGTPDWARAHAPATATAPLVLPALAAGATGVGXEGWNRLXYSINGENAHYGTPANPCAPGRVPGGSSSGSAVXPVAASLADFALGNDTGGSVRVPAAYCGIFGLRPSHGLVSVENVVPMAQMFDTVGWFAXDLPTLSRVTDVMLPPVPAAADDDAEIPRRPSRVIIPADCFKILGSVDDHTYEILNASAAKIFGSDAVVDNGNLGDFVSSNVPSIXKFMTDLSAVEASSSVCAASVCHPHVSCEFFKRSEFKSXTNAGGGVMLRPSPGPRVRERVQEAIASEDESAMDDLHAVRTEFKSALATLLKDDGILAIPTVPGAPPKLCLDAALLEDFRARAFSLLSIAGLSGFCQISIPLGTRNGVPVSVSLLAGHGGDCFLVAVAQELHEALQAEAAAAWGSSA

SEQ ID NO: 106603 - protein, 155 aa, Triticum aestivum
  Clone ID: PAT_TA_1021.pep
MANLQPSVPEPSSFAGASPPSPSSIGGGAASAAQEPRKMASAEQLVLDLCDRELRENALLELSKKREIFQDLAPLLWHSFGTIAALLQEIVSIYPALSPPVLSAGASNRVCNALALLQCVASHPDTRIPFLHAHVPLFLYPFLNTFSKTGFFEYL

SEQ ID NO: 106604 - protein, 261 aa, Triticum aestivum
  unsure (1)..(261): unsure at all Xaa locations
  Clone ID: PAT_TA_1022.pep
HASGEEFRSSYRSCHEAGGDPCTSIATGRPADGLCCGVGRPRRREGHAEAGQVPRVEGHSPPFVTQRAQGASCRAFSAVAMMESLYFIKTGTLVTLSEQQLVDCDKYDGGCNRGYYHRAXFQWIMENGGLTTAALYPYKAVRGVCIRAKPAVTITGHAAVPKNELALQSAVARQPIGVAIEVPTSMQFYKSGVFSAPCGIQMSHAVVTVGYGTDAYSGLKYWLVKNSWGQTWGEAGYIRMRRDVGGGGLCGMALDTAYPTM

SEQ ID NO: 106605 - protein, 116 aa, Triticum aestivum
  Clone ID: PAT_TA_1023.pep
FLLEIKLLLIRQRYIIICCPISSIFCLNFILDAASSETTILVKQKIIKDNIKNFKDFISWHKRKAWSTRTATNRANHTKKEQIRQSKSLIQENPQLLILHTQTASKHQYLQNLQHK

SEQ ID NO: 106606 - protein, 104 aa, Triticum aestivum
  Clone ID: PAT_TA_1024.pep
GRVGREEVDILHHMGSCASKDDMAARPRNAAVHPCPWITPTTLPAPGQRVAVRMRASEFRALHEATGRDTSGRDADAGVGRAILDGCVTGRWTWSLASASYFAG

SEQ ID NO: 106607 - protein, 203 aa, Triticum aestivum
  unsure (1)..(203): unsure at all Xaa locations
  Clone ID: PAT_TA_1025.pep
MAVKVYVVYYSMYGHVAKLADEIKKGATSVEGVEAKIWQVPETLPEEVLGKMGAPPKLDAPIITPQELAEADGILFGFPTRFGMMAAQMKAFFDATGGLWREQSLAGKPAGIFFSTGTQGGGQETTALTTVTQLTHHGMVFVPVGYTFGAKLFDMDKVQGGSPYGAGTFAADGXRWPSEMELEHAFHQGQYFASIAKKLKGSA

SEQ ID NO: 106608 - protein, 181 aa, Triticum aestivum
  Clone ID: PAT_TA_1026.pep
FFFFFCTNYIYIYIYIYIYIYIYIYIYIVYITEPAFLQFMFRNLPRFSVFRVTGSMPRPVFLRSLNSCSCFSLLFPLLIPSGTAPVACFLELASRKYLASWAVFMSFASMVRIDFMNISCMLVTLGRAAEEQAVSCRESSSSSSSMRSDVRKESVSEPSPKESNEEEKPEEKSLSEASPPW

SEQ ID NO: 106609 - protein, 243 aa, Triticum aestivum
  Clone ID: PAT_TA_1027.pep
VRVPRLISDSTYNIFTTVCNYSRYVSEYYHGSISTVCDRVMSQVTRETSRFVDKYDVTLDVCISSVLMQSQVLTPSPNSTEQLNRALDVCVEDETMNYLNRKDVQKAMHAQLNGVPKWTVCSSVLEYKQLDLQIPTINIVGALVKSGIPVLVYSGDQDSVIPLTGSRTLVHRLAKRLRLNATVPYRVWFQGKQVGGWTQVFGDALSFATIRGASHEAPFSQPERSLVLFRAFLASRPLPESFE

SEQ ID NO: 106610 - protein, 235 aa, Triticum aestivum
  Clone ID: PAT_TA_1028.pep
VGDLAQNPNIVSIIRNELSPIASTKVAARAAARDTVGPTLTWFFYNLAHHPNVVSIIRKELSPIASRKVADDVDAMVIFEPNETKSLVYLRAVLYETLRLYPPAPLERKMVAANDIMPSGHEVHAGDTILISLHSMGRMEGIWGKDCLNYNPDRWLSEDGNKLRYVPSHKFLAFNSGPRMCLGKDIAVMQMKTVIASTLWNFDVEVMEGQSIQAKPSCILEMKNGLMVKLKKREM

SEQ ID NO: 106611 - protein, 138 aa, Triticum aestivum
  Clone ID: PAT_TA_1029.pep
WIDSWWMLADNEDRCLLARETRTAHAPMLLKPHQCLIGAERSKPCRSSRLKPMNGSDGPTSLVRISSGLLEPCGEKETAPGPRCVSADAWGRACTSRHWKHTAPPEGGKDADAPGWGYPWRRRVGAPQGRPHGPACGR

SEQ ID NO: 106612 - protein, 201 aa, Triticum aestivum
  Clone ID: PAT_TA_1030.pep
PRVRPRVRPRVRPRVRLHKIALDIAKALAYLHDTCVPRILHRDVKPNNILLDTNHNAYLSDFGLARLLGNSETHATTGVAGTFGYVAPEYAMTCRVSDKADVYSYGVVLMELISDKKALDPSFSPYGNGFNIVAWACMLLRQGRARDFFVDGLWDVGPHDDLVEVLHLAVMCTVESLSIRPTMKLVVQRLKQLQPPMREHR

SEQ ID NO: 106613 - protein, 248 aa, Triticum aestivum
  unsure (1)..(248): unsure at all Xaa locations
  Clone ID: PAT_TA_1031.pep
MADESWRLPSSVQQLAASIQEPPRQYLLREQEPLGGNLAGTEMPEPIPTIDLGLLSASNDAEEAAKLRSALQTWGFFKVSNHGMETSLMDSVMNASRDFFRLPLEEKRKYSNIIGGKHFQMEGYGTDQVKTQDQRLDWSDRLHLKVEPEDERNLAHWPIHPKSFRDDLHEYTSKSKRIKDDILRAVAKLLELDEDCLVNQFSNRALTYARFNYYPPCPRPDLVLGIKPHSDVYALTVLLXDKDVAGLQ

SEQ ID NO: 106614 - protein, 253 aa, Triticum aestivum
  Clone ID: PAT_TA_1032.pep
EFGTRNYSVGLVCCYGGRWILNFLLIEVMTHFFHYNAFVVSRLWRQLTPFEIFIISYGVLIFMWLKFFLIWRYFRFWSLVGGVETPENMPRCINNCPDLESFWKSWHASFNKWLVRYVYIPLGGSRRKLLSIWVVFTFVAAWHDLEWKLISWAWLTCLCFVPEIVIKSFSNNFQAKSTLGRFIRRELCAIAGAVTVSSLMVANLVGYVVGPSGIKVLMSRMLHKDALPGLGIIFATFYVAVKLIFHVRDARKT

SEQ ID NO: 106615 - protein, 66 aa, Triticum aestivum
  Clone ID: PAT_TA_1033.pep
LLESCTYQMLVWPIGMVRWEERDEGERLRWTCRLLLPFHSMVVGFSFWLGGAIFSHFFSFSSSFLS

SEQ ID NO: 106616 - protein, 212 aa, Triticum aestivum
  Clone ID: PAT_TA_1034.pep
SEEQEFTPLATKPAIRWPIKVFVEEARTRRLIVRGTQPASRWPIDGCVEAAPTCRPGAPSAPARRAPALCSREPAAWACAGPPAAPARLRGSPGRGPWRRAARGAPSRPARAAPPAAGRTPPPCAPGPTTRPAPPPTPTTTTTTATPPPAPAATPAAPPSPPTTTPARGSASSREAPWREAPTARRRRRAPLPASSRRRPSRRASEGGPPAP

SEQ ID NO: 106617 - protein, 496 aa, Triticum aestivum
  unsure (1)..(496): unsure at all Xaa locations
  Clone ID: PAT_TA_1035.pep
MKKIDGAEFENVSGWDDEIDDHVEDEYNDDHSPGDRWSQVRKGTKIMVQVVKEGLGTKGPTLSPFPCLRSRFWILVSRGNKVGVSKKITGIERTRLKGITKLLRPPGFTLTARTVAAGHSWEELNKDLDRLLSTWKGITEHAQSAALAAEEGVEGAIPVMLYRSKGQALSIVQDDFNEKVKRLVVDSPRTYHEVTGYLQEVAPELCNRVDLYEKRTPIFDEYKIEKEIDNILCKRVVLQNGGSLIIEQTEALVSIDVNGGHSMFGQGTSQEKAILDVNLEAAKQIARELRLRDIGGIIVVDFIDMTDDSNKRLIYEEMKKAVEKDRSTVGVSELSKLGLMEITRKRVRPSVTFMISEPCPCCHGIGRVEALDTSFSKIEREICRRLAVSGHNPDPEKPKLWPRFLLRVDHEMCTYLTSGKRTKLGILSSSLKXWVLLKIARGFTRGAFELLPYSDQKDTDEQKELSPESPPPREAGRPRLSVFPIKKWMSRAKRAK

SEQ ID NO: 106618 - protein, 171 aa, Triticum aestivum
  Clone ID: PAT_TA_1036.pep
MGGCCCCASRAEADRAPVHIYHQQNQEEHEPLSSAFDGSSPASAIVAVDTNLDTSTPDTYRAPPAPLPYDVSLPVTENPDLEKSDIKSKTDDQQESLKVDEYESCEKGAPEDKIEEEDVCPICLEEYDEENPRSITKCEHHFHLCCILEWMERSETCPVCDQITLIDEMYE

SEQ ID NO: 106619 - protein, 203 aa, Triticum aestivum
  Clone ID: PAT_TA_1037.pep
TTSDPTLAAEIAAAAAGAGCAAVDAPVSGGDRGARNACLSIFAGGDAAVVARLAPLFKLMGNALYMGGPGAGQRAKLGNQIAIASTMVGLVEGMVYAHKAGLDVGKWLEAISTGAAGSKSLELYGKRMLERDMAAGFYVRHFVKDLGICLSECQTMGLALPGLALAHQLYVSLLAHGEGGLGTQALILAVERLNNTCLDKKGE

SEQ ID NO: 106620 - protein, 181 aa, Triticum aestivum
  Clone ID: PAT_TA_1038.pep
LVFQPAEEGYAGAYYILEEGVLNDISAIFGLHVFPHLPVGIVASRPGPFLAAAARFTATITGKGGHAGNPHDAVDPVIAASSAILSLQQLVARETDPLESVVVSVTQLRGGDAYNVIPESASFGGTFRSMTDEGLSYLMKRVKEIVEAQATVHRCAATVDFMEEKLKHYPATVNDEGMYAH

SEQ ID NO: 106621 - protein, 248 aa, Triticum aestivum
  unsure (1)..(248): unsure at all Xaa locations
  Clone ID: PAT_TA_1039.pep
MQILRRNLLEASRRLSSLLHSPPPAAHAHAHAVATLSAARRDPSTGSLATTPWAATQRRGAKMLGSDVKLGNVIQRKGRIYQVIKSHHSHQGRGGATIQVELRDVDTGNKIVERFRTDEALERXVFVEDKPFTYLYQEGDNVALMEPNTFEQLEVSKELFGKNAAYLKDEMKVTLQFFDGRALSGSVPPXRVTCTVVEAQPNAKGLTXTPQYKRVLLDNGLTVLAPPFVEVGENIIVSTVDDSYMTRA

SEQ ID NO: 106622 - protein, 277 aa, Triticum aestivum
  unsure (1)..(277): unsure at all Xaa locations
  Clone ID: PAT_TA_1040.pep
AVVVPGGQPAVVPHPVSKFPFLWDTKARQGKISRAAEQRAALITLGATTTSTTEEKQRLPGEAGSVDLLLPLAYEVTRRLVLRQLGATWLALTRRRWAKVVEAVIHQGIVRCQSFTLIGVAGSLLGSVPCFLEGCGIVLQSFSLQFRAMSQTIDXAEIIKLLIEALDMFLIGTALLTFGMGMHGMFYGSQRVQEPIYERLKKGXRIRSVTQAKSRFGHAVILLLQAGVLEKFKSVPLVTGLDMACFAGAVLASSAGVFLLSRLSAHPQPCNKQASFA

SEQ ID NO: 106623 - protein, 71 aa, Triticum aestivum
  Clone ID: PAT_TA_1041.pep
SRRHLPDHLIKIDRSKNKILTASTRLTTLPEHARTHARIMGELLLWGGMGMASQAEEASALARRHRRRRRA

SEQ ID NO: 106624 - protein, 286 aa, Triticum aestivum
  unsure (1)..(286): unsure at all Xaa locations
  Clone ID: PAT_TA_1042.pep
HASGATLDDKELELYRIFQAIDVEHNGCTXPEELWDALVKAGXRLMTEELARFVEHVDKDNNGIITFEEWRDFLMLYPNEATIENIYHHWEXRVCLVXIGEQAAIPEXGLSKHVSASKYLIAGGIAGAASRTATAPXLDRLKVIMQVQTTRTTVTHAVKDIFIRGGLLGFFRGNGLNVVKVAPESAIRFYAYETLKEYIMNSKGENKSXVGASERLVAGGLAGAIAQTAIYPIDLVKTGLQTFSCESGKVPSLGTLSRDILKHEGPRTFXRGLFHLAGGALPGAGC

SEQ ID NO: 106625 - protein, 166 aa, Triticum aestivum
  Clone ID: PAT_TA_1043.pep
MSFTGTQDKCKTCDKTVHFIDLLTADGVSYHKTCFKCSHCKGTLSMCNYSSMDGVLYCKTHFDQLFKETGNFSKNFTPGGKSAEKGEAKAPSKMSSAFSGTQDKCAACQKTVSPMERLTLVGECYHKSCFKCSHGGCILTTSSYAALNGILYCKIHFSPHSYSRRS

SEQ ID NO: 106626 - protein, 168 aa, Triticum aestivum
  Clone ID: PAT_TA_1044.pep
CGRVHYENPKMVVGCLVEHDNKVLLCRRKIEPAYGLWTLPAGYLEVGESAAEGASRETLEEACADVEIVSPFAQLDIPLIGQSYIIFRARMKTPSFSPGSESLECALFALDDIPFDSLAFSSIIVTLRMYIEDVKAGNIKFHYCTINKRIGAGPSDLRSFDIDNHLAV

SEQ ID NO: 106627 - protein, 334 aa, Triticum aestivum
  Clone ID: PAT_TA_1045.pep
MPSQDSTNTSGDEEEGGRARENARKANSSRRVSKDFSADLQLKEVNVDNSIPGEKPSSRSRQYGGKDVPKKYDNQLSDSSEDALDGAWSRPRGDSPDDSPVKRQSPSRAGDSYPKDGINNERAKTDSLGASYDAIAAKKYSGKVDEASQSDGGSPLQKAKKRTYDSKHIDRRSSGSEESEKHRSQSEKRGHKKGHKHKKHYDDSFDSDSDSDDKESKRRRREEKKLRKEERRLRREERHRRRADRHASKQRLKYAGSPLSDLEKDRQSGSDADVGKKGSYTPREEPDPNKLEIELRQRALESLAKKSKHVVTPSSDVEKDRESDSDADVRKRVS

SEQ ID NO: 106628 - protein, 284 aa, Triticum aestivum
  unsure (1)..(284): unsure at all Xaa locations
  Clone ID: PAT_TA_1046.pep
PRVRPRVRPRVRFSPIMAAWTFTTPMVGIYSIFRYYPGIFKAISPHYIVHFFLKNKKEGWQMLGATVLAITGAEAMFADLGHFSKKAIQIAFLSSVYPSLILTYAGQTACLINHLKDTDQENIGKVFDDAFYKFIPRPVYWPMFVIATLAAIVASQSLISATFSVIKQSVVLDYFPRVKVVHTSDENEGEVYSPETNYILMVLCVGVILGFGGGQAIGNAFGLVVIMVMLITSIMLTLVMIIIWRTPPVLIAAYFVPFVIMEGSYVSAVFTKFXEXGWLPFAIS

SEQ ID NO: 106629 - protein, 482 aa, Triticum aestivum
  Clone ID: PAT_TA_1047.pep
PDCSPAAAVPPPPPAPFSLPPPTRRPPPRGPPPAPPPAAVRPGRRRWWPGAAAPRALLLALPASARSFPSISSLSRRGGCGCPGARKYTGMVEDCCCDYETVDAINEEVLNPILQDLVALPFFRYFKVKLWCDCPFWPDDGMCRLRDCSVCECPDNEFPEPFKKPYSGLSPENMICQEGKPEATVDRTLDTKVFKGWVETDNPWTSDDETDNAEMTYVNLQLNPERYTGYTGDSARRIWDAIYKENCPKYPSEDMCQEKKALYKLISGLHSSISVHIAYDYLLDESANLWGHNLSLLHDRVLKYPERVENLYFTYLFVLRAVTKAADYLEQAEYNTGNPEEDLKTQSLVRQLLYNHKLRSACPLPFDEAKLWQGENGPELKQEIQKQFRNISAIMDCVGCEKCRLWGKLQVLGLGTALKILFSVDGENNLNQQFQLQRNEVIALVNLLNRLSESVKFVHETGSSSQEIIKQQSFSTLQKGAS

SEQ ID NO: 106630 - protein, 341 aa, Triticum aestivum
  unsure (1)..(341): unsure at all Xaa locations
  Clone ID: PAT_TA_1048.pep
MMRTVAAVAVAVLLAAAVAAEASELKVGYYDKSCRGVENVVKWHVARAIKANRKSGAALVRLIFHDCFVRGCDASVLLDPTPENPHTEKTAPINIXGLAAFDLLDDIKAAVEDRCPGVVSCADILIFAARDAASLLSNGHVHFDALAGRLDGVHSHAGEAQQDLPDSTFTIAELIQNFKRKNFTIEELVILSGAHAVGVGHCSSLRARLTAPADQILPAYRGLLAGKCAKGPDPIVPNNIRDEDAGAVAAAVPGFLPKLRKVKDFLDNSYYHNNLARIVTFNSDWQLLTEKEARGHVHEYADNGTLWDEDFSDSLVKLSKLPMPHGSKGEIRKMCRFVNHH

SEQ ID NO: 106631 - protein, 172 aa, Triticum aestivum
  Clone ID: PAT_TA_1049.pep
PRVRRAAGGVGKRRLHSAQGMKGFSGPGMHYHRRAESAPDLPPFDPGRAGIHRYNSSSTMADVFEEDEEDDDNARSGTTDDSSEEETDSDSDATPPAGGVRDPLRHSQDKLSVHNMRRTTSSLSDKDQISGSTVRGERSRSSLHESVIAEEFPSVIFRSPFMPAERCGTADS

SEQ ID NO: 106632 - protein, 220 aa, Triticum aestivum
  unsure (1)..(220): unsure at all Xaa locations
  Clone ID: PAT_TA_1050.pep
RGNSIRAAARAGTATDAPXXDASNITALQLMFCKXGLSFPSYSEGQFELPFSSIRAPRVRPITPRFIHVSSAGVTRPERSGLDLSKQPPAVRMNKELGSILTYKLKGEDLIRESGVPYTIVRPCALTEEPAGADLIFEQGDNITGKISREEVARLCVAALASPSACGEXLFEVKSTVPFSEPFVIDPSNPPPEKDYEVYFKELKDSMAAAEVLEGTPALV

SEQ ID NO: 106633 - protein, 135 aa, Triticum aestivum
  Clone ID: PAT_TA_1051.pep
PTEVQWHAKARINAGANFYIVGRDPAGMGHPTEKRDLYNPDHGKKVLSMAPGLEKLNILPFKVAAYDTVAKKMAFFEPSRSQDFLFISGTKMRTFAKTGENPPDGFMCPGGWKVLVDYYNSLQTEGATAPAAATV

SEQ ID NO: 106634 - protein, 181 aa, Triticum aestivum
  Clone ID: PAT_TA_1052.pep
TPAVPVRISGRTRVRPRVRPRVRGYCGNMGMCSYNRTSPVCGCPSRNFELVDASNPRSGCKRKTELQNCPGNSTMLQIDNTQFLTYPPEIAIEQFYIGITACRLNCLAGSSCVGATALSDGSGLCWLKVSNFVSAYQSASLPSTSFVKVCFPGVPTRPSAPLTRRRRGPPASWMIYLFIFL

SEQ ID NO: 106635 - protein, 121 aa, Triticum aestivum
  Clone ID: PAT_TA_1053.pep
AAAKGSHLKKSRRWRRSRWGEGPALMQLETLLALSLKQQSHLVTKVSQNSNIHHFHARLHILGARGLSKETQMFEKFYSLQALITCISMCYPHCILFFEMAVSYQAPPRNFSGGRFRLVNK

SEQ ID NO: 106636 - protein, 120 aa, Triticum aestivum
  unsure (1)..(120): unsure at all Xaa locations
  Clone ID: PAT_TA_1054.pep
MAMASPWQAGRYINIEGMARPVAVDHRISLPYYFRIADNLLRQANIYREEKNLIDLYIILLRYSSLLSETIPKHRDYHAFKSREKEFLKKGPHNSDKLLNGISELXALKPIGKQQIAELN

SEQ ID NO: 106637 - protein, 317 aa, Triticum aestivum
  Clone ID: PAT_TA_1055.pep
MPSGLAPTRPRPANGELGFRPLGPGPATHFDGRASQGLTRCACRPKAAGNPGGRMIPATTPAAAPRGISPCPPPRPATPPGVPLRLRSRSPGAASERSARAARHRISPIWGGCKTPRLPPTIPPMQPHPSPGSQPGRSGGGCKRRGGARARAVPMWWQHYHRNHMGHDKEHFFAVATGDFRRSMCIPWEVGNHLGSMISETIKLEAPNGIFCIGVCRKPGELVLQSGWDKFVAMHHVEENYSFWFVYRGNSTFKVHIFNPNGREKTTSCSQPPSQSFGGVPSAATCDHHVLNGYEAHLLNDPAPVEFGVDLEPHSSG

SEQ ID NO: 106638 - protein, 273 aa, Triticum aestivum
  unsure (1)..(273): unsure at all Xaa locations
  Clone ID: PAT_TA_1056.pep
MATERESKTFLARLCEQAERYDEMVTYMKEVAKLGGELTVDERNLLSVAYKNVVGTRRASWRIISSIEQKEESKGSDKHVSTIKDYRNKIETELEKVCQDVLDVLDDFLIPNAATGESKVFYHKMKGDYHRYLAEFASGEKRKGAATAAHDAYKSATDVAQTELTPTHPIRLGLALNFSVFYYEILNSPDRACHLAKQAFDDAIDELDSLSEESYRDSTLIMQLLRDNLTLWTSSDSAEGEXAGAADAPKKEEGEAAKPAEEAAEEPAPAPAS

SEQ ID NO: 106639 - protein, 86 aa, Triticum aestivum
  Clone ID: PAT_TA_1057.pep
TPAPEFNFGGPKKKLLPCKPGVVKLGPLKRPPLFFFFFFFFFFFFFFFFFFFFFFFFFFFFFFFFFFFFFFWEKDTIAKSDTYCVR

SEQ ID NO: 106640 - protein, 189 aa, Triticum aestivum
  Clone ID: PAT_TA_1058.pep
GPLRAVGDAAGSLSLRRPLQRREGGGTSGLFTRWVCGRVRVEGDAAEAVAVVSRRNKFLRAPFAVRRGFCLRLGASGVGDPRIAGRSWAELFHQPSPPLQQRRRPFFFLVGMICCGCSSPSSALMLEGDSALPGWMARPRCWTGRMTRILFHQEGTFFAVLKAKAGDGRCRCVGLMPMPSQRWCQERRK

SEQ ID NO: 106641 - protein, 149 aa, Triticum aestivum
  Clone ID: PAT_TA_1059.pep
PPPASRPTPLYARRVREKCGMKTRSQTTPKPLNTVRLPPVESPRTRSRPKPKPETRKKGTLGDLRRPKKPPTAFFYFMEDFRKTFQEENPSVKAMQDVGKACGEKWNKMAFEEKVKYYDLATERRAEFEKAMAQYNKKKINGELSVESD

SEQ ID NO: 106642 - protein, 203 aa, Triticum aestivum
  Clone ID: PAT_TA_1060.pep
MLPNRDPFYTYDAFITAAKTFPDFGTTGQLMKRELAAFFGQTSHETTGGGSEGGYKFIEEINKNDPLYYGRGPIQLTGQSNYRAAGAALNQPLESNPEIVANNPVVSFQTALWYWMTEQSPKPSCHNVILGNWKPTDADNAAGRLPGYGVITNIINGGVECGMGQMPNDPNADRIAYYKRYCDMLNTTYGDNLDCYSQKNFAG

SEQ ID NO: 106643 - protein, 199 aa, Triticum aestivum
  unsure (1)..(199): unsure at all Xaa locations
  Clone ID: PAT_TA_1061.pep
LLCSWALMEDGREDNFGKVRRPPVSVLRPDYDAIALQDFCLHPIYARRPSTRVPAATAPRRCRTRGGPVAYAEGGCLLPRHAPIGAPHRQVPDACFPVGGRPATVRELRAGRVFQLGCRPWWGEEQQYGERERSGWKRRRWGEKKPYRKTERDDWTRQXWQVGQLSGGAGHDGVAASWLGGAEFGMADARVMFDIMPVK

SEQ ID NO: 106644 - protein, 182 aa, Triticum aestivum
  Clone ID: PAT_TA_1062.pep
MRSVWMDKLLLALAVTGALFMSNGVGVAATPQTTCKAAANIDKRVNYDFCVSQLLDHHESSEADTWGLAKIAALMGANNAAHAKADIDALLAKPGTGDQMKRLLGQCKGLYDRTFMTFVYAHEELKKRRYASGKEKAAETVALVHQCDEAFVEARVRSPLTKQSADSVQLAIICTAITNLIK

SEQ ID NO: 106645 - protein, 288 aa, Triticum aestivum
  unsure (1)..(288): unsure at all Xaa locations
  Clone ID: PAT_TA_1063.pep
MDLDKTNTVGGDGAANGQDLEQARRGQELPPPAGHATKGLAVGHLIRELVLEGVATFLVVFWSCVAALMQEMHHSLTFPTVCLVVALTVAFVLGWMGPAHLNPAVTFTFAAFRYFPWRKLPLYVATQIGASVLACLSVNAIMRPHDDNFYGTVPRPPGAGARLPFLLELLASAVLMIVISTVATSNASKAVVGISIGTAVGTLGLVIGPVSGGXMNPARSLGPAIVFGRYTSIWIYVVAPVAGMLLGALFNKAVRQSDAIVGFLCGGRGASSRVVIVGRSVTGAPGTN

SEQ ID NO: 106646 - protein, 114 aa, Triticum aestivum
  unsure (1)..(114): unsure at all Xaa locations
  Clone ID: PAT_TA_1064.pep
ASRTKSTNQSKKVSFYSQTIHLHTQDHKGTERVPEVVIQIKADAWVSKRKKGFLILISRPPLKKDGFAAPPPRRRPGGLAPLCSMQRTTXRGGHDPWDXARTAXQGGAXTNSPI

SEQ ID NO: 106647 - protein, 235 aa, Triticum aestivum
  Clone ID: PAT_TA_1065.pep
HASEFYYDSVSIFFYNVLNPPQFPSACSNKLEKYYNRGAGTNESLLYEIINGLRAAGTDAGSSSAAAASFTNATKSVVELLTERVNQLSVKNDSDLDFLLDENHNLTEMEENTAESHTQDKANRQSEECCSYTSSNRESWGRCSSLGAASDVSSSGERPRVSDHKHKSMTLRALATPLRRIRRKPLTIPKERKNRSLWKRLNQERHDMGESLTQRFRLCLQGQAQHKRTKSSLTL

SEQ ID NO: 106648 - protein, 151 aa, Triticum aestivum
  Clone ID: PAT_TA_1066.pep
HLPGGQHISSSFACSMMWLSKPQQDLCIRIMIWGGIDMSVSHKEEETGYVTLAAWFAVESFDVTRIAARNQLSHNTSLSLLERHAYEGCMKDYALAGRHITRVANEMLPSCRFTDLSYEYNRALNSIVTCMNRLSALTHVNTPLNPMVLAG

SEQ ID NO: 106649 - protein, 251 aa, Triticum aestivum
  Clone ID: PAT_TA_1067.pep
LDTEKKIYQFNGANSNIQERAKALEVIQHLKDKYHEGVCDVAIVDDGKLQAESDSGEFWVVFGGFAPIGKKAISDDDVILEATPTKLYSVNNGKLTLEDTVLTKSILENTKCFLLDCGSELYVWVGRVTQVDDRKAASVAVEEFIVNQNRPKTTRVTQVIQGYEDHTFKSKFDSRPVSFAAAASGGVARRQGAALLQSLGAASRASSSSPPVVDVVPALLVGAGAPLGGGVVRRATPALPKEDFGKFHSAD

SEQ ID NO: 106650 - protein, 213 aa, Triticum aestivum
  Clone ID: PAT_TA_1068.pep
GSHPHQATTTSSSSMDSGGGDSSGSAGAAAAAAKWRREATRAFQYYLDRSTPHATGRWVGTLVVAGVYALRVLSIHGFYIVSYGLGIYLLNLLIGFLSPMVDPELDPSAAAAGPALPTRGSDEFKPFIRRLPEFKFWYAITKAFVIAFVMTFFSVFDVPVFWPILLCYWIVLFVLTMKRQILHMVKYKYVPFNIGKQKYGGKKGGASSSSSKD

SEQ ID NO: 106651 - protein, 418 aa, Triticum aestivum
  unsure (1)..(418): unsure at all Xaa locations
  Clone ID: PAT_TA_1069.pep
HQVTIFPRAMLCHIYHYAISDEFSVARDLLLMSRLQDGIQLMDISSQXILYNRVMAQVGLWAFRAGLIADAHGCLSELYATGRVKELLAQGVQYSRYHERTPEQERLERRRMMPYHMHINLELLEATHLICAMLIEVPYMASSTYDKRRPMSKTFRRLLEMSERQTFVGPPETVRDHVMAATRALNKGDHEKAFSVISSLDTWKLLRNKEHILEMLKLKIKEEALRTYLFSYSSCYESLSLDQLTTMFDLSEAHAHSVVSKMMMHDELHASWDQPTKCIVFQNVDQTRLQGLIFQMTDRLSVLVESNERAYEARTGGALEGAPPRRRGDQDSSNLGKWQENFVSSQGGRRGGGRSGYGGRGGSGQGGGYQNDRGGQGSRGGYGGGSRFQDGRARNQSGSSSRGDGNGRMVNLNRPGRN

SEQ ID NO: 106652 - protein, 131 aa, Triticum aestivum
  Clone ID: PAT_TA_1070.pep
MASLLVLRGTWYGTVRPATQPDWLSPRNPHPPRPHRGRSSSIKVASKVVLKTSTYPNKRNVAYGTIRSTDPRTKAGGIELGAEFALVRIDEPILDNEELVREVSDCKTIGEAFTSGYLIAWPSAFIREKDG

SEQ ID NO: 106653 - protein, 247 aa, Triticum aestivum
  Clone ID: PAT_TA_1071.pep
MLASRVWSRSAPQSSRALASAAASAARSLLLRSGMQLSRAPPGLAERPCARIAEADAPPLCSSSGYSRGEHACRRRTYQIHPVSNRVTPVGGNRHVLYASYLSQNQQNYRSFSASSDQERIEAANRIIHGLPRCVKIVEVGPRDGLQNEKNTVPTPVKIELIKRLATSGLSVVEATSFVSPKWVPQLADARDVMEVVRNITGVSFLVLTPNLKGFEAAAAAGAKEDAIFASASEAFSKSNINCSIKE

SEQ ID NO: 106654 - protein, 121 aa, Triticum aestivum
  Clone ID: PAT_TA_1072.pep
PRVRPRVRFQPLRSKGWETALLEYTISMITDSTPKSRVPVSKRLSEISCPVLVVTGDTDRLVPASNAERLARAIPGATFEVIKNCGHLPQEERAEEFLSVVERFLQRAFGTPDEHVFQAAV

SEQ ID NO: 106655 - protein, 102 aa, Triticum aestivum
  Clone ID: PAT_TA_1073.pep
AFAVFDKNVRPAIPATCPAALRVLIEQCWALQADKRPEFWQIVQLLDKFKMVLERDGTLDNMPSSNCQESHDPKKWLAHWLHKLKHPHHHHDLSGPPPPKLL

SEQ ID NO: 106656 - protein, 184 aa, Triticum aestivum
  unsure (1)..(184): unsure at all Xaa locations
  Clone ID: PAT_TA_1074.pep
RGVHARXAMAQSSGGSSSQQRRQSSGGSSSQQRSPSSGGCAAGGGDSSCSECGRQCTSECGRQSISRGGVSVWSCGFCSECQCLEEEEEGEVLHDISDRWADPPGSAAGSSCSVQVRQILTGPGVQPGSWRRLTVGLICLAFGALGDARCCLGIAKSWRILSHVWSRCQECGRLPNDADDGEGE

SEQ ID NO: 106657 - protein, 50 aa, Triticum aestivum
  Clone ID: PAT_TA_1075.pep
GGVEASVPRAHGLPDIGNGRRRSFRLDLESGLVQVCRKLSGFMYKLFKYE

SEQ ID NO: 106658 - protein, 273 aa, Triticum aestivum
  Clone ID: PAT_TA_1076.pep
MLSTAPAAYSTSFAAFPTLARRRHRHRRVLLPFAAATDGAERFAASSSIADYLRYRRPMSGDLSVGGGGGKLQTAVVRYEKRFPWSLIHPFLRVDLVSTVHIADKEYFDKLQQALEDYDCVLYEMVISRDNLNNQQDPTFAKKMRSSRKGFSILGFIQKQMARILSLDYQLDCLDYGDEKWQHADLDYETFKLLQTERGESFLTFAVDMTLKSTKALVQPTSPDGLDFWRSKLLWASRVLPMPLIGLFVITGLCLPVDKQDGYPELEALSKLD

SEQ ID NO: 106659 - protein, 138 aa, Triticum aestivum
  Clone ID: PAT_TA_1077.pep
MADLSCLTILGFCFLTFNSGMAIYRSNGDAGSIVFVVFSYLNLVALVACLRLYKDLDYHSPRRQTIKAAVWTLTSLLTVMFSYKVAEIMPLAVKIVVWTMAAATTCGGFYAFFIHQDKAYQPVPAAPEAPALRRDGTN

SEQ ID NO: 106660 - protein, 485 aa, Triticum aestivum
  Clone ID: PAT_TA_1078.pep
MAFSFSSPAQQNPFQTPTQQNPFQTPAPQNPFQTPSPAQTQAPAQSPSPFQFNFQQPQQQQQQQQQQQQQQQQAAPTAQPQQQLMLYTKEGKPAGYNTKWDELHADSQKALLQIEDKIREYKDESERLDQCSRLHDSSISNVNFELDASHIAQELAGTATVIEREKASVQELMTVVNEMMWNTEFAIRSYMMLRPRFLKSATGSSNPSGPAGALPNQPGPTNDFYSGVPKRPSLFMLQTVNKFEKYLDECCKWITELEQLVQIESNKRSSSSVESLPKVMSNVHDYFIYVASKVENLHQYVVSMKTEYLHGQRRLGNANDPFLEANRREAAKEEAAAKRVHPTLHLPAPVQPTTQIAAPATSQPQQSLLPSGGTSSSAFTAFSMPASAPSTSSLFSTPTTSSLTTNLFGTTGSASLSTPFGTSSTPTLGSTPTPSGFGGITPSFPSTPALTGTSLFSTPFGGGATASGSSFGGTSKGRSKARGRR

SEQ ID NO: 106661 - protein, 129 aa, Triticum aestivum
  Clone ID: PAT_TA_1079.pep
APEDSAVHAQLDPPEPSADETIVDPSTVRLPGSANPPASPDHDVQITGSRFIEPGNPIVLARNSAKQEALERQKVRFDVSHYAHLNVSDVLSDYLSHVHSSCDSEIEMVKKLQLKYEVCSPVYIYSASP

SEQ ID NO: 106662 - protein, 142 aa, Triticum aestivum
  Clone ID: PAT_TA_1080.pep
HQVHAYGIQHTTPRPSQIKSPCINQHAQQSIASIRRVFPWIDSDGSACLLRASCWRGRGRRRPIWARCALHDLVGRLDVALLVPVVAVAGVGAGRRHLLHQALAAGAGLVHRPAHPLQRVHQVVVVLLARPQDGRHRVPPQR

SEQ ID NO: 106663 - protein, 136 aa, Triticum aestivum
  Clone ID: PAT_TA_1081.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGMFEDTNLCAIHAKRVTIMPKDIQLARRIRGERA

SEQ ID NO: 106664 - protein, 218 aa, Triticum aestivum
  Clone ID: PAT_TA_1082.pep
GTRVTLTPSHRPLHSTSEMAAVTFEEEVSRLAAREAAISPALVRTAVGTLARSSTARAAADALFHLFAGTISFLFAATFLYLVVFRACVENCTVASVVWEILVYSGMLSLLLIVPAMVLFFLRAAGSGSEVKDDVEGRVRRWPLIWHASVAFFHLALLVGLIGLVLQICGGSQEVSYLLRIAAVLCKLLLTVLFCIRAAVALWSMNPQQPAAVGAAVV

SEQ ID NO: 106665 - protein, 328 aa, Triticum aestivum
  unsure (1)..(328): unsure at all Xaa locations
  Clone ID: PAT_TA_1083.pep
MKFLGLLNLAALASAVPTPTVQQVGKTLGKRAAITDAANIGYTTENGGTTGGAGGATVTVSSLAEFSKAAESDEKQVIYVKGQLTGNNKIRVKSDKTIVGAAGASLENIGLYINKQKNVIVRNLAIKNVVAANGDAIGIQKSTNVWVDHCELSSDXLQDKDFFDGLLDVTHAFRXVTISNTYFHDHHKASLVGHSDSNAAEDTGALHVTYANNHWTNIGSRAPSVRFGTVHVFNNYYEDISVTGVNSRMGAQVLVESSAFSNAKKALISKDSKQTGSISVNDVDLGGSTNDAPKGTISKSDIPYKYSLVGSSKVKAAVVGVAGNTLKL

SEQ ID NO: 106666 - protein, 122 aa, Triticum aestivum
  unsure (1)..(122): unsure at all Xaa locations
  Clone ID: PAT_TA_1084.pep
TLSTXXXXXXXXXRLHLNSYKQTTTTHSLTTATMSSPYTVQIHQSTKEPSISSSYSYSSGSYSSSTSTTPRSLSPGEYREYGADKHTTQVAKSGRNLVINHNKVSYEKDSPAPTYAGAYTRT

SEQ ID NO: 106667 - protein, 257 aa, Triticum aestivum
  Clone ID: PAT_TA_1085.pep
MGSAWVPWEQIQMPSDAKILFMRSFNERQITLVVYESAQDNCPYFLLRTFHMGTPWFSLRGAHELVVDRNGSCLQFWRWSESDRCTKRWATLCFLTWEEMVLVYCCFLSFKTRDSQTLPMAANEDLSLWGERKLFQARIVDDNFMHSLIVYEDFVSKGLRLHAAVWEGDLRQCPVWTAFVTHQSASSRWIKRVSKTRVRLADIHLYVFCQEYRQQNQRINRSGAFEIKFVSEEAAKRFRDIFAPSFTDESTTTDTTA

SEQ ID NO: 106668 - protein, 436 aa, Triticum aestivum
  unsure (1)..(436): unsure at all Xaa locations
  Clone ID: PAT_TA_1086.pep
MLPQMRPLPSRPAIHAVHRRTSPAPPSIGGLGQHGRVALVRTTTPVVCRSVASPAANQGAPAVERPWKLSDARLVLEDGSVWNAKSFGASGTQVGEVVFNTSLTGYQEILTDPSYAGQFVLMTNPHIGNTGVNSGDEESIKCFLGGLIIRNLSICTSNWRCTETLDEYLRKRNIMGIYDVDTRAITRRLREDGSLIGVLSTDQSLKDEELLEMAKNWKIVGVDLISDVTCDAPYEWVDKTGSRWEFNDNQSSGTFHVVVYDFGVKINIMQRMGSSRCIISFGCAKWXPDGDVFRNLLGDLIAVPHVIKALXDIVGKVPVFGTCMGHKLIGQALGAKTFNMKFGHHGGNHPVRDNRTGRVDISAQNHNYAVDPESLXPEGVQVTHINLNDQSCAGLVFPKMKLMSLXQYHPESSPGPHDSDLAXFGEFVELMKNNRL

SEQ ID NO: 106669 - protein, 191 aa, Triticum aestivum
  Clone ID: PAT_TA_1087.pep
QIASNGMATHRPLRHGYPPPSATRSRQARSSVSTQLRLRAATRHDGQPLAWGDGLAVRHHTPCPLAFALHAPTRPCYEWRPVAGDWHRGEACCNLRQSKLEPPSRHAATGQHRAATGTGGDGRGWDCVLQPASFFAGASDGRCYDRCRREHRRSAAVLQIFLCWKASEVASFAGTGPYFLLPPSFDFVGAG

SEQ ID NO: 106670 - protein, 104 aa, Triticum aestivum
  Clone ID: PAT_TA_1088.pep
MEPNGISGGTAEARRPPHVAMLVTPGMGHLIPLAELAKRLAARHGVEATLITFASTASATQRAFLASLPPAISSLSLPPVDLSDLPPDASIEMLIKKNPHKGPP

SEQ ID NO: 106671 - protein, 196 aa, Triticum aestivum
  Clone ID: PAT_TA_1089.pep
TRRSSSSLHGHLLHPAASLQWHLSGSSSSTRPPWSRSSCCPPSWLRPPLLLPGPNPAATHPPRPPRPRRRPSPPPARPPRRRQATLTLRRPSPQLARPPTRRRPSRRREATLTLRRPTPQPARPLRGGRRPMKPPARPPWRGRRWRPPPARPPRRGRRPRPPPAHPLRGERLTRPRRATLTLRRPSSPPPMARLRP

SEQ ID NO: 106672 - protein, 142 aa, Triticum aestivum
  Clone ID: PAT_TA_1090.pep
LQGAEAPHANASSTTEDRSQQPVHQNSSSPQVVWQDSIDPDNMTYEELLDLGEAVGTQSRGLSQESISALPVTKFKCGLFSRKKKRRERCVICQMEYRRGDLQMALPCKHVYHASCVTKWLTINKVCPVCFAEVPGEEPKRQ

SEQ ID NO: 106673 - protein, 154 aa, Triticum aestivum
  unsure (1)..(154): unsure at all Xaa locations
  Clone ID: PAT_TA_1091.pep
MQIFVKTLTGKTITLEVESSDTIDNVKAKIQDKEGIPPDQQRLIFAGKQLEDGRTLADYNIQKESTLHLVLRLRGGXMQIFVKTLTGKTITLKVESSDTIDNVKAKIQDKEGIPPDQQRLIFAGKQLEDGRTLADYNIQKESTLHLVLRLRGGQ

SEQ ID NO: 106674 - protein, 250 aa, Triticum aestivum
  Clone ID: PAT_TA_1092.pep
MENGFPGEVLKAVFPLLDGKDLVFCMLVCRQWCEIAKDDYFWKCICSRKWPSICKQPPSDTNFQKLYLTFSKPRKTVHLPVPKLTFEDLVFYIDMWLEGSLIFSQAVSGCILRAGLQNTPGGIPDVLVAHLNAADCILMMEVKPKLTVPMGPAITVSVLAHRKDTNKMTCIINTSSFDYIDSNAARALAYEYLRFSPRHPFISDIRAWMSLLFLYKGTNSIEVFGIELDFCDAARSEPEILWLLDMLDWK

SEQ ID NO: 106675 - protein, 73 aa, Triticum aestivum
  Clone ID: PAT_TA_1093.pep
DIARKIQGTLSIPKVHDHIACDRVWSRRLQHWHNNMLLDMGMAAAAIHAKMVVFIIISFLLDVLMFRLPVTSV

SEQ ID NO: 106676 - protein, 92 aa, Triticum aestivum
  Clone ID: PAT_TA_1094.pep
PAPLGWTKTYMMSFARRSTPGNAPVGLLARCWSVSMFSLIHLCSTKLSIGLVMHRQPTRAELVVVTFEEGVLFAKTPSWQLHPGCISPHNYW

SEQ ID NO: 106677 - protein, 217 aa, Triticum aestivum
  Clone ID: PAT_TA_1095.pep
ASSPSPSPGALRGGKPLPASSARAPGTADKKREAAANGGANAISRPRGAPQKAVEPSTTSRKEKDDEPSMQFEESESLTTPSIEDQLQEQLPDPVDLKPIDMAASASASASPRRDQQGPHTQQQGKNEQPEKEGADAGGKNNKPDIAKVADELDREAETEEAITKASSRAEAAQSWRKDDPKSNDVIEEAKSKLLEERQSRVKALVGAFETVMSFKE

SEQ ID NO: 106678 - protein, 153 aa, Triticum aestivum
  Clone ID: PAT_TA_1096.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 106679 - protein, 109 aa, Triticum aestivum
  Clone ID: PAT_TA_1097.pep
ARHTPLFLHRARYFKEASTRPPWTPRCCAPRSSRPPSPCPRSRGSPTPSTRRPPRRAPAATPPPAPPNCRRRRWSPPSSARPSRSSSPTCATDNRTKRIHACMHAMLSN

SEQ ID NO: 106680 - protein, 154 aa, Triticum aestivum
  Clone ID: PAT_TA_1098.pep
CSAGPRTNQRWEQSHSNLDHSLSQSYDVGNKARRYRNDKFSSNQHYNLTTYPRYSSLKALDPLLLLNIQGVCFPTFATCSDQMRSLLGLGGGRRRWGGAGRGRPRSSKRRSPPCRLPSPTPPPPAATCRASSWRPWRESPRGSKRRDGIFHLVP

SEQ ID NO: 106681 - protein, 199 aa, Triticum aestivum
  Clone ID: PAT_TA_1099.pep
MASHLDFRYLDEGLGGERGKRKRREEEADAADSMELDADAPRSSKLRAVASQSDPSKPAAFGSPTYDGVIAGRVSGRTWKEPRTRRSSALMVSRKPAPLEQRVRDKSLKKAYQARVAELKDEIRQNKVAKRKQKEEREKRKKENVLRTGSKLQKVTNPKTIQKIAKSKNRGQLRVVSDDIFGGKKSEAARRMQVPGLEN

SEQ ID NO: 106682 - protein, 200 aa, Triticum aestivum
  unsure (1)..(200): unsure at all Xaa locations
  Clone ID: PAT_TA_1100.pep
MASHLDFRYLDEGLGGERGKRKRREEEADAADSMDLDADAPRPSKLRAVASQSDPSKPAAFGSPTYDXGVIAGRVSGRTWKEPRTRRSSALMVSRKPVPLEQRARDKSLKKAYQARVAELKDEIRQNKVAKRKQKEEREKRKKENVLRTGSKLQKVTNPKTIQKIAKSKNRGQLRVVSDDIFGGKKSEAARRMQVPGLEN

SEQ ID NO: 106683 - protein, 81 aa, Triticum aestivum
  Clone ID: PAT_TA_1101.pep
MMWGVAAAVASAAAVAVASGAELLACDCAPTEPPAAAVGRCDEFLLRQRDSSASSGASGDDKFAPRFDGLRFIETLVTAHR

SEQ ID NO: 106684 - protein, 285 aa, Triticum aestivum
  Clone ID: PAT_TA_1102.pep
PHRPGGGAGLFNTKRSRPCPARAWRGSERHHCSPNSRRRRWATAATSLSCPPTSPTGSSAPTPPARRPASPPRSAPRRPLHRRSPPTLLGQFHISELPLRRGRVPPPRVARRRVRARPLSAVCCQVPGVRGGLRGAPTSGAWRLARQPDGPQSRSGTRSRNEIIDDGKKCRKYGKKAVENSPNPRKYYRCSTEGCSVKKRVERDRDDPAYVVTTYEGTHSHVSPSTVYYASQDAASGRFFVAGTHPPPGSLNCGPELVLRKPRINGVRRSKLEDDNRTGVWPSTY

SEQ ID NO: 106685 - protein, 195 aa, Triticum aestivum
  Clone ID: PAT_TA_1103.pep
LHQESTARARRGRGRATSINGWWRSTCAEAGAHGGQGLLHLRLVGGRDRARCRHQQPGRLPVPRPVADRARGRGHGGGGATPAHEGAHPGAPQSGSGDDRRGGCRGPGGGLPHISGPLHRRQRAHRRRHQYLPSLQSRLHAGSRRRRAKRRRAGPRRLDPYLHRRLLLLLLLRQPHCHPLRLTSPVVTFSVNKLR

SEQ ID NO: 106686 - protein, 401 aa, Triticum aestivum
  unsure (1)..(401): unsure at all Xaa locations
  Clone ID: PAT_TA_1104.pep
ANPISAGPPFAKPSATAAAQPPPPPHGRPLLLLPPAASAGDALPAPAASDAPEVTLPAAAPDLDKEFGFQRAELGKEKLAGTVGFHERHVFLCYKGPEEWPSHVEASESDHLPRLLAAAIKARKPNLKKSTKLTICEGEDGTESSLGDVLIFPDMIRYRGLTHFDVDNFVEEVLVKDTEWLPGSPEAIRGSYVFVCCHGSRDKRCGVCGPALITRFKEEIEAQGLDGHVAVSACSHVGGHKYANVIIFSPDAKGEVTGNWYGYVAPDDVXVTTQTNGDLRHVTLVCAGQESSAKESPEANGTDGAPAGGCCQGNGGALSCCQSDLPAGKQDKSIPAEQNHKISTTESDKENGAASKKGRMKICRMPTWFETWDKSDTYTTLAVVASAATVFAAFRCYKAMN

SEQ ID NO: 106687 - protein, 405 aa, Triticum aestivum
  Clone ID: PAT_TA_1105.pep
MADPSPSSPTAASAGDALLAPDATLPAAAAPDLDKEFGFQRAELGKEKLAGTVGFHERHVFLCYKGPEEWPSHVEASESDHLPRHLAAAIKARKPNLKKSTKLTICEGGDGTESSLGDVLIFPDMIRYRELIHLDVDNFVEEVLVKDTEWLPGSPEAIKGSFVFVCCHGSRDKRCGVCGPALITRFKEETHLPEGLGLCDQGSVSACSHVGGHKYAGNVIIFSPDAKGEVTGHWYGYVAPDDVPVLLRQHIGQGEIVGHLWRGQLGLSEEQQKKALELRHATNGLTEEESSAKESPEANGTNGAACNPAPAGGCCQGNGGGLTCCQNDLPEAKQDKSIPAEQNHKSSTTECDKENVAATKKGRMKICRASTWFETWDRSDTYTTLAVVASAATVFAAFRCYKAMN

SEQ ID NO: 106688 - protein, 136 aa, Triticum aestivum
  Clone ID: PAT_TA_1106.pep
THHSQDPNRVFSTSMNIPLILSIVNSCTFCTILAAASYLQIGFSHNSQSHRKIESRISTTSISQYTKEGGSIITTPSLVSIAVSCTKLNHDKPTPILMLASLAFPDETGGKDGNLPCFGVLPSGVVGLTCSISEMK

SEQ ID NO: 106689 - protein, 278 aa, Triticum aestivum
  Clone ID: PAT_TA_1107.pep
GALRNLLLPLLQLRVSRDSSFPARSRILSAGNARRRSDGGGARRVLVHSRCRFSFRSGVLGVMPRTGDMPMRSAPPARTSSAWWLAAMLWLVAVAWCYSLLRDSSSAHPPISSVAAMIWRRIRPLPLLLQAAMEVDGAMVMLEDLVFAGGFGAYQQRQIRWSYSARWQPVFHTMALPLLAEWRPCISSQPKSDRGGRCIFYLEFEAVPSCCDGLVAPSGASPATASLHPGRRCSGPDCNFQIQFRVLLVKIKGLGVIFLLCESLCGLCVVTAEVLMKI

SEQ ID NO: 106690 - protein, 114 aa, Triticum aestivum
  Clone ID: PAT_TA_1108.pep
CVATYCTPRPLVSREDLARRGTGGGRPCYVCGGRYDGRHGGDEARGAAPGPTITAVEAAAGDRHHLAVARGQRQEHQQDGHADHLGSHRRGRGTGSPFGSLWSRVSVCGSSMAV

SEQ ID NO: 106691 - protein, 93 aa, Triticum aestivum
  Clone ID: PAT_TA_1109.pep
MDYRFYCMTLRMSIDCNGCYQKIRRALLQMQELESHLIDRKHGRVSVWGAFSPQDVAIKIRKRTNRRVEILELREATGPGGGDEQGAGGGQMP

SEQ ID NO: 106692 - protein, 54 aa, Triticum aestivum
  Clone ID: PAT_TA_1110.pep
TPPPSPPPTPGTRPINYYRADGQNTGNFLTDRPSTKVHAAPGGGSSLGYLFGGK

SEQ ID NO: 106693 - protein, 101 aa, Triticum aestivum
  unsure (1)..(101): unsure at all Xaa locations
  Clone ID: PAT_TA_1111.pep
MSRGGSAGGGQSSLGYLFGDGEPAKPAAAPAAKPAPAEKPAPAAADVTKQIPAGIPGSRANNYYRADGQNTGNFLXTDRPSTKVHAAPGGGSSLGYLFGGK

SEQ ID NO: 106694 - protein, 101 aa, Triticum aestivum
  unsure (1)..(101): unsure at all Xaa locations
  Clone ID: PAT_TA_1112.pep
VVAGSAGGGQSSLGYLFGDGEPAKPAAAPAAKPAPAEKPAXAAADVTKQIPAGIPGSRANNYYRADGQNTGQXSVTDRPSTKVHAAPGGGSSLGLLVWRGR

SEQ ID NO: 106695 - protein, 138 aa, Triticum aestivum
  Clone ID: PAT_TA_1113.pep
DPADPSPLTTTVVTVLRVRRLGPHRFHAHDQNHLQIRRPAESLPAVGTPETDADAASSFQERAKDILVVVSGLLFGFGCGALTAASMYLVWSLVASTGAASPYEELYSDDEDDDGAESPKKAGYVIIHGAEDVVAGKN

SEQ ID NO: 106696 - protein, 97 aa, Triticum aestivum
  Clone ID: PAT_TA_1114.pep
LEKDRKERVYLILRPTPSIMGARNATICFVLILVLFANHGSAEKKCWGNTSGSPLCVGFLCKATCLIGGKMFNADVKEHKCIGPAWSSECYCYFCDK

SEQ ID NO: 106697 - protein, 124 aa, Triticum aestivum
  Clone ID: PAT_TA_1115.pep
MCKHILNAQVAVRSPCCRKWFDCVECHGEQEDHPLKENYEMIFACKKCRKCFRKDVTEFEEADEFCPHCDNHFVIDAKTPQAALSVESEDVRMDNKMLRDDRQKTKTKGIRSIFDPSDDADKLG

SEQ ID NO: 106698 - protein, 200 aa, Triticum aestivum
  Clone ID: PAT_TA_1116.pep
MAATAMEHDGGAEVVVTPGELLGPSSSLEAGRGAYADGRSVRASVTGRRRFVAPAPGSSDQRSTVEVVGHKAHGAVPQPGSVVIARVTKVMARMASADIMCVDSKAVKEKFTGMIRQQDVRATEIDKVDMYQSYRPGDIVRALVLSLGDARAYYLSTAKNELGVVSAQSIAGGTLVPTSWTEMQCELTGQIEQRKVAKVE

SEQ ID NO: 106699 - protein, 163 aa, Triticum aestivum
  unsure (1)..(163): unsure at all Xaa locations
  Clone ID: PAT_TA_1117.pep
MAPIKVGINGFGRIGRIVFRNAVEHPDIEVVAVNDPFIEPHYAVYMLKYDSSHGIFKGEVGNQGNDLVVNGKTIKFYSERDPANIKWSETGADYVVESTGVFTTIDKAKAHLQGGAKKVIISAPSADAPMYVVGVNENKYDGSADIISNASCTXNCLAPSQHK

SEQ ID NO: 106700 - protein, 185 aa, Triticum aestivum
  Clone ID: PAT_TA_1118.pep
MGLLSIIRKIKRKEKEMRILMVGLDNSGKTTIVLKINGEDTSVISPTLGFNIKTIQYQKYSLNIWDVGGQKTIRSYWRNYFEQTDGLVWVVDSSDVRRLDDCRAELHNLLKEERLAGSSLLVFANKQDIQGALKPDEIAKVLNLEAMNKDRHWKIVGCSAYTGDGLLQGFDWLVQDIASRIYVLD

SEQ ID NO: 106701 - protein, 221 aa, Triticum aestivum
  Clone ID: PAT_TA_1119.pep
MAISHLTRRLLSPSTAKAAATAKLFPGTSFSNPHAYARNPLLLLDPHRRFSTSPNTTPNPAAAAAPAPEATPLESMKHQEIEGPTVERDLSPLADEARAELDALRRAAQRLSASLAILGGTHLAAGAWIASGAAPVGVESAALVQGVAAFAFPFTAALVLRRVIKPVAFFQKMEANGRLQVLTLCLQASKNVNLMMLRTRVLAISCALGVSVGSVATILMR

SEQ ID NO: 106702 - protein, 151 aa, Triticum aestivum
  Clone ID: PAT_TA_1120.pep
MAKCSKIRNIVWLRQTLRRWRSRAAARTAAGGGAGAVSVPAGHVAVCVGGSSRRFVVRAAHLNHPVFRELLRQGGGEVRWLRNLRASCGPIALSHPFTPFEHALREISSSLPGAHSFTLDDIKSGAYSCCCAAAGDALPLLRGISSDKFVW

SEQ ID NO: 106703 - protein, 232 aa, Triticum aestivum
  Clone ID: PAT_TA_1121.pep
MAPKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTGSVLCLTTVKNEDKLEFSKILEAIKANFNDKFDEVRKEWGG

SEQ ID NO: 106704 - protein, 228 aa, Triticum aestivum
  unsure (1)..(228): unsure at all Xaa locations
  Clone ID: PAT_TA_1122.pep
MAPKRGGKAPVRAKKKAADKVVNPLFEKRPKQFGIGGALPPKKDLHRFVKWPKVVRIQRQRRILQRLKSTVPPTLHQFTRTLDKNLAXTNLFKHASPSTAPEDKVAKKERLLKRAQAEAEGKTVEAKKPXVVKYGLNHVTYLIEQSKAQLVVIAHDVDPIXLVVWLPALCRKMEVPYCIVKGKSRLGSIVHKKDWXVMCVTTVKSEERRDFGKILXEANKANVNDAFA

SEQ ID NO: 106705 - protein, 207 aa, Triticum aestivum
  unsure (1)..(207): unsure at all Xaa locations
  Clone ID: PAT_TA_1123.pep
MARLLLFAADHTAGAPGAASLALVVLVVLVVAAVVVSLCTSSTHEKLWGQQRGSSSSAPLDKADSSVRRDAXRKRLLSATLSGIGGKAARMVSXNRRSPSGSSDDDKEAGAALGPEDDEAVWRKAIIMGDKCRPLQFSGHIPCHSDATLPPTPPPTTNPAPPDVPATYAASSPSPLDPCSPAAPNPPEAPPFPLDLGAPVRTTAYLT

SEQ ID NO: 106706 - protein, 178 aa, Triticum aestivum
  unsure (1)..(178): unsure at all Xaa locations
  Clone ID: PAT_TA_1124.pep
MDADADTVVFEAPAHFRFYKSGRIERLHRPPILPAGDDEATGVTSKDVVLDADTGLSVRLYLPKLQEPSTKLLVLVYFHGRAPSSSTSADSSTYHNXVNALAAAAGVLAVSVDYRLAPEHPAPPRATTTPWAELQSAALXKDAWIREHGDXARLVLAGDSAGXANIVHDMLMLGQGHI

SEQ ID NO: 106707 - protein, 233 aa, Triticum aestivum
  Clone ID: PAT_TA_1125.pep
LIHQPPVRARSPAGQSRRSNGVHGATRGVHRRRPPRRRPLPGGAGGGGGRVGRAGVVRDPGERGGGVPGGLRHAPRRGLRPLRALPERGRAQRRRLRVRRDPRPGGAGHEDRRRPRRQHGGQDRGPGGARGRGRRRPRPVRPLPGAVRRRRRPAPRRAGQPAGQRVRPGHAAADGGAGRVPELRGRLEGRPGARLSRRRPRPRVPAPRPHSHRLYPRRRQMIMHCRRHGPDRR

SEQ ID NO: 106708 - protein, 135 aa, Triticum aestivum
  Clone ID: PAT_TA_1126.pep
VNVPEDEEEFLSVYVGNLSPATSVFDLEKVFQAFGRIKPDGVAIRSRKEAGVFFGFIEYENMSGIQNALDASPIELNGRLVHVEERRPGSGVFRGGGRRGRGRGQYGGRYDGDYAARSKGNGYQRRGGHQYDGYD

SEQ ID NO: 106709 - protein, 101 aa, Triticum aestivum
  Clone ID: PAT_TA_1127.pep
DVFHKTISRLFFSLLVFNNSILAFVVSVLSQDLVSLRSRVIVMLLFPTHHLVCQRSWSFRAYPFNRSVVFSFEFSNFIKFSLLPQLESCLKSFLPIVPFFQ

SEQ ID NO: 106710 - protein, 176 aa, Triticum aestivum
  unsure (1)..(176): unsure at all Xaa locations
  Clone ID: PAT_TA_1128.pep
VRRGPCAALPLSTAATIGVLKKIYPPLALVCIYYSKNTLNQGERAEKPWCIRWREADERSPFGRLTTGGVLRAPRRHASSSTLVNPRGSASSRNAGRPRPXXPSPFXKVHRXSNWWPXTXQXAKQVXLPAXXNKGRFPXGFQGQIRXXPXSKMEGGXPFXAXYSPVVXSLRDPPGG

SEQ ID NO: 106711 - protein, 206 aa, Triticum aestivum
  unsure (1)..(206): unsure at all Xaa locations
  Clone ID: PAT_TA_1129.pep
VAAYSRASMGGYISSQXVRKIIENNPYMLGTMAGGAADCQFWHRNLGVKCRLHELANKRRISIAGSSKTLANILYSYRGMGLSIGTMIAGFDETGPGLYYVDSEGARLKGSRFSVGSGSLYAYGILDEGYKFNMSVEEAAELARRAIYHATFRDGASGGCVSVYYVGPDGWKKLSGDDVGELHYHYYPVQAAPVEQEMAEAPSAST

SEQ ID NO: 106712 - protein, 255 aa, Triticum aestivum
  unsure (1)..(255): unsure at all Xaa locations
  Clone ID: PAT_TA_1130.pep
MIPNLSALENHFGAAAAGSDDFAGLFSADAAAPLALELPTCTDLTLGSTKATRAMVNNKQGTTTLSFIFDKGVXIVAADXRASMGAYISSQTVRXKIIEXNPYXMLGTMAAGAADCHMVWHRNLEGQXRRDELAIQRRIXIAVSSKTLPNILYSYRGMGLSFRTMIAGFDETGPGXCYEFLNRRGVQVVGGXSHFSVCSGXSLYAMWLSWDKXYIYMMKLLRKLIMLARRAIYQXATFRDGASGGLLLVSTIVGP

SEQ ID NO: 106713 - protein, 222 aa, Triticum aestivum
  unsure (1)..(222): unsure at all Xaa locations
  Clone ID: PAT_TA_1131.pep
ARGTGTHPTATRCRPPPWKKPAAPPWPXPVRSPPPEPAAEAQPPPPSSPPSQLPATDPFRLSPDNPTPAHPLPAAPTTTAPAPSTGPFRLSPDNPTPAPPLPAAPTTTAPAPSTVPFRLSPDNPTPAPPLPAAPTVTAPPPDGADDSSSPSPPSPPKAPTHPPLSTTDPSPPLPRGNQTSAPRRTPPSPPARAPAPAAPPPPVPASPEAKPEQEADEAPGES

SEQ ID NO: 106714 - protein, 137 aa, Triticum aestivum
  Clone ID: PAT_TA_1132.pep
VSPRHRPASPPHPISPAVAMDMAAMNDPERLFFFDLACKTAKSTYDENPLDADNLTRWGGALLELSQMHNGPESLKCLEDAESKLDEALRIDPNKADALWCLGNALTSRGFFTSETGQANECFEKATGWFQRAGDVE

SEQ ID NO: 106715 - protein, 88 aa, Triticum aestivum
  Clone ID: PAT_TA_1133.pep
DLAKVMERKWCFHVAVFCGIFRHAAGLDEVCLVIRRWICFLLYALLLLAGTIAVVMAFSHALDNTVLSTDVLISGIYLLSVIILFVCQ

SEQ ID NO: 106716 - protein, 297 aa, Triticum aestivum
  Clone ID: PAT_TA_1134.pep
SARGRPPLRRPRLRPWLCRCPTTAAGRRSLPPRLSSRPPPPARGVRAHPQPARGLKPLGPKTLGKPPAQPRLAPAPELAAVAVADADAMDMAAMNDPERLFFFDLACKTAKSTYDENPLDADNLTRWGGALLELSQMHNGPESLKCLEDAESKLDEALRIDPNKADALWCLGNALTSRGFFTSETVQANECFEKATGCFQRAVDVEPANELYRKSLDLSSKAPELHMEIHRQIASQASQGAPSSSNARQSRKKKKDNDFWYDLAGWGILLVGIGVWIGVANSQAKEAQPPHMSQPNM

SEQ ID NO: 106717 - protein, 181 aa, Triticum aestivum
  Clone ID: PAT_TA_1135.pep
PTRPANHHKGFCPVCRKVFDEKDIEHVRDLLDANTSQLMACLTVDLGVDDKELLHSEAEKKRREKFGSLFNLQQERNGLIEPKKDLAIQPGMYVSLAASEPTTSAGDSTNSWEATASSTSETVLPGMANISGGGKKENNSGPPRRNRAYAPRRQPHVQPVGKQWQRSQPARQQWQKKDAET

SEQ ID NO: 106718 - protein, 224 aa, Triticum aestivum
  unsure (1)..(224): unsure at all Xaa locations
  Clone ID: PAT_TA_1136.pep
IRHEASEGVQPRAAGAAAPGEEVRLEVEAVAAVYGEDCRVYCDFPPHLVVHVRPNTADDSSQQFVELFLGIKASSQYPKEPPHVYAVESKGLDENRQAYLISSIQDKAKEHSYYPMLVILCEEAGEILSNMNHPAGDCPMCLYPLVSENNHDSALPFMKLMSCYHCFHSDCIMRWWGWLQHDDANSKKIDNSIYRRRXRLSNSDKLYNANHHKGFCPDCRKVFD

SEQ ID NO: 106719 - protein, 110 aa, Triticum aestivum
  Clone ID: PAT_TA_1137.pep
GAFFIQPEYHVTTLLVTVASFAVTWSSFWRHNDYGFLILMINKRRLRVMVANISAGKPVHYGYKYAITWAYGTRLQSRALTSSVSLCWGSTSAYFIHFNKGSGIGVVRLA

SEQ ID NO: 106720 - protein, 138 aa, Triticum aestivum
  Clone ID: PAT_TA_1138.pep
SISNSRAKLAPRRKLDRLSARATRRVASAGAQNRRARYNGLSARWKILTRAAYFGRQLQCAAHSSARAALSSLLVLRPARAGAGALPPTHGRAHRRPAHPAVPPPPPPETLAREALASPPPELRRASASRAASSCHRG

SEQ ID NO: 106721 - protein, 258 aa, Triticum aestivum
  Clone ID: PAT_TA_1139.pep
PAFTLFHHTHNMADNIKDILADDSVTVQDAAKKITSSCITAIEKNEDASKIEHDLHALWSGILTAAEQTPHDRQDKLVQVMQAIKELAPSGDKAKKFVVWGEETRWDALPLFGSTARDELDRAQEDSENACVNINAFFARVTTAGVDDFTLYAIWTLREAIEDPAADEIAQKTSPKLLKAAAVWFIYAGDSLTKATKEGKQFDGKMAKPGASLRDGAEWRGFCDDRWKAWQQRMSALNDADLPQDTKTLIEKACQGLN

SEQ ID NO: 106722 - protein, 171 aa, Triticum aestivum
  Clone ID: PAT_TA_1140.pep
APTFPVCLSSRRRRRRQEGERRTLAARGTPRSPRPATMAMAAVRCAARRLGGSLLQPTQAAVAEEGRRLVPSRFMRSRHLSTKHASETWMEKKMQKLRSMWAQYKADIERRMREPPEEDEFKLLVESYARTIDGVVHGTAKMALLCIIPFALFAGDNNKGVEAESVTKEDQ

SEQ ID NO: 106723 - protein, 194 aa, Triticum aestivum
  Clone ID: PAT_TA_1141.pep
LPRDCKEKFVRPRVRRSPRPATMAAVRCAARRLGGSLLQRTQAAVAEEGRLLSPSRLMRSRQLSTKVSGERSQVAERHLLEPGSLMRSRQLSGEHARNIQKKEDDCWAGFIETLKRLDELEKKKKPNVFKQRMISIDRALKSLVYGSFKVTVVYVAAASAFSDSGLASPRYQGKRVKTRWKNENQRWPPSLFYV

SEQ ID NO: 106724 - protein, 165 aa, Triticum aestivum
  Clone ID: PAT_TA_1142.pep
LNLKQAGPSLVLIVPSCLHWLPLVTACASTPSPPKATAVTIQKAANLTTPLTTPSAARPMDFKRNINSSGCSFSNLSNVAPSFALVSFNLASTSDGSSSFWILPACLVESWRERMNLLGTSGRPSSATAACVRWSSEPPKLLAAHRTAAIVAVLADLGVPYSSRG

SEQ ID NO: 106725 - protein, 192 aa, Triticum aestivum
  Clone ID: PAT_TA_1143.pep
VWLSSRRRRRRQEGERRTLAAQGTPRSPRPATMAAVRCAARRLGGSLLQQTQAVVAEEGRLLAPGRLMRSRQLSSQVSGERSQVAERRLLEPGWLMRSRQLYSKTPKKKKLSALESEFLWTQETLNASCDRLEELQKKAAPDAFKLGVKTYGRVAKGVVSGAAKLTFCFCMVTSVIFGDKGVQSQAVTNENH

SEQ ID NO: 106726 - protein, 188 aa, Triticum aestivum
  Clone ID: PAT_TA_1144.pep
PRQLSPSVFLLGGGERGTLAARGTPRSPRPATMAAVRCAARRLGGSLLQRTQAAVAEEGRLLSPSRLMRSRQLSTKVSGERSQVAERHLLEPGSLMRSRQLSGEHARNIQKKEDDCWAGFIETLKRLDELEKKKKPNVFKQRMISIDRALKSLVYGSFKVTVVFVVAASAFSDSGPLPRKTCEDKVEK

SEQ ID NO: 106727 - protein, 160 aa, Triticum aestivum
  Clone ID: PAT_TA_1145.pep
FNLKHLGPSLVLIFPIISHWLSLVLASASTPSPPKATAAATNTSVNLAAPTTTVLAARPIDIMRSTNTDGPASFWSSANLSNAAFIFFQSNSSSFRILPARSPETWLESWRERMSLLGASRRGPSSTTAACVRWSREPPILLAAHRIAAIAASLADVGGG

SEQ ID NO: 106728 - protein, 185 aa, Triticum aestivum
  Clone ID: PAT_TA_1146.pep
AQAKAQHPHQLSPSVFLLGGGERRTLAARGTPRSPRPATMAAVRCAARRLGGSLLQRTQAAVAEEGRLLAPSRLMRSRQLSTKVSGERSQVAERHLLEPGSLMRSRQLSGEHARNIQKKEDDCWAGFNETLKRLDELQKKKKPSVFQQRMISIDRALKSLVYGSFKVTVVYVAAATAFSGSGLEA

SEQ ID NO: 106729 - protein, 791 aa, Triticum aestivum
  unsure (1)..(791): unsure at all Xaa locations
  Clone ID: PAT_TA_1147.pep
MTMMAMPEAPCLCARPSLAARARRPGPGPAPRLRRWRPNATAGKGVGEVCAAVVEAATKAEDEGEEDEPVAEDRYALGGACRVLAGMPAPLGATALAGGVNFAVYSGGATAAALCLFTPEDLKADRVTEEVPLDPLMNRTGNVWHVFIEGELHDMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECEGLGLEDFPTAERXLQWHGHQPGKPDWSENSRFVAFSMKDERQGEIYVAFNTSHLPAVVELPERTGRRWEPVVDTGKPAPYDFLTDDLPDRALTIHQFSHFLYSNLYPMLSYSSVILVLRPDV

SEQ ID NO: 106730 - protein, 300 aa, Triticum aestivum
  Clone ID: PAT_TA_1148.pep
MLPWATAAEAEAALGRAMTAAEALWFRWTAETSDYYLYCLNILFLLVVFTLAPLPVALLELRAPRAVGPYKLQPRVRLSRAEFLKCYGDVMRIFFLVIGPLQLVSYPAVKMVGIHTGLPLPSLGEMAAQLLVYFLVEDYLNYWIHRLLHGEWGYEKIHRIHHEYTAPIGFAAPYAHWAEVLILGIPSFAGPAIAPGHMITFWLWIILRQMEAIDTHSGFDFPFSLTKYIPFYGGAEYHDYHHYVGGQSQSNFASVFTYCDYLYGTDRGYRFHKAYLAKLKDLAPSDGEKGADGFAYAKLD

SEQ ID NO: 106731 - protein, 218 aa, Triticum aestivum
  unsure (1)..(218): unsure at all Xaa locations
  Clone ID: PAT_TA_1149.pep
MDRVQLVLLGLPILLFCSDVVTLFAPQPPAAPKPHRHPQPAAGAFQPGDSSPDAADSAQLAEAQVDGPGSGTTVELKFCASCSYKGNAMTMKRMLDTSFPGIHVVLENYPPPFPKRALGKMVPFVQVGAIATLMAGDQIFPRFGMVPPPWYYSLCANRFGTMASVWMFGNFAQSLLQSSGAFEVYCNGQLVFSKLSEQTSPPXVELXELIGNRLSDSQ

SEQ ID NO: 106732 - protein, 83 aa, Triticum aestivum
  Clone ID: PAT_TA_1150.pep
SSQYSYYRSCCQGCERGSRVASEGAPSREMCSYNATSRRCRRPPWMSGGCESFPRKAHSIMEWLSLQKATLATETSIHLCHHQ

SEQ ID NO: 106733 - protein, 118 aa, Triticum aestivum
  Clone ID: PAT_TA_1151.pep
AAAQAPELTVMAMAEAESNGFEFLSDPVDRFPLMDLSGGNCAPSNEAIEALICAPSDSSMGDAGDRALTMEADLNSTCDDVPLSAPPSEPSTGKDDPQGTWLDREVKRDDCDRLVPFM

SEQ ID NO: 106734 - protein, 97 aa, Triticum aestivum
  Clone ID: PAT_TA_1152.pep
MGRHSSSGKPEAGGEQYRKEEKHHKHMENLAKLGAVAAGAYARHEKHEARKDPEHARSHKIKEKIAATVAAGSAGFAIHEHHKKKEAKKNARHAHRH

SEQ ID NO: 106735 - protein, 300 aa, Triticum aestivum
  Clone ID: PAT_TA_1153.pep
MRNFVEKLVLSLLWISLFQGCMVQSVEYDHTASIECLRDPMKPLYKGGIIQNSEFNNGLMGWSTYRNIKAGVGKSASGNRFAVVQGAISSLFSAAGDAAASQSHSVYQKVQMQGDTHYSLSAWLQVSAGTAHVRAVVKAPNGENITAGGIDAQSGCWTMLKGGMTAHTYHSGQGEVFFQSDTPVDIWVDSVSLQPFSFDEWDAHARRSADKARRSMVNVVARGPDGQPMANTNVSIQLLRTGFPFGNTMTKEIISNPAYEKWFFSRFTVATMENEMKWYSTEWNQNQEDYKIPDDMLKMA

SEQ ID NO: 106736 - protein, 112 aa, Triticum aestivum
  unsure (1)..(112): unsure at all Xaa locations
  Clone ID: PAT_TA_1154.pep
MRFVAAYLLATLGGNSSPTKDDVRAILGSVGAEVEEGKLDALFKEVEGKDLAELLAAGREKFAFAPXAGAGAAMGASPVAAGDAAEEKKEKAQEKKEEEEEEEDLDMFSLFD

SEQ ID NO: 106737 - protein, 134 aa, Triticum aestivum
  Clone ID: PAT_TA_1155.pep
TTSHTIPTVPMELNNSIASFSFTTYTQRSLGARARPAGISSTLGGTAWPQGKPCPRTPSRRRIRTHLPLLLWPSSASCPPSLPAGTGQEAASCIAATSPRSSTGWGHRSSPPAVTPRSRQSPNPSSGRCPARPA

SEQ ID NO: 106738 - protein, 249 aa, Triticum aestivum
  Clone ID: PAT_TA_1156.pep
GTGTLFFLFSSFCLLARQAAAGGYGGWQSAHATFYGGGDASGTMGGACGYGNLYSTGYGTNTAALSTALFNDGAACGTCYELRCDNAGSSCRPGSILVTATNFCPPNYGLPSDDGGWCNPPRPHFDMAEPAFLHIAQYRAGIVPVSYRRVPCVKKGGIRFTINGHSYFNLVLVTNVGGAGDAQSVSIKGTRTGWQAMSRNWGMNWQSNADLDGQSLSFRVTLSDGRTVTSNNAAPAGWSFGQTFEGAQF

SEQ ID NO: 106739 - protein, 296 aa, Triticum aestivum
  unsure (1)..(296): unsure at all Xaa locations
  Clone ID: PAT_TA_1157.pep
MGTSAGSSLRLFVLFAVATCLLWSTASGFSASGVSRAFATFYGGSDASGTMGGACGYGNLYSTGYGTSTAALSTALFNDGASCGQCYRIRCDYAADPRFCIRGASVTITATNLCPPNYALPNDDGGWCNPPRQHFDMAEPAWLNIGVYRGGIVPVLYQRVPCAKKGGVRFTVNGHDYFELVLVSNVXGVGSIRSVSTQRPPTGWMPVXGEGGQNWQSNAILVGQALSFRVTASDRRTSTSWNAAPQSWRFGQTFEGKNLVGAHRYLPFLFSGDGRRHGREVHRLIYKRVLLLHTSG

SEQ ID NO: 106740 - protein, 252 aa, Triticum aestivum
  Clone ID: PAT_TA_1158.pep
MAGAGALFFLFSFCLLARQAAAGGYGGWQSAHATFYGGGDASGTMGGACGYGNLYSTGYGTNTAALSTALFNDGAACGTCYELRCDNAGSSCRPGSILVTATNFCPPNYGLPSDDGGWCNPPRPHFDMAEPAFLHIAQYRAGIVPVSYRRVPCVKKGGIRFTINGHSYFNLVLVTNVAGAGDMRSVSIKGTRTGWLPMSSNWGVNWQSNALLSGQSLSFQVTSTDGQTLTFPNAAPVGWGFGQTFATNKQFS

SEQ ID NO: 106741 - protein, 279 aa, Triticum aestivum
  unsure (1)..(279): unsure at all Xaa locations
  Clone ID: PAT_TA_1159.pep
MASANALLLLFSAAFCLLARRAAGDYGSWQSAHATFYGGGDASGTMGGACGYGNLYSTGYGTNTAALSTALFNDGAACGSCYELKCQDVSSSCLPGSITITATNLXPPNYALPNDDGGWCNPPRAHFDMAEPAYLXQIGIYRAGIVAVAYRRVPCVKKGGIRFTINGHSYFNLVLVTNVAGAGDVQSVAIKGTSTGWQAMARNWGQNWQSNAYLDGQSLSFRVTPSDGRTVTSNNAAPAGWPFGQTLRKAPSSTRPARASPPVRRSVLFAFAWEREQEE

SEQ ID NO: 106742 - protein, 176 aa, Triticum aestivum
  unsure (1)..(176): unsure at all Xaa locations
  Clone ID: PAT_TA_1160.pep
CCKCAICLVSHLNMGEKCTWSTRPTAGGSPSLASLAFRDTFKAGASLYGIGDRTLLRAETHKFESRYMDNLVGSEGAYYERSPXINFVNKFTCPVIVFQGLEDMLMASGPGRARAKALKESGLPVALVEYEGEQHGFRKAENIKFTLEQQMVFFARTVGKFEVADDITPIKIENFD

SEQ ID NO: 106743 - protein, 160 aa, Triticum aestivum
  unsure (1)..(160): unsure at all Xaa locations
  Clone ID: PAT_TA_1161.pep
ARKAGSSACTLPTIPSSPSTPSPHHDQLLPQPKSLPASPATLPRGPMVFDNSWWLANNREIWEXAGXFEPERFLGEESNVDATVGGKVDFRFLPFGVGRRSCPGIILALPILALIVGKLVRSFEMVPPPGVDKLDVSEKGGQFSLHIANHSVVAFHPISP

SEQ ID NO: 106744 - protein, 277 aa, Triticum aestivum
  Clone ID: PAT_TA_1162.pep
MLPPAARLAARRLLGLASASASQSAARRLSPSPISSPAAAAATGYFSRSFSSALNYHIDSPDNNPNMPWEFTKANMDKVNEILSHYPSNYKQSGIIPMLDLAQQQHGGWVPVAAMDAIAKIVGVAPIRVYEVATFYSMFNRTKVGKYHLLVCGTTPCMIRGSRDIEDALLKHLGVKRNEVTSDGLFSVGEMECMGCCVNAPMIAVADYTKGSDGYTYNYYEDLTPKRVVELVEMLRRGETPPRGTQNPERKNCGPAGGMTTLLGEPKPPPCRDLDAC

SEQ ID NO: 106745 - protein, 193 aa, Triticum aestivum
  Clone ID: PAT_TA_1163.pep
AGLACFVLLYSLAFALCPAVLLIRLMGFPAVYSEMPRLLLNLLFLLGHLRRLSSWLLRLVGAGVDDDLCFDYSDASDFADHHQEQYQHQHRDHGLEELEEHSPAVRFDALSAASDGDDGTALLPEGCAVCLGDFHGAARVRRPRGCRHVFHRGCFGRWASHVYHTCPLCRAPLLPPAPASLGPVLLPMPLPAS

SEQ ID NO: 106746 - protein, 105 aa, Triticum aestivum
  Clone ID: PAT_TA_1164.pep
KYSLDLILPPFLNISLLRDFNKNYIYTHMYNHRIPSRDGRHESSKVYLVSTGEMFGRRDHPRDWIIRGGPAGGACHRLGWAKARRHRRPEAGAGFLTVCHGRSSR

SEQ ID NO: 106747 - protein, 85 aa, Triticum aestivum
  Clone ID: PAT_TA_1165.pep
TAPVRASPTASQTASPLPRPPASLARSFSIPSNSQRTPLITVNKLLEARSSRESSEISSPPLTPLFSTSQHKKQLKAALGEKGMS

SEQ ID NO: 106748 - protein, 152 aa, Triticum aestivum
  Clone ID: PAT_TA_1166.pep
LTDKLEARMHCRHAGWQANSRAEGGGMDRPASDAGAGSSLDDGDGRQDVMPLGCKLCIHTSQRRYVVAKGDETDGGSGGRCRPAREQAQSRRRMNCSRSSPLGSTFWRISTTFLWELEWMAGTKVGLAAGRVLREERGGCRGTRGAGGGRAG

SEQ ID NO: 106749 - protein, 125 aa, Triticum aestivum
  Clone ID: PAT_TA_1167.pep
WPPPPNGPSATPSATAAPTTPSATGSSASTPATASPTSAATTSRAPAPPRSAPPALPPAATSPSPLAGATSLAPTTASPLFLSCPTLSVRSSGLLTPTSSLLVPRLSSLISLMLLLRSPNKRFHE

SEQ ID NO: 106750 - protein, 361 aa, Triticum aestivum
  Clone ID: PAT_TA_1168.pep
MASSPLLVALVMVSACFLAVSGQKFNAIYSFGDSMSDTGNLCVNGPPAGLTLTQPPYGETFFGRATCRCSDGRLVVDFLAEKFGLPLLKPSKQGGANFKQGANMAIIGATAMGSSFFQSLGVGDKIWNNGPLDSQIQWFQNLLPSVCGSSCKTYLSKSLFVLGELGGNDYNAQLFGGYTPEQAAGQSPTIVDAIGAGAEKLIGLGAMYVVIPGVLPVGCFPIYLTLYQTSNAGDYDQYGCLKRFNALSARHNSLLQSKVSSLQSKYPYAKIMYADFYSHVFDMVKSPTSYGFSTNLRACCGAGGGKYNYQNGARCGMSGASACGNPSSSLSWDGIHLTEAAYKKIADGWVNGPYCHPAILS

SEQ ID NO: 106751 - protein, 192 aa, Triticum aestivum
  Clone ID: PAT_TA_1169.pep
RPGSEPHPNPISRCLLLLPSRTLAAAATTMAATNGATAAADPVQEQPKAAAPLLLKVKRLSANAVLPSRGSALAAGYDLSSAVEAVVPARGKALVATDLSVAVPEGTYARIAPRSGLAWKHSIDVGAGVVDADYRGPVGVVLFNHSDADFAVKPGDRVAQLVVERIATPDVAEVDDLDATVRGEGGFGSTGV

SEQ ID NO: 106752 - protein, 228 aa, Triticum aestivum
  unsure (1)..(228): unsure at all Xaa locations
  Clone ID: PAT_TA_1170.pep
MRFQMIPLLAVASCATVNASPVQHEPRAAGCSSYTIINTRGTGEMQGPSSGFRTMNSQITSQVSGGKIYNTVYPADFSQNSASGTRDIVRKVNSVLSSNPSECFILEGYSQGAAATVNALSQLTGSAKDAVKGVFLIGNPLHKRGLECNVDNKGGDTTKNVSGISAFGGGGIPQDWVSKTLDVCIYGDGVCDTTHGSGINGPHLQYPRDSSTQDLGTXYVVKQLTGSN

SEQ ID NO: 106753 - protein, 102 aa, Triticum aestivum
  Clone ID: PAT_TA_1171.pep
KAEKLLATNLPFPYTSNDVYENSMRMPLGPDFNPAISLSALNRPAIVKKPGVVIKPIQYGEIDPHEKPDELKRVIQRVKPNPNIKKASAKQAKRTASHRRTG

SEQ ID NO: 106754 - protein, 130 aa, Triticum aestivum
  unsure (1)..(130): unsure at all Xaa locations
  Clone ID: PAT_TA_1172.pep
MKSQRKRKNLKXRKDAKLKHVIISEHVDKKAXKLLATNLPFPYTSNDVYENSMRMPLGPDFNPAISLSALNRPAIVKKPGVVIKPIQYGEIDPHEKPDELKRVIQRVKPNPNIKKASAKQAKRTASHRRN

SEQ ID NO: 106755 - protein, 294 aa, Triticum aestivum
  unsure (1)..(294): unsure at all Xaa locations
  Clone ID: PAT_TA_1173.pep
SLDVCRKGVRSMVLESSPALRTSGFAFMTWTNAFRALDALGVGDKMRSHHLQVQGYVYSTARSQSPXVSEAYHEVHSPPESHEARCVHRHVLQRCESWISECKANCEISRSHLQQTRTEKAAGGDAKILHLADGSTLRAKVLIGCDGINSVVAKWLGLAKPLDSGRRATRGHAKYPDGHGFQPKFMQFSGNGFRAGLVPCGDTDVYWFLTWSPSCPDGTEDVDPSPAEMKQFVLAKLRSIKAPAEVLEAVERSEMNDVLVAPLRYRPPLSLLFGSISKGNVCXAXEXLHXTTPD

SEQ ID NO: 106756 - protein, 256 aa, Triticum aestivum
  Clone ID: PAT_TA_1174.pep
MLMLRAATARAASTVVAGARRRPGLLPVAVAGLSSSSSGPPSGGKRRKGQRRGEAKPQPQPLPGHSEIPSNKKANARPAKDRRKVRPAEEAPQGPSGQGQEIELRKQPPEKPKRVVRWRCATGCGACCKLDKGPELPAAVEVFADFPDHLQLYKSMIGPDGWCNNYDKSNRTCNIYEDRPFFCRVEPKVFEEFFGVPRSKFDREACSACVDNIKIVYGQDSPELGNFKRAIREESSKHEASMNEVKLLDATNTTGT

SEQ ID NO: 106757 - protein, 153 aa, Triticum aestivum
  Clone ID: PAT_TA_1175.pep
FKPAPNPKQARTPRVKSATCQPASLQRSPTPPRPRPCPPPPPRPWARSPRPPPWRSPAPSSSSPSAASPSPASTTTPLPRTTPRPFVHASPPPPPPPPPQTSGRAVGSCGGRGRSGCASRRESSTMRARPPRPGPPPRPRRRRQRPSRRAGEA

SEQ ID NO: 106758 - protein, 114 aa, Triticum aestivum
  Clone ID: PAT_TA_1176.pep
MERRAARGTSDHRRRMQMPPAPVGQKQQQPQRRGGPKSCQRTPPPPGCFTIQLLMVFLWVAASLAFLPLVLPPLPPPPLSLLLVPVCLLAVLAALAFVPLDAHNNVVVGGSSCL

SEQ ID NO: 106759 - protein, 222 aa, Triticum aestivum
  Clone ID: PAT_TA_1177.pep
MASTALSTASNPTQLCRTRASSLCKPVKGLGFSRERVPRNITCMAGSISADRVPDMSKRELMNLLLLGAISLPTFGMLVPYGSFLVPAGSGSNAGGVAAKDKLGNDILVEDWLKTHGPNDRTLAQGLKGDPTYLVVESDKTLATYGINAVCTHLGCVVPWNAAENKFLCPCHGSQYNNQGKVVRGPAPLSLALVHADVDDGKVVFVPWVETDFRTGDNPWWK

SEQ ID NO: 106760 - protein, 170 aa, Triticum aestivum
  unsure (1)..(170): unsure at all Xaa locations
  Clone ID: PAT_TA_1178.pep
SPCPCPAAGSAPTPRILVPYPSFLLPXAGNRGSRARQGPASTTGIGVDGLVEDWVKTPSDQQRXRLPQGLKGXPPYLVVGTDXTLATYGXIHALCTHLGCLGPWNAAEHKFVCRCRRSEYHSQGKALPGMPCTSVAGPGSRPTCACSPVPLRRGWAASRTSRDRRTPPWW

SEQ ID NO: 106761 - protein, 81 aa, Triticum aestivum
  Clone ID: PAT_TA_1179.pep
QPPPPPPSPPPPPPPSPPPPPSPYPSPSSPPPPPSSPPPRRRLRFLSAGRFLWPAQPNTAMATIATAATKPKARPTTLLGA

SEQ ID NO: 106762 - protein, 309 aa, Triticum aestivum
  Clone ID: PAT_TA_1180.pep
MAALLMRRLAGTYRGRAPLAAAAVGGAALFYASSNPTIAHMEEKGEDAAAKVALNPEKWLEFKLQEKATVSHDSELFRFSFDPSTKLGLDVASCLVTRAPIGQEVEGKRKYVIRPYTPISDPDSKGYFDLLIKVYPEGKMSQHFANLKPGDVLEVKGPIEKLRYSPNMKRQIGMVAGGTGITPMLQVVRAILKNPDDNTQVSLIYANVSPDDILLKKELDRLASSYPNFKVFYTVDKPSSDWRGGAGYISKDMVLKGLPGPGEDSLILVCGPPGMMNHISGDKAKDYSQGEVTGLLKDLGYTADMVYKF

SEQ ID NO: 106763 - protein, 77 aa, Triticum aestivum
  unsure (1)..(77): unsure at all Xaa locations
  Clone ID: PAT_TA_1181.pep
TGSQVKAQSLQFVPTSTXAAMSMDQRCSIALGQDQVASWANEIRNSSGIWXPLCLHVPSMAVRLPRRKRHPTSDLYW

SEQ ID NO: 106764 - protein, 217 aa, Triticum aestivum
  unsure (1)..(217): unsure at all Xaa locations
  Clone ID: PAT_TA_1182.pep
MSPTMEEPLVDKTGGPKESLVVTEVKKQLYLAGPLIAGCLLQNVVQMISVMFVGHLGELALSSASIATSFAGVTGFSLLAGMASSLDTLCGQAFGAKQYYLLGIYKQRAILVLTLVSVVVAVVWAYTGQILLLFGQDPEIAMGAGSYXRWMIPALFVYGPLQCHVRFLQTQNIVLPVMASSDITELRHMLKCWMLENKIGSDRQGTLNLSNGVVGPG

SEQ ID NO: 106765 - protein, 431 aa, Triticum aestivum
  unsure (1)..(431): unsure at all Xaa locations
  Clone ID: PAT_TA_1183.pep
SLPVRFVALLGELGLSSASIATSFAGVTGFSLLAGMASNLXTHCVGKPSGAKQYHLLGIYKQRAIFVLTLVSVVVAVVWAYTGQILLLFGQDPEIAMGAESYIRWMIPSLFVYGPLQCHVRFLQTQNIVLPVMLSSGVTALNHIFVCWLLVYKLGLGNKGAALANGISYLTNLLILALYIRLSPSCKSTWTGLSMEAFRDILSFLRLAVPSALMVCLEWWSFELLVLFSGFLPNPKLEASVLSISLNTLSLVFRIPSGLGAAISTRVSNELGAGRPEAARLATHVIMALGLVSSVSVGLAIILVRNLWGYAYSNEKEVVEYIARMMPILAVTFLFDDLQCVLSGIVRGCGFQKIGAYVNLSAYYLVGIPAALYFAFVYHLGGMGLWFGLTCGLVVQTVLLMSITLRTNWDKEALKAKDRVFSSSLPVDLAT

SEQ ID NO: 106766 - protein, 180 aa, Triticum aestivum
  Clone ID: PAT_TA_1184.pep
MVSMAAAKLAVLLAVAALFAVAEAANPQEAHCWQCYYSCMQQKCGGYRNPAAHTAVDDGTAAASVPLNSTDGTTAVVHPADGGAAAHVAGGYESYCKCNKACIVDCYKALPPVCYQMCVSETCAKLPPCKQAECYKACGDKCYHKQPSPGPKPPSPKPPSPKPTPPKSAPPNHGGSPKPT

SEQ ID NO: 106767 - protein, 114 aa, Triticum aestivum
  Clone ID: PAT_TA_1185.pep
MEHGEGRHEAALRAVQRAPAKPWRGAGAPPPPRVYRVEPRDFRELVQRLTGAGTATTGSPAVGARKAPGHAAAAHGRREAAPVEQFDYSSWFSAPLLSPASMPAGMDAHHGALL

SEQ ID NO: 106768 - protein, 218 aa, Triticum aestivum
  unsure (1)..(218): unsure at all Xaa locations
  Clone ID: PAT_TA_1186.pep
RPVLFNIADHEAEHYLEMIRNHASGWLPEMRKDDYAVVEKRSLTTWMKGGLDYIVLKYLDTDGIRIISSVLGQSIALDHYIRQVDDMVEEFTEINRIMEKTGDFTMKRKKLFQLVGKANSNLADVIIRLGLFDRSEIAWKNANYAQILEYLREEYELNQRFGSLDFKLKFVEHNIHFLQEVLQNRRSNFLEWGVIILLAIEIVISLYEIXIKDSSMMS

SEQ ID NO: 106769 - protein, 111 aa, Triticum aestivum
  Clone ID: PAT_TA_1187.pep
ESQCLKFLARGVNMHPVRHMCFCNPFRCTVMCACSSNLIFAHYTRRKSVNVLKCPNDLWFFLKLKCPCFGNMYVHLGIINFTCILASVDLPCLFWFFAFGIAGCLPFYTDF

SEQ ID NO: 106770 - protein, 298 aa, Triticum aestivum
  unsure (1)..(298): unsure at all Xaa locations
  Clone ID: PAT_TA_1188.pep
MGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALQAGIPAGALNVVMGNAPEIGDELMQSTQVRKITFTGSTAVGKKLMAGSANTVKKVSLELGGNAPCIVFDDADIDVAVKGXLAAKFPNMGQT

SEQ ID NO: 106771 - protein, 383 aa, Triticum aestivum
  Clone ID: PAT_TA_1189.pep
MAMAMRRAAALGARHILAASASASSRVASRRHMGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMISGKVGAALGLQVGNGLQESTSQGPLINEAAVEKVEKFVGDASTKGANIMLGGKRHSLGMSFYEPTVVGNVSNDMLLFREEVFGPVAPLIPFKTEEEAIHLANDTNAGLAAYMFTKSIARSWRVSEALEYGLVGVNEGLISTEVAPFGGVKQSGLGREGSKYGMDDYLEIKYVCMGNLG

SEQ ID NO: 106772 - protein, 226 aa, Triticum aestivum
  unsure (1)..(226): unsure at all Xaa locations
  Clone ID: PAT_TA_1190.pep
NGMILFLRLKKKKLQELGMTKQNCQEVSWVQSTVFFGFSTTSIPTEQLLNRSSNPRYYLKAKSDHVQEPIPRDVWESIWTAWLEKPEAALLMLDPYGGLMSSISPSKTPFPHRQGNLYQLQYYSFWYENGTAAAEKRMSWVRGLYKEMEXYVSKNPRAVYVNYRDLDLXGRMSWTATVTSYEKARVWGEKYFKGIFKRFAAVKGMVDPDDFFKNEQSIPPLPAAKI

SEQ ID NO: 106773 - protein, 136 aa, Triticum aestivum
  Clone ID: PAT_TA_1191.pep
MTKHQRAPADQLVSLSLSLSLGAVADRNSKRTRRAAAAGGEFMCKTCDRSFPTFQALGGHRTSHLRGRHGLALALAGTGPEPRKATDQKQGRQRHVCGQGFEMGQALGGHMRRHREQEAAATAVAQAPPVLLELFV

SEQ ID NO: 106774 - protein, 153 aa, Triticum aestivum
  Clone ID: PAT_TA_1192.pep
MTTEAAVRKFFTSSAYAVAGASSNPAKFGHRVFVWYLQHDLPVTPINPGSQTINALNKDHATVPNVTALPNPTETSLSVITPPAATLQVLQEAKEKGIPSIWLQPGSFDDAVLKFANSPGTFEAVIAGDGGRGHEGWCILVDGERGMKAAGKL

SEQ ID NO: 106775 - protein, 272 aa, Triticum aestivum
  Clone ID: PAT_TA_1193.pep
MVSVNVGLVHYVLDHIYGTLLHRTKLGTPFFAPRGRGTKLDLLERMVKQLFPEAPCQNWPPTAVQPKWKTVWETKNSCLREGVFRTTCDERLIDALPPESHNARVAFLTPKDVSPEKMACVVHLAGTGDHSFERRLRLGGPLLKDNIATMVLESPYYGQRRPSMQHGAKLQCVSDLLLLGKATIDEARSLLYWLQAEAGYGKMGICGLSMGGVHAAMVGSLHPTPIATLPFLAPHSAVVPFCEGLYRHATAWEALTEDAAALAKDATSLTED

SEQ ID NO: 106776 - protein, 216 aa, Triticum aestivum
  Clone ID: PAT_TA_1194.pep
MKSRRQSGRGGAMVADGGCKMERKDVEKNRRLHMKGLCLKLSSLVPASSSSDHHLRHYSSSPPSSNKDAATQLDQLDSAAAYIKQLRGRIDDLKRRKQAALSGGTAGCSSSVSAGDYKAQTTSLPVIEVRHHDGTLDVALVSEVGRPFRLHEVIAVLEQEGAEVVSASFSVVGDKIFYTLHSQAFCPRIGLDARRVDQRLRGLAAAATISSSVLLT

SEQ ID NO: 106777 - protein, 81 aa, Triticum aestivum
  Clone ID: PAT_TA_1195.pep
SPWWPPPPWSRRPPRPPRRRPSPPARPAGPPPRRPERPPRPPAAPSPARPAPPRSSSPSSPTTCTETRTLPRGATQTRRLI

SEQ ID NO: 106778 - protein, 211 aa, Triticum aestivum
  Clone ID: PAT_TA_1196.pep
IGKKTTPKLPQNGTKNGIECRTRKSISPAENEERSRNNSLIETETGRKRRDSSSEEDNLFFKKYDKAKPELKGPIKDFSQYEDYLQEYNEKYKVYSYLNSQIEKTQSEFLKVQEDFNVAKERDKDKYYYIVDRLRDMYHESGTRHKLMKKVFVLLHEELQSIKQRMKDFAGLFKGIMGSPSYQGIKLFFWLLPSILLLEKMSGTLASCGLS

SEQ ID NO: 106779 - protein, 164 aa, Triticum aestivum
  unsure (1)..(164): unsure at all Xaa locations
  Clone ID: PAT_TA_1197.pep
MQPDASGNAGGGGANSRPKLPPVAAAPAPSGRPASVLPHKTANVRDHYRIGKKLGQGQFGTTYLCVAKEDGGEFACKSIPKRKLLCREDYEDVWREIHIMHHLSEHPNVVRGAYEDALFVHIXMELCAGXLFDRIVSTTPSVPQRISSGHRSPLARRLDNSYFK

SEQ ID NO: 106780 - protein, 316 aa, Triticum aestivum
  Clone ID: PAT_TA_1198.pep
MMPAGHKFSDVVGSPYYVAPEVLQKCYGPEADVWSAGVILYILLCGVPPFWAETEAGIFRQILRGKLDFESEPWPSISDSAKDLVRTMLCRDPTKRLSAHEVLCHPWIVDDSVAPDKPIDSAVLSRLKHFSAMNKLKKMALRVIAESLSEEEIGGLRELFKMIDADNSGTITFDELKDGLKRVGSELTEHEIQALMDAADIDNSGTIDYGEFIAATLHMNKLEREENLVSAFSFFDKDGSGFITIDELSQACRQFGLDDVHLEDMIKDVDQNNDGQIDYSEFTAMMRKGNAGATGRRTMRNSLNLNLGDILNPSNS

SEQ ID NO: 106781 - protein, 51 aa, Triticum aestivum
  Clone ID: PAT_TA_1199.pep
YSTPRHLYSKIRLSNTMINDHYMPMYKKMMEILIEKFANNDDNSGADSTVE

SEQ ID NO: 106782 - protein, 137 aa, Triticum aestivum
  Clone ID: PAT_TA_1200.pep
EAPIQFITTPAVFFFFWRTAQEYLHPANKNENYLRHPHDTYMYIYPKIRGLNKAFLPLKGAHGSGKRDPPYATGAPRSGASSCSCPPGRAGVAGGREPGREVRLVELEAAVVEVLRVAHRFVVYPAGAGDGAVVPCP

SEQ ID NO: 106783 - protein, 186 aa, Triticum aestivum
  unsure (1)..(186): unsure at all Xaa locations
  Clone ID: PAT_TA_1201.pep
MGEFSKESCPSVKNILLLDSEGKRVAVKYFSDDWPNNASRLTFEKSIFTKTLKTNARSEAEITLLDGYIVVYKXFVQDLHFFVTAGDDENELIIANVXQGFADSVGSSTNVVMVYKKYLHFRTWDLVLLCIAEINDGGIILVSDANTXQGKVATNAADGYVPLSDRTISQALATAREHXLARSLLK

SEQ ID NO: 106784 - protein, 119 aa, Triticum aestivum
  Clone ID: PAT_TA_1202.pep
TKLLPQINPWARRKDYSRRSIPGRSATKKGRAAWWLRPEVYPILAATGVAVSICAMQLIRNITTNPEVRGTKDDRAAGIQENFDEGEALLAARLQEFIDRQRPEIMPAINNFFSDPPKY

SEQ ID NO: 106785 - protein, 171 aa, Triticum aestivum
  unsure (1)..(171): unsure at all Xaa locations
  Clone ID: PAT_TA_1203.pep
TRRHQRLTAVNQQQVGGQGPNTWVGNDANTLLVVATLITTLTYQLGTNIPGGYWQETKSLDGRELYRAGDPIMRDLHRPRYWLFMAASWVGFASSMVMTLSLLVRMSADSRHVRWSFVVAYSSLVLXLRLGGRPRLPLARHQRPPGAPHAHRPGTLLQHRQLRVGLAGDSI

SEQ ID NO: 106786 - protein, 132 aa, Triticum aestivum
  Clone ID: PAT_TA_1204.pep
HIWYAIDIEEGLLPPPRCHLSPPSSEPWSAAAPRSEPCGSRLISLRTWKYSLATASVSNGCWRLALVKRSLVVLGFLVFPVVCFSLSFRWTQFPLVVCSYSGCILWYLFSSRICTYHILEPQLKAVRPKWSP

SEQ ID NO: 106787 - protein, 161 aa, Triticum aestivum
  Clone ID: PAT_TA_1205.pep
YQQLLLKQPLRDGCIIPRVEMQSLCIYRRTYICLYISPVFLYLYCNNTIRYQLACLQINNWSPLALLTKSLFLGAPACACDLGRTGWVHRRTEYRFTDGDPLRFREAAVLLERGAQMVLLGDGCWSISASSSRRDHQQQHGREESSFAVLHRRDYVLPLRR

SEQ ID NO: 106788 - protein, 114 aa, Triticum aestivum
  Clone ID: PAT_TA_1206.pep
MAGLQRSSGTFRRSGSSGMVWDGDSHLSGEIKPVRVERSRSTGHAGYRASAGRVSPALDPPSPRVAVCGFCACFRGGKSKAAKKSNGGKAKAAKPKARTAAGSPPRPKARRASG

SEQ ID NO: 106789 - protein, 136 aa, Triticum aestivum
  Clone ID: PAT_TA_1207.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 106790 - protein, 102 aa, Triticum aestivum
  Clone ID: PAT_TA_1208.pep
HASALVILRREPARGQQEGHEHPGAPINPACPIDRIDLTLSSDWGFFFPQTKLLSVEFVEITPLTGTGCVPLQLQRRLVAYFSIGLWVDGFFFFVRRLSVGF

SEQ ID NO: 106791 - protein, 424 aa, Triticum aestivum
  Clone ID: PAT_TA_1209.pep
GPLEVEEGAGGKEEKAAVSCSICLDAVVAASAERSTARLQCGHEFHLDCIGSAFNAKGVMQCPNCRKIEKGNWLYANGSRPSHDINMDEWAHEEDLYDVSYSEMPFRFHWCPFGRLAQLPSFFEEGESPPPVTFHDFMGQHVFPENLSVSAAPGTHPCPYVAYLHPLPSLASSSSSHVPERTMDGSAYHDHWNHLAGPSDGRPLQTVQPTDFHHNHWAHLPHSYVQSNSNNGVTEQPGVPFGSMRAARVDGDSQRRGSVVSPSYFSNGSGSRSRAPNVPPLVPQFMRAHGNINEQYTQSSSSSLFAGAHRSGGMRPAPPPPQPENPTFCLFPPGSSGHSSMDTDEAGGSRFYAWERDRFAPYPLMPVDCETSWWSSQQSHGASESTPAPAPRRLFGQWIGLGRSSPENRSPEGSSYRQMHSPRM

SEQ ID NO: 106792 - protein, 472 aa, Triticum aestivum
  unsure (1)..(472): unsure at all Xaa locations
  Clone ID: PAT_TA_1210.pep
MQYERSDTAVRDVEAVSQASSGSGATLGESLRSLDVEIGSVEGHDDGDRHGASDRTPLGDVQAATRSRRPSGNAVPVSSRDISLESVREIPPNTVQESDQNASEGDQEPNRATGTDSIDPTFLEALPEDSPPPVLSSRQNASDSXTSSEQPQHDADIDPEFLAALPPDIREEVLAQQRAQRLQQQSQELEGQPVEMDAVSIIATFPSEIREEVLLTSPDTLLATLTPALVAEANMLRERFAHRYHSGSLFGMNSRNRRGESSRRGDIIGSGLDRNTGDSSRQTASKLIETVGTPLVDKDALNALIRLLRVVQPIYKGQLQRLLLNLCAHRESRKSLVQILLDMLMLDLQGSSKKSIDATEPSFRLYGCHANITYSRPQSSDGVPPLVSRRVLETLTYLARNHPNVAKLLLFLRFPCPPTCHTETLDQRRGKAVLVEDGEQQSAFALVLLLTLLNQPLYMRSVAHLEQLLNLL

SEQ ID NO: 106793 - protein, 363 aa, Triticum aestivum
  Clone ID: PAT_TA_1211.pep
KAGIKDCLGGNACAEKLDGLMVVVCEHLKSLDRQCLYKEFVILKTIFRASLLRVHRSKFAQFIIFYTCSLDPKTLGEDFAVFLTDIVTEKKEDPISRMSAVSYVGSYLSRARFISADTVVTILKKLVDWCVDYCDHQSKREATPIPNHQLFYATCQAVMYVLCFRLRSIMDYPNLKSDLFHMPFGFLFRHRLEPLKVCLPSIVNEFLRQAKDAGLVAAFVDPAAEDAIESDLSRTFGGINRLDMFFPFDPYLLKESDRYIRPNFEFWSMVKTTYSDDTDDDDDELEDLDAPEMNVGSLDDHVEIDINSDDDDLEYTMNKMSITPHHSFLHQMAMDSDGGLSMPARIRPSTSPPSRWAMSGESP

SEQ ID NO: 106794 - protein, 110 aa, Triticum aestivum
  Clone ID: PAT_TA_1212.pep
KAVLISFCDSPFHQVHKVKGFSPLDSIAHQISSRKNLGGARRICCSSSSQTSNREQATDLSLPPPHRSRRNESERTNTISLRISRFSTRWWWGTNGVCVCAKTDKQTHAS

SEQ ID NO: 106795 - protein, 383 aa, Triticum aestivum
  unsure (1)..(383): unsure at all Xaa locations
  Clone ID: PAT_TA_1213.pep
MAGSAIGFEGYEKRLEITFSEAPVFTDPNGRGLRALSRAQIDSVLDLAKCTIVSELSNEKFDSYVLSESSLFVYPYKVVIKTCGTTKLLLAIPRVLELAEELSLPLAAVKYSRGTFIFPDAQPSPHKNFSDEVAFLNGYFGGLKSGGNAYVIGDPAKPGQKWHVYYATHLAEQHLVVWDKKKTFLLQKKASFFLQTSGDGDTSXLPGISEIIPEMEICDFDFEPCGYSMNAIHGSAFSTIHVTPEDGFSYASYEVMGLDPASMAYGDLVKRVLRSFGPSEFSVAVTIFGXGRNLAGTWGEXLNVGVYDSTNMLPQELPDGGALIYQSFTAVGEDFTGSPRSVLNCNVDGNLVTGCKMDAFLCWEDDAAQEKDERGAGKKMKSS

SEQ ID NO: 106796 - protein, 201 aa, Triticum aestivum
  unsure (1)..(201): unsure at all Xaa locations
  Clone ID: PAT_TA_1214.pep
PRLPPSPPKNRIKPPPPPPPRTLARTLAATASLQPPPSLSTSRACPNQWRPPTATATSPAAASPPTPPPPSRPSTTRATRSSACAAAAAASAARASPSPSSSSPSSSXSSSSPCSASGTRPRGSSPRASSASPRASPSRRSTSSSTSPSSSRCPCTTPTRPPSPSPRAATPTSPTAAPTSATPRSTPAASPARGTGTCSWR

SEQ ID NO: 106797 - protein, 43 aa, Triticum aestivum
  Clone ID: PAT_TA_1215.pep
MLAAAKLIDSYEMDPDVSWLEVFAYSGVSAALCATIWVAAKAC

SEQ ID NO: 106798 - protein, 165 aa, Triticum aestivum
  Clone ID: PAT_TA_1216.pep
IYRSVVAAYNRGKHKQAERQHHEDTSCRARLLAVGIRAAVQVRRGLAGVHRREARHGRGGVTPSHDRHHDGESVCTTATFDGGERWACEWTPAELVLLAPGNNLTAGPEPSSCGTRDSARSPARVFGALRCVHFPLISRQFQIFSGLYSDVLYVLCTIFNVLRKQ

SEQ ID NO: 106799 - protein, 87 aa, Triticum aestivum
  Clone ID: PAT_TA_1217.pep
RVGHDITTVHLDDQPPSPSQSSMITQSSAPAPSATTGQFSLPADTKQHGGANAPYNSPPSYGMGLQDQGLQCGPLHDQLAANRSMLY

SEQ ID NO: 106800 - protein, 163 aa, Triticum aestivum
  unsure (1)..(163): unsure at all Xaa locations
  Clone ID: PAT_TA_1218.pep
RGVPWPADEHRXFLLALKTYGKGDWRKISRNFVRTRTQTQVASHAQKYFIRLSSGAARRSSIHDITTVHLTDDQPPSPSQXLMINQSSAXLSAATGQFSLPADPKQHGAASAPFSSPNRALGMPNYGXGLQDQGLQCGPLHDQLAANRSTEYAVLEDASASDV

SEQ ID NO: 106801 - protein, 176 aa, Triticum aestivum
  Clone ID: PAT_TA_1219.pep
GARHGAPAGGPAAVRRHGGRPPAEEPKEVVPSHDITHSSLVPRPSKYGNGDWRNISRNFVQTRTPTQVASHAQKYFIRLSSGGGKDKRRSSIHDITTVHLDDQPPSPSLSSMITQSSAPAPSSATGQFSLPADTKQHGGANAPYNSPPSYGMGLQDEGLQCGPLHDQLAANRSMLY

SEQ ID NO: 106802 - protein, 184 aa, Triticum aestivum
  Clone ID: PAT_TA_1220.pep
GWFCFCVSGIEVAYQEAVSLKRQEELIREEEEAGLLESEMKGKRNNTTEKEKRAKKKQAKQKKNNRKVKDKDREEKSDSNFAEKDQDESTIHDSEDSKQAGQVAMKVDTSEEGASDISDNLDGSAEVCQTDAGDKISQPVNGVNDVGVEMKNVHTGKNSTVEHKPLPCLSESATMNIMQGKKNN

SEQ ID NO: 106803 - protein, 149 aa, Triticum aestivum
  Clone ID: PAT_TA_1221.pep
RPGRPGFTSNSLFFRDINSLNHQQSQTSTFTTLSSVKMAVNTPSTCCRSSDGASECACAQKATCSCGQKSALQCTCAKAPVENTVNGPRCSCRARPAGECTCDRAASENVTPSGATCACGSRPAGGCTCEKAADGGFNPANEIDFTTKK

SEQ ID NO: 106804 - protein, 309 aa, Triticum aestivum
  unsure (1)..(309): unsure at all Xaa locations
  Clone ID: PAT_TA_1222.pep
MGNPRGGLDEQIEQLLQCKPLVEPELKALCEKAKEILMEESNVQPVRSPVTICGDIHGQFHDLAELFRIGGKCPDTNYLFMGDYVDRGYYSVETVSLLVALKVRYPHRLTILRGNHESRQITQVYGFYDECLRKYGSANVWKTFTDLFDYLPLTALVEXKLFCLHGGTYHHPIRAHLIMCRGFHRTGEGTCMDPACDLLGSDPDDRCGWGISPRGAGYTFGQDISEQFNHTNSLKLIARAHQLVMEGFNWAHEQKVVTIFSAPNYCYRCGNMASILEVDDCKEHTFIQFEPAPRRGEPDVTRRTPDYFL

SEQ ID NO: 106805 - protein, 289 aa, Triticum aestivum
  Clone ID: PAT_TA_1223.pep
SIVAALANDELLAVIIVAIIVGYLIESPHSPIIRVAEEIERMILKVINFLIAAAPIGVFFLILPNLMRLDIGEIGSNLGILIGATLSTMVLHILVVVPIIFFIFTRMNAYSYWIKISPAWITAWGSASSAATLSVTLRCAKERGVPAIISKFACPLGCLINMDGTAIYLPAAVVFLASTQGITLDPTSYVIVALLSTLASIGVSPIPSASLVLLLMIARSVNVEITGMYAVIVAIDWLLDRFRTAINVSGDLFAVMIIYKQTGMEDPEEVIEETARETDAHEKDATNRV

SEQ ID NO: 106806 - protein, 182 aa, Triticum aestivum
  Clone ID: PAT_TA_1224.pep
RKSPAMSGRRGRGRGPPTQADRLMRGAIDHFGRMGYAEADIRSTVGQLIEVYGEDASSFLKEDDYRVVQDALFEKQEQEEQQQEPKQKEAAISEAPTASDMPIVDMHNEMPPGAELSVEGADPMPIDPPAPEATMAHPAATGTSRAGRPCYGWISESESDSDYEEYLASRRQATHAPIPGSG

SEQ ID NO: 106807 - protein, 206 aa, Triticum aestivum
  Clone ID: PAT_TA_1225.pep
LISSVAPEALGLYTPGISRHRRSTVSFASSHRPRILAMNFWGANHNLPIRRATQIPAAVPGPESLPRVNLPMSNMPSWMTLVVGAVLVAIPIYRKIRALEDKVEKTAEVAVEVMDTVAEAAEKVAGEVAEAFPENEGLKEAASRIKTVADAIEEDAELAEALIHKVDELTKEMDSVVGPIIDVVIKESGERGVVDEEPKSKESDNI

SEQ ID NO: 106808 - protein, 159 aa, Triticum aestivum
  Clone ID: PAT_TA_1226.pep
VRSPCNPAVATFAIGGCASCGEAPEGVMTAQTRYSSLPLLAPPPILASSVQAATTPRPGHKEGFVPRCAGCLSDRFCVTCNKWWCEACYQPFGGNCAPVAKRHVSRSCWECGMNCDECIEKTQKVCKKCCGGYCLVHNEGSSTSFCDWCFSSGRGLRRV

SEQ ID NO: 106809 - protein, 113 aa, Triticum aestivum
  Clone ID: PAT_TA_1227.pep
PAGFEDIELEQQSRGNNHRRICCPYVLVWSLVLGGEARKKMTRRFLPLCALLLVLLCMAASLAEGRRGGGRPIIGGGSGGARGRGSGSPRGLSGGTWAACVGSSLLVAAAMLF

SEQ ID NO: 106810 - protein, 189 aa, Triticum aestivum
  unsure (1)..(189): unsure at all Xaa locations
  Clone ID: PAT_TA_1228.pep
MKTILASETMEIPEEVTVKVSAKMISVTGPRGTLTRNFKHLNLDFQLQEGGRKLKVDAWFGTRKTMAAIRTAISHVQNLITGVTXGFRYKMRFVYAHFPINASITAANRGREIRNFLGEKKVRKVDMLDGVTILRSEKVKDEIVLDGNDIELVSRSAALINQKCHVKNKDIRKFLDGIYVSDKGAIKEE

SEQ ID NO: 106811 - protein, 189 aa, Triticum aestivum
  Clone ID: PAT_TA_1229.pep
MKTILASETMEIPEEVTVKVSAKMISVTGPRGTLTRNFKHLNLDFQLQEGGRKLKVDAWFGTRKTMAAIRTAISHVQNLITGVTKGFRYKMRFVYAHFPINASITAANKGIEIRNFLGEKKVRKVDMLDGVTILRSEKVKDEIVLDGNDIELVSRSAALINQKCHVKNKDIRKFLDGIYVSDKGAIKEE

SEQ ID NO: 106812 - protein, 189 aa, Triticum aestivum
  Clone ID: PAT_TA_1230.pep
MKTILASETMEIPEEVTVKVSAKMISVTGPRGTLTRNFKHLNLDFQLQEGGRKLKVDAWFGTRKTMAAIRTAISHVQNLITGVTKGFRYKMRFVYAHFPINASITAANRGIEIRNFLGEKKVRKVDMLDGVTILRSEKVKDEIVLDGNDIELVSRSAALINQKCHVKNKDIRKFLDGIYVSDKGAIKEE

SEQ ID NO: 106813 - protein, 189 aa, Triticum aestivum; identical to SEQ ID NO: 106812
  Clone ID: PAT_TA_1231.pep

SEQ ID NO: 106814 - protein, 189 aa, Triticum aestivum; identical to SEQ ID NO: 106812
  Clone ID: PAT_TA_1232.pep

SEQ ID NO: 106815 - protein, 186 aa, Triticum aestivum
  Clone ID: PAT_TA_1233.pep
MKTILASETMEIPEEVTVKVSAKLISLTGPRGTLTRNFKHLTPRLSSWREGGRKLKVDAWFGTRTTIAAIRTAISHVPRTFKHRGRQRLALRRYPRFVYTLPPNDPVTAHQPAPPRSRDCHRGQEGKARWPCSVVVTIFPDQETVKEEPSLRGHRLTWNSSPRYTNLSKQKCHVNQQGDQRTFWAV

SEQ ID NO: 106816 - protein, 590 aa, Triticum aestivum
  unsure (1)..(590): unsure at all Xaa locations
  Clone ID: PAT_TA_1234.pep
LPAPAPPPPAGHRARRRLGRCRTRHLTTLARGRGGGRPLRELANLVLIMGNHTXIEEMPPGNANVLTTVLKLVDKYDLYGSVAFPKHHYQAXVQCFYALTAITKGVYNNPALVEPFGLTLIEAAAHGLPIVATKNGGPVDITNTLNSGLLVDPHDQNAIADALLKLVADKNLWHECRKNGLRNIHLYSWPEHCRTYLARVAGCRIRNPRWLKDTPADAGADDEAEDSLMEFQDLSLRLSIDGERGSTNEPASSDPQDQVQKIMNKLHQSSSAAPDAATDKNPANVQAAGTVNKYPLLRRRRRLFIVAVDCYGDDGRASKKMLQVIQEVFRAVRSDTQLSKISGFALSTAMPLSETLQLLQMGKVPPTDFDALICGSGSEVYYPGSAQCLDAQGKLRPDQDYLQHINHRWSHDGARQTIGKLMASQDGSGSVVEPDVESCNAHCVSFFVRDPKKVRTIDEMRERLRMRGLRCHLMYCRKSTRMQVVPLMASRSQALRYLFVRWGLPVGNMYIVLGEHGDTDREEMLSGLHKTVIVKGVTEKGSEDLLRSSGSYHKEDVVPSDSPLATTTRGDLKSDEILRALKEVSKASSG

SEQ ID NO: 106817 - protein, 172 aa, Triticum aestivum
  unsure (1)..(172): unsure at all Xaa locations
  Clone ID: PAT_TA_1235.pep
HSKMAVHKHTSILQPIYITEAQIHSTRRRNSKEKLKQSKPSRPSGSGKQDAATASLDALRSSTAAPTAPVAASTTAAAAAGAITSVAGAAAAAPALAAASLGPPVVGAAERRDGHDGDRAHEDEEQTHYGAGRALHGAXXXXXXXXXAAAAAKPLAAARSNAVTISAAGAYS

SEQ ID NO: 106818 - protein, 218 aa, Triticum aestivum
  Clone ID: PAT_TA_1236.pep
CAEDAALDNPAIVEDLTMFFARSVVDEVIAPSDLEAMEEEAGRRKAAGSPGMLALRNAHAMLGAKLSAERILRCWGGGGTGKAGWELSEVKDKIGKLLQEYDSGGGVREACRCIKELGMPFFHHEVVKKALVAIIEKRGKDERLWGLLSECYGRGLITPNQMTKGFQRVADCVDDLALDVPDAGKQLGCYVERAKKGGWLDASFSVAKPGPDVIAVCS

SEQ ID NO: 106819 - protein, 102 aa, Triticum aestivum
  Clone ID: PAT_TA_1237.pep
VEWFRGMVGSRRVEDLADPRIVPVPAPRVLNRVLLVCLRCIDSDAHKRPKMGQIVHMLEGDEFPFRTEHRSPRAAHRPSTNARTSLLAEKAGPDDADKSTWR

SEQ ID NO: 106820 - protein, 130 aa, Triticum aestivum
  Clone ID: PAT_TA_1238.pep
EGGGSGGCAQAPMQAIPLPPALDLDLFHRAAVVTAVAGGGMRFPFNGYPVAPRQPLHPYFFYEQAAAAAAASASGYRALKVAQPVTVAAVAQSDSDSSSVVDLSPSPPAVTAHKAVAFDLDLNRPPPSED

SEQ ID NO: 106821 - protein, 384 aa, Triticum aestivum
  Clone ID: PAT_TA_1239.pep
PTRPPTRATVCKLDKKYPPYELIWEDSNQLAGKSFYLPASFDADHNQMDQWNLSPPPVSLGSRSDFAQKHNEIAKSKGHLCSRRPCYNDSQRDNAGNAYMSTSGDLEMGSEGEACIPDEEMQGERQAEASVIDQLLADTYHDTTSSPGDYWTDTNGRSGQPRNYDTPGGNDPPTHEYFAVRAAESDMSISLSGRSASRNQNQTVSTSDHEPTNDHIASVSAKQPTDPADCDDVTSADAQHGLGDPPSAPENAAGVQYRILEDSPPEEGQLGDPPSAPENAAGVQYRILEDSPPEEGQLTPEEAQPNDLSSTDGNAAGVPMLEESPLETDAPVGAANLPLAHTFPGLQFASAPTWPGCYAAREVLSRGMGYPTFHQEASYNLLGK

SEQ ID NO: 106822 - protein, 400 aa, Triticum aestivum
  unsure (1)..(400): unsure at all Xaa locations
  Clone ID: PAT_TA_1240.pep
MDSLRLRPSSLRSAPGAAAARRRDHILPSFCSIQRNGKGRVTLSIQASKGPTINHCKKFLDWKYSNHRISHQSINTSAKAGQSLQPETEAHDPASFWKPISSSLDAFYRFSRPYTIIGTALSIVSVSLLAVESXSDISPLFLTGLLEAVVAALFMNIYIVGLNQLFDIEIDKVNKPTLPLASGEYSPATGVAIVSVFAAMSFGLGWVVGSPPLFWALFISFVLGTAYSVNLPYFRWKRSAVVAALCILAVRAVIVQLAFFLHIQTFVFRRPAVFSKPLIFATAFMTFFSVVIALFKDIPDIEGDRIFGIQSFSVRLGQSKVFWTCVGLLEVAYGVAILMGVTSSSLWSKSLTVVGHAILASILWSSARSIDLTSKAAITSFYMLIWRLFYAEYLLIPLVR

SEQ ID NO: 106823 - protein, 143 aa, Triticum aestivum
  unsure (1)..(143): unsure at all Xaa locations
  Clone ID: PAT_TA_1241.pep
SQAQNSXQDYLSPHNAARXXVGVGAVSWSTKLQGFAQSYANQRINDCKLQHSGGPYGENIFWGSAGADWKAADAVKLWVDEKKDYDYGSNTCAGGKVCGHYTQVVWRASTSIGCARVVCNNNRGVFITCNYEPAGNVVGQKPY

SEQ ID NO: 106824 - protein, 111 aa, Triticum aestivum
  unsure (1)..(111): unsure at all Xaa locations
  Clone ID: PAT_TA_1242.pep
AQNYAEQRRGDCQLIHTSXGRPYGENLFGGGGTQWTAADAVNSWVSEKQYYDHGSNSCSAPEGDSCGHYTQVVWRDSTAIGCARVVCDSGDGVFIICSYNPPGNYVGQSPY

SEQ ID NO: 106825 - protein, 164 aa, Triticum aestivum
  Clone ID: PAT_TA_1243.pep
MQTPKLAILLALAMAAAMVNPSEAQNTPQDYVSPHNAARATVGVGAVSWSTKLQGFAQSYANQRINDCKLQHSGGPYGENIFWGSAGADWKAADAVNAWVGEKQDYDYGSNTCAAGKVCGHYTQVVWRASTSIGCARVVCNNNLGVFITCNYEPRGNIIGQKPY

SEQ ID NO: 106826 - protein, 168 aa, Triticum aestivum
  unsure (1)..(168): unsure at all Xaa locations
  Clone ID: PAT_TA_1244.pep
MEYSPKLAVLVLLALASAMAVTAQNSEQDFVDAHNAARADVGLGEVTWDATVAAFAQDYADQRRGDCQLIHTPDGRPYGKKNXKKGGGGTEWTATDAVNSWVSEKQYYDHDSNTCSAPEGESCGHYTQVVWRDSTGIGCARVVCDSGDGVFIICSYNPPGNFPGVSPY

SEQ ID NO: 106827 - protein, 167 aa, Triticum aestivum
  Clone ID: PAT_TA_1245.pep
MEYSPKLAAVLLLALASAMVVVTAQNSPQDFVDPHNAARADMGVGPVTWDDNVAAYAQNYAEQRRGDCQLVHSGGQYGENIYGGRGGGADWTAADAVQAWVSEKQYYDHGSNSCSAPADKSCLHYTQVVWRDSTAIGCARVVCDGGDGLFIICSYNPPGNYEGVSPY

SEQ ID NO: 106828 - protein, 190 aa, Triticum aestivum
  Clone ID: PAT_TA_1246.pep
MGRIQATEAKLASAGTDKSFRHRETRMQTPKLAILLALAMSAAMANLSQAQNSPQDYLSPHNAARAAVGVGAVTWSTKLQGFAQSYANQRINDCKLQHSGGPYGENIFWGSAGADWKAADAVNAWVGEKKDYDYGSNTCAAGKVCGHYTQVVWRASTSIGCARVVCNNNLGVFITCNYEPRGNIIGQKPY

SEQ ID NO: 106829 - protein, 166 aa, Triticum aestivum
  Clone ID: PAT_TA_1247.pep
MEYSPKLAVVLLLALASAMVVTAQNSPQDFVDPHNAARADVGVGPVTWDDNVAAYAQNYAEQRRGDCQLVHSGGQYGENIYGGGGGGAEWTAADAVNSWVSEKQYYDHDSNTCSAPEGESCGHYTQVVWRDSTAIGCARVVCDSGDGVFIICSYNPPGNFPGVSPY

SEQ ID NO: 106830 - protein, 164 aa, Triticum aestivum
  Clone ID: PAT_TA_1248.pep
METPKLAVLLALAMAAAMVNLSQAQNSPQDYLSPHNAARAAVGVGAVSWSTKLQGFAQSYANQRINDCKLQHSGGPYGENIFWGSAGADWKAADAVKLWVDEKKDYDYGSNTCAGGKVCGHYTQVVWRASTSIGCARVVCNNNRGVFITCNYEPAGNVIGQKPY

SEQ ID NO: 106831 - protein, 170 aa, Triticum aestivum
  unsure (1)..(170): unsure at all Xaa locations
  Clone ID: PAT_TA_1249.pep
METPKLAXLLALAMAAAMVNLSQAQNSPQDYLSPHNAARAAVGVGAVSWQRRTLQGTKLQGFAQSYANQRINDCKLQHSGGPYGENIFWGPAGADWKAADAVKLWVDEKKDYNYGSNTCASGKVCGHYTQVVWRASTSIGCARVVCNNNRGVFITCNYEPAGNVVGQKPY

SEQ ID NO: 106832 - protein, 166 aa, Triticum aestivum
  Clone ID: PAT_TA_1250.pep
MEYSLKLAVVLLLALASAMAVTAQNSPQDFVDPHNAARADVGVGPVTWDDNVAAYAQNYAEQRRGDCQLIHTPDGRPYGENLFGGGGTQWTAADAVNSWVSEKQYYDHGSNSCSAPEGDSCGHYTQVVWRDSTAIGCARVVCDSGDGVFIICSYNPPGNYVGQSPY

SEQ ID NO: 106833 - protein, 74 aa, Triticum aestivum
  Clone ID: PAT_TA_1251.pep
MSCAAPKAPAGEEKKTSWPEVVGKSIEEAKEIILKDMPNADIDVLPAGSAMTLDFRTNRVRIIVDTVAITPSIG

SEQ ID NO: 106834 - protein, 135 aa, Triticum aestivum
  unsure (1)..(135): unsure at all Xaa locations
  Clone ID: PAT_TA_1252.pep
AMKWHPXRWASDPGATGEAKRRFQRIQEAYSVLSDKGKRAMYDAGLFDPLDDDDQDFSDFMQEMLVMMDSVKNEKPDTLEDLQKMLDDIVNGDGGSRATAGAGGSGGGGGGCGGRVPPEANRRTRVAPYPQPSRR

SEQ ID NO: 106835 - protein, 107 aa, Triticum aestivum
  Clone ID: PAT_TA_1253.pep
MNGSRQMELHYINTGYPYTITESFMDFFEGLTYAQADFALADAFQDQANPYWTMMQTNSYKYGYSGAGNYYSYGHVYDMNDYMHRADSGRRIWDNPMPVNSTDSPNI

SEQ ID NO: 106836 - protein, 112 aa, Triticum aestivum
  unsure (1)..(112): unsure at all Xaa locations
  Clone ID: PAT_TA_1254.pep
TGSGSLAKKKRIAGGAMVVRAFPGAGHPEQGGSQGGGGNGPNWPWWKKVGFWGSGSEXWGEGWQSQGKGWGTPGTGPTPTGGGGAPINPQAVFQQKVVDRKEGAGQGKGVHN

SEQ ID NO: 106837 - protein, 253 aa, Triticum aestivum
  Clone ID: PAT_TA_1255.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKQIKNGRLAMFSMFGFFVQAIVTGKGPLEDLADHLADPVNKT

SEQ ID NO: 106838 - protein, 112 aa, Triticum aestivum
  Clone ID: PAT_TA_1256.pep
PRVRPRVRIRWSSSNKDDDKTELTRAEVESLRSEIADADERVSQLKARLENIDEALRYALLSGYLHIRSRWTQLPGEPPIIDDADVDDWLPRFVVLQGQCLYYYLKCSGYCR

SEQ ID NO: 106839 - protein, 135 aa, Triticum aestivum
  Clone ID: PAT_TA_1257.pep
IELTRAEVESLRSEIADADERESQLKARLENIDEVLRYAFLSGYLHIRSRWTQLPGEPPIIDDTDVDDWLPRFVVLQAQCLYYYLKSTDLSPQESLLLRDVEPTSYPDDGGRPQPPSQGLTPLRFLRTRKEERGP

SEQ ID NO: 106840 - protein, 97 aa, Triticum aestivum
  Clone ID: PAT_TA_1258.pep
QRTALRIKRGFTMELTGCHEDDQEYIISWATKQQSKSVNRSYKPLSHLQREESWHKDFVDRLTSAGGAQVGLGIARAAMEVLCTASRVPTALSLHMV

SEQ ID NO: 106841 - protein, 400 aa, Triticum aestivum
  unsure (1)..(400): unsure at all Xaa locations
  Clone ID: PAT_TA_1259.pep
MATAMDTTVPRSGVGEGGGGGGLKKGPWTQAEDRVLLDHVRRHGEGNWNAVRRETGLQRCGKSCRLRWANHLRPNLRXGPFSPEEERLILRLHGLIGNKWARISTHLPGRTDNEVKNFWNTRLKRRQRAGQSLYPPDVEREIALMRAQNINPFADADGNTVASPFLGPFALPPRPPSSTKQASHSHSHSSPLINQHYQLLNQMQGMQMRHHAVQHHHQQPAFHYHGGIRSPGLPPLPTRPRELPSNQIEMASCSGGGDGLLEALLLGVDEHQLPRPNHAVCRAGSMPDLMYGGVASGSDSDVTSQFPPAPGGQDPHHGGKWDFLVDDMKPTMRRATSAAENETSGMFGVAHGSISGEWFGTGVGSPGPSSVVTTDDEFGLEMQQLMSSLPLSADELNWNA

SEQ ID NO: 106842 - protein, 92 aa, Triticum aestivum
  Clone ID: PAT_TA_1260.pep
GCGNWRQGQPPKLREWSVREESVEYEDGVVLQEFRKGFKLGERLLRPAMVKVSAGPGPEKSGDDDTTIGEDSVGPQAFDDGEDDGFDDADAE

SEQ ID NO: 106843 - protein, 259 aa, Triticum aestivum
  unsure (1)..(259): unsure at all Xaa locations
  Clone ID: PAT_TA_1261.pep
TTARYWLKASRRAGRSPSLNCAGLSTRLGRITPCRAQIEWYKASFDADIGYYDAFKQQRSPKKFGKANIYRLKLGQFWDGVLTMLDNSQLPHDFHRRAKWVNAARFYQLLVEPLDIADYHRNNLHRLTHGYITHGRDRKYEXLDKWWKEKGAFSGTSTGDTSVTATARSKYAGLTQDPCFWARVEEAWDXTESAQAEYDVAMLAMKLGRLREFERYARELVESKEVSIDVLAPQSSYTRWVEEWKKLLLRDEARTASLF

SEQ ID NO: 106844 - protein, 130 aa, Triticum aestivum
  Clone ID: PAT_TA_1262.pep
PRVRPSPGATSSDTTSNGETSPGNADEPALSSLLTVGMQALASAVPSVKLNLSSVTAINSHICTTIHQITTALKCAGNGNTVRPPPGSHAVQEAPGGSGGKHTVKDCVQLFCHLLTPESTLLASQLQARI

SEQ ID NO: 106845 - protein, 70 aa, Triticum aestivum
  Clone ID: PAT_TA_1263.pep
GSRSQSRRSAAIGIRSQSPQLTYCNWHVAIAAPPPLHVALRNFMPSSTLKIRMVLQFVQGVGKLGSSKKT

SEQ ID NO: 106846 - protein, 341 aa, Triticum aestivum
  Clone ID: PAT_TA_1264.pep
MADLKAPAKARRLAPPMSWRTRLSIFAAGYLTDATCRADGTINRRLLTYLDPGVPPSAAPRNGVSSRDIDVDAAIPLRARLFHPVGLPGPLPVVLFFHGGGFAYLSAASLAYDAACRRIARYCGAAVLSVDYRRSPEHRFPAAYDDGFSALRFLDDPNKHPADVAPLDVSRCFVAGDSAGANIAHHVARRYAMSSPSFANVRISGLIAIQPFFGGEERTPSELQLEGAPIVSISRCDWMWRAFLPPGADRTHEAAHAASPAAAAGIDSPAFPPAVVVVGGYDPLQDWQRRYCEMLTSKGKEVRVLEYPEAIHAFYVFPEFAESKDLMLRIKEFVAGSDGSK

SEQ ID NO: 106847 - protein, 102 aa, Triticum aestivum
  Clone ID: PAT_TA_1265.pep
MGSPLGGWPSHNPQNFSQLVPADPSAQPTNVTPTTYIAAHRTDPPPYQVITTEPRNILLRHFYQNSENKPRPKRAAPESAALRNGKQARSPADGGSQSSTRS

SEQ ID NO: 106848 - protein, 139 aa, Triticum aestivum
  Clone ID: PAT_TA_1266.pep
LTSHGVFVVEGDINDGRLLAKLFDVVPFTHVLHLAAQAGVRYAMENPASYVHSNVAGLVTLLEACKNADPQPAIVWASSSSVYGLNDKVPFSESHRTDQPASLYAATKKAGEEITHSYNHIYGLSITGLRFFTVYGPWG

SEQ ID NO: 106849 - protein, 270 aa, Triticum aestivum
  Clone ID: PAT_TA_1267.pep
MCVPVPLGPLLPPLARVRCARVFPASCVPANRAGPGALPGACPRPLPRPPFVGASPSPALRPDPMVPVSASHRTDQPASLYAATKKAGEEITHSYNHIYGLSITGLRFFTVYGPWGRPDMAYFSFTRNILQGKPITVYRGKNHVDLARDFTYIDDIVKGCLGSLDTAGRSTGTGGKKRGPAPYRIFNLGNTSPVTVPTLVAILEKHLRVKARKHVVEMPGNGDVPFTHANISLARQQLGYKPATNLDAGLKKFVKWYLSYYGYTRGSKNL

SEQ ID NO: 106850 - protein, 215 aa, Triticum aestivum
  Clone ID: PAT_TA_1268.pep
MAFAASRRLSAAAAAAAAPKLSSLFTPRPIPNPKPRPLSPESGDDPRRRKARPRSRHPWGEDAAALLRRLHEGRYLPGPYIPDAPHVVSPDAVKAAAERFGNDHQVVAKWLSGSDLKKVALFGCPSVERRTVFASKRLRAFFNLPEEKVCSSCKIRSSCQFINQEVPRYDKVILSDTMRILALFVLDAYPEPLQVTAEVKASVRKLLKDTINLSI

SEQ ID NO: 106851 - protein, 178 aa, Triticum aestivum
  Clone ID: PAT_TA_1269.pep
AIRTRVATRFPHLQLLNLGTIRFPERRHTIHPLPLMSPPKVVAGPACVVGDEGRGEIFADSFAGGGPWTPRRRPRTARKRSSDVLAGFLGYTGGEDSADCGRNPDSPPSAPDLKTKKGLEDSIGMHTVQCYKWEKWRQVPTEYGADLTASRFAFATPMFVPAPIGGRSLWRVAQAEGG

SEQ ID NO: 106852 - protein, 217 aa, Triticum aestivum
  Clone ID: PAT_TA_1270.pep
MAMVKNIACTLFLAAIVVAATLVPAASGAGDKSIEEMDSSIKKAFDAVIAAAPASKRSAVESFVLKQKVAATASLNEAAGDKKKLDEIVTAYKMASDAVLAAKPADKYAVFDKTFSEAGHPPTVKAVDALENSFKEAIGDVVAAAPAPQQDEMKALVFQQTVVAANMLAQSAKDKKLFAAVTTAYKVASDAVLAAAPADKYSVMGKTFAEAADVKAA

SEQ ID NO: 106853 - protein, 139 aa, Triticum aestivum
  Clone ID: PAT_TA_1271.pep
MSGMEEEENAAELKIGEEFLKAKCLMNCEVAIILEHKWEQLQHMSDGGADQVSQVFEKSQAYVKRFSRYKNPDAVRQVRETLSRYSLVEFELCTLGNLCPDTADEAKALVPSLVPGGRFDSDDRVDKMLNDLSLIKKFE

SEQ ID NO: 106854 - protein, 263 aa, Triticum aestivum
  unsure (1)..(263): unsure at all Xaa locations
  Clone ID: PAT_TA_1272.pep
PEITKYKAVVSAQPPRQEIIQDLYCTGIDPEKGTPVHSGMMRELLVSFFQKTKHKPSRIIFYRDGVPTRPRXAWVLMYEMDAIRKACASLQEDYQPPVTFVVVQKRHHTRLFPEVHGKETDKSGNILPGTVVDTNICHPTEFDFYLCSHAGIQGTSRPTHYHVLFDENRFTADGLQLLTNNLCYTYARCTRSVSVVPPAYYAHLAAFRARYYDEPSEGSDSASIVSGGTRESAATGAGAAGPPGTYRRLPRIRDNVKDVMFYC

SEQ ID NO: 106855 - protein, 206 aa, Triticum aestivum
  unsure (1)..(206): unsure at all Xaa locations
  Clone ID: PAT_TA_1273.pep
MCRGTVDDLRPLGPRRLDVRAFYLRLSSSSHSSASPPPAELTLVYRPAIGGAALELAGRALPPPCPAEATLLRVRGAADGADDAPAYASADRVSAAEGARFEVYAGQELAAEGAFFPRRRLDGGGWHVECRRPVGSRSHSRVAEVLVLAEGGVLIRARARAARRAGCATPLEGIPEEEDASSWGSCKCGXLGDGWQMVGDKRRDDD

SEQ ID NO: 106856 - protein, 38 aa, Triticum aestivum
  Clone ID: PAT_TA_1274.pep
KRAEIARLRELHTLKGHVESVVKQKGIDIDAIPQNYTV

SEQ ID NO: 106857 - protein, 88 aa, Triticum aestivum
  Clone ID: PAT_TA_1275.pep
PRVRLVLRGFEREEQCLYNYAGIPLCVYTSLLLLLHSFSCALHLTLSVIQVCGNGASASTFCLSCHKPLASLPATPSLNKYKSVSITT

SEQ ID NO: 106858 - protein, 444 aa, Triticum aestivum
  Clone ID: PAT_TA_1276.pep
LHLGVNVKMITGDQLAIGKETGRRLGMGTNMYPSTALLGDKNTAVDGLPIDELIEKADGFAGVFPEHKYEIVKRLQDKKHIVGMTGDGVNDAPALKKADIGIAVDDATDAARSASDIVLTEPGLSVIVSAVLTSRAIFQRMKNYTIYAVSITIRIVLGFMLVALIWKFDFAPFMVLIIAILNDGTIMTISKDRVKPSPKPDSWKLDEIFATGVVLGTYMALVTVVFFYLAHDTDFFTETFGVHPIRDNDRQLMAALYLQVSIISQALIFVTRSRSWSFVERPGFLLLFAFFAAQLVATAIAVYADWDFCDMEGIGWAWGGAIWVFTLVTYIPLDVLKFIIRYSISGKGWNNVQNKTAFTNKKDYGRGEREALWAREQRTLNGLSQPAGSDLLSNKEELSDIAAEAAKRAEIARLRELHTLKGHVESVVKQKGIDIDAIPQNYTV

SEQ ID NO: 106859 - protein, 199 aa, Triticum aestivum
  unsure (1)..(199): unsure at all Xaa locations
  Clone ID: PAT_TA_1277.pep
TRQILAPXFYGEPAEMLVSTTFKNSKQEKGENSGGYIIRIPFGPRDMYLTKERLWPFIQEFVDAALSHIVRMSKTIGEEIGCGHPVWPAVIHGHYASAGIAATLLSGALNLPMAFTGHFLGKDKLEGLLKQGRQSREEINMTYKIMRRIEAEELSLDASEIVIASTRQEIEEQWNLYDGFEVILARKLRARVKRGANCY

SEQ ID NO: 106860 - protein, 275 aa, Triticum aestivum
  Clone ID: PAT_TA_1278.pep
MVSKLALALFFGNALAGLAGRALPPRCAVADPTAEQVQHAQNLKKIESVSKVAAASITVDTYFHVVSSSSSKYISKAKLTAQLKALNDAYGPNDITFKLIDTTFTTNTNWAAGNGELAMKRQLRQGDYKTLNLYFTDVAKLGGTEALGYCYFPEPNVSTGSQKFILDGCVIVAETVPGGTAAPYNLGGTAVHEVGHWFNLFHTFQDGCNGGDLVADTPAQARQTSGCPARMDTCPNQAGDDPIHNYMDYSDDVCYEEFTPGQQTRMHSAWTAYRK

SEQ ID NO: 106861 - protein, 216 aa, Triticum aestivum
  unsure (1)..(216): unsure at all Xaa locations
  Clone ID: PAT_TA_1279.pep
PRPRRPPRGPGRGGRPPSLQHALPQPLPRAAPPAASAAPARPGXRRRREPTTWTRTTRTRTTTRTRTRRPPPPXLVPGHGPVPPPATPAASAPSPPPQXLSGRTPPRPAAATRRALSLSLPLAPQRPLPVPPAPPSRRPIQPPPPPPSLPPPPYPLPRWLSTYALARPRTICIYLPRPSSFPVLLPPSPCPVQSIQATGRLHPFLDSLLCLITVLQ

SEQ ID NO: 106862 - protein, 135 aa, Triticum aestivum
  Clone ID: PAT_TA_1280.pep
VTVLKDGLPYPNGIAVSHDRTYVVVAHTVPCQAHRYYLQGPKAGHYELLADLPGYPDNVRRDGKGGYWVALNQEKGRPGATTAPVKHLVGVRLDGGGVEVEELTAAKGVTLSEVTERKGQLWLGSVELDYIGLVA

SEQ ID NO: 106863 - protein, 65 aa, Triticum aestivum
  Clone ID: PAT_TA_1281.pep
EDTKKKPSAAASPSDDDDDDDSAADSPDDSSSDDATADKDGAAPSAVAGWVTAAVAVASALALAA

SEQ ID NO: 106864 - protein, 295 aa, Triticum aestivum
  Clone ID: PAT_TA_1282.pep
AKVGHHRRRVAFFIPPPENPTPRDDQPAAAMLLRRPLQTLTLPLLRRHLSASAAAVSAPDHNIDELLSPPFDYLPGHPRPDAKHDEVIFAVPRDSSGRHFAAKERKAGRVPAIVFEQENGQEGGNKRLVSVPSKQIRKLVDHLGRSFFLSRLFRLQVWSEQAGQGDLIESVRVLPRKVHLHAGTDEPLNVTFMRAPSSALLKIDVPLMYIGEDASPGLRKGAYFNTIKRTVKFLCPADIVPPYIEVDLSELDVGQKLLMRDLIVHPALKLLQSPDQPICSIIGSRAPDQKKEKSK

SEQ ID NO: 106865 - protein, 250 aa, Triticum aestivum
  Clone ID: PAT_TA_1283.pep
LSITHGVMTIRKTLAQVEPELGARPNGTLVVDGRPVAVVYFRAGYAPTDYPSEVEWSARLLIEQSSAIKCPSISYHLVGTKKIQQELAKPSVLERFLDNEEDIAKLRKCFAGLWSLDNEEIVKSAIEKPDLFVLKPQREGGGNNLYGHDLRETLIRLKNEQGEALAAYILMQRIFPRASLTQLVQGGVCFEELSISELGIFGSYLRNKDKVVINNQCGYLMRTKVSSSNEGGVAGGFVGLGSILLTRCSR

SEQ ID NO: 106866 - protein, 358 aa, Triticum aestivum
  Clone ID: PAT_TA_1284.pep
MAKFGEGDARWIVQERADGANVHNWHWAERDCLDWSRALLSKLLAGLPVLSGEGGLTLRTTTLDKLDGEAYVNIRKGKVIPGYELSLTLAWEADATTESGVVKVTGTAEVPYLADENADEDPELRITVRGDDGPLARRAKDAFIAHGKPLVIAKIRDYVAAMANGGPAKDEIDSKKISTKAAPAAGGAAVAPAPSVKVTAAPVQAPAAKEKKANGKDKEGFKTIEMTEKFNCRSKDIYEILMDDNRWKGFTQSNARISKDVGGQFSLFDGSITGVNEELQEGKLIVQKWRFGSWADGVHSTVRLVFDEPESGVTIIKLKQTDVPEEDRYGNSTVVENTERGWKELIFQRIRAVFGFGV

SEQ ID NO: 106867 - protein, 132 aa, Triticum aestivum
  Clone ID: PAT_TA_1285.pep
HERNDPLPRSRPRASAVLARPADSGRIRRPAPGSDRLASMYIRVKRNKTTYFIQCDPTETILNIKQKLQSITDHTPNNQRLILLATNNILDDSKTLADQKVENDAVVALALRKDNEFEEVSIADPSDYMASS

SEQ ID NO: 106868 - protein, 193 aa, Triticum aestivum
  Clone ID: PAT_TA_1286.pep
MSSSASEIVADTTHGRHHLKIDGYSITKATLPTGEFLKSQPFSVGGRRWAIQYYPNGDPSSHKGHISLHLVLDDAVAGEVRAQVQFRFKAEKKHALSFLQSWGRKPAPLKLGRVEAGEDGVWECPNFVKRKTLEESDHLKDDSFTIRCDIIVVNEFRADGGPPRAAAPRSIPVPPSDLGKQLGDSSRRQGRRR

SEQ ID NO: 106869 - protein, 160 aa, Triticum aestivum
  Clone ID: PAT_TA_1287.pep
PYSLAPERELDCGGDGEACPQIRHGGAAEQRAQGLRPARSSVERSSGDAATQLWGISPAAAGASFWRRRHPRRGGQAMRTCMRMAAAAAASFHEPPRRAAASWPWRARTTVAVRTPKAGIILLWRPLSRPRERDAITSIITQLMALRLTPPLPPPPPEPD

SEQ ID NO: 106870 - protein, 199 aa, Triticum aestivum
  unsure (1)..(199): unsure at all Xaa locations
  Clone ID: PAT_TA_1288.pep
MVQRSSNAEVMCMDLSPKKPAKAYGSDGGAYYDWSPADLPMLGAASIGAAKLHLSAGGLALPSYSDSAKVAYVLQGAGACGLVLPEAAKEKVIPVKEGDALALPFGAVTWWHNAEGSSAELVVLFLGDTSKGHTPGRFTNFQLTGASGIFTGFSTEFVARAWDLDQDAAAKIVSTQPXXGVVKIXXGHKMPEPSAXXRX

SEQ ID NO: 106871 - protein, 135 aa, Triticum aestivum
  unsure (1)..(135): unsure at all Xaa locations
  Clone ID: PAT_TA_1289.pep
APALPSPPAPPRPXPPCSASEAASSPNSSRRAPPPPLPSPPTPXPRPRPRPPFPQTLASSPWRSTSSPPAASPARRPSRPPPSSPTSSPPLTPTPSAPSSPASASPAPMSPPSSRATRSSSVPSVGEXPGPVTKN

SEQ ID NO: 106872 - protein, 67 aa, Triticum aestivum
  Clone ID: PAT_TA_1290.pep
TNIALKNCISFAILMVYDRKFFSCLQLYCFLLLELHMPGKDYTKQILFLFAYNQVRQQQLRFSRSCK

SEQ ID NO: 106873 - protein, 166 aa, Triticum aestivum
  unsure (1)..(166): unsure at all Xaa locations
  Clone ID: PAT_TA_1291.pep
DPSQIPNPSSALSTSPAGERRCRRSRPDPVLAPLHSFFSLPPIFHSGFKVAWIRLPARPNAARRIIAGIRRPSLVVLADGRGRLGHSCLGHHLASTMPDSDGFATVPKTRGTELLENTQXPDGYTRQLFFLTPSPHWLSIKAYEVPRARNSITGGKRRTFCYIPSG

SEQ ID NO: 106874 - protein, 75 aa, Triticum aestivum
  Clone ID: PAT_TA_1292.pep
MSCNCGSGCSCGSDCKCGKMYPDLTEQGSAAAQVAAVVVLGVAPENKAGQFEVAAGQSGEGCSCGDNCKCNPCNC

SEQ ID NO: 106875 - protein, 131 aa, Triticum aestivum
  Clone ID: PAT_TA_1293.pep
AARLRALWLGVAVARGGGEAGCDGGVVHGVVEALRLHHPQPQLTRLLLRQHPEPPRPRSTSSSPLLLRRRCRRRLGVDVVGLARPPEERRPPLPVGAAEPGTSGGRGGARAGPAGARRRGPGGERGRGSRC

SEQ ID NO: 106876 - protein, 453 aa, Triticum aestivum
  unsure (1)..(453): unsure at all Xaa locations
  Clone ID: PAT_TA_1294.pep
QTESFSEDTKLVQLMTSAIIPGLQGDVSTKHPRGVPFVGGPKHVAACAKHFVGDGGTHHGISGNNTVLSFHDLMRIHMPPYYDAVIKGVASVMISYSSWNGVKMHENKYLITQILKEKMHFRGFVITDWQAVDKITTPPHKHYYRSSQESTHGGNDTVRTAYDNAEVAAAVPAQVLGGAEQGDGITDGEARILRVKFTMGLFENPFPEHSLTAQLGTKEARGLAREAVRKSLVLLKNGKGRKDGKPVLPLSKKAKKILVVGTHAHDLGLQCGGWTKSWQGQSGNGITGQGTTIXEAIKSAVDKKTVIDYTEHPDKGSVSKNEDEYDYAVVVVGENPYAATAGDNLNLTIPGPGPEVIRKVCELVECVVVLVSGRPLVVEPYLDTIDALVAAWLPGTEGHGVADVLFGDHGFSGKLPRTWVRSVDQLPMNYGDKLYDPLFPFGFGLTTKPADRS

SEQ ID NO: 106877 - protein, 222 aa, Triticum aestivum
  Clone ID: PAT_TA_1295.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLG

SEQ ID NO: 106878 - protein, 126 aa, Triticum aestivum
  Clone ID: PAT_TA_1296.pep
MSGMKDANAAGHDNVGNSEPMDQSGDNAMPSAQQQEQVIKKKFGGLIPKKPPLISKDHERAYFDSADWALGKSGQQGVAKPKGPLEALRPKLQPTRQQQQRSRSSIYSSSENEDGDGAGSEDMNIN

SEQ ID NO: 106879 - protein, 369 aa, Triticum aestivum
  unsure (1)..(369): unsure at all Xaa locations
  Clone ID: PAT_TA_1297.pep
MEGVGREHDSSVALPVEDFGAAKDTTSVSTKPTRRYPLASWVAILALATLVGVYIFSLXLKQNGMLFGLRQTNMIEKEREQPCHHPGVPETEIPFVHFPTPNTYSRKECACTPVRFFAILSMQRSGSGWFETLLNSHENISSNGEIFSVKDRRSNVTAITQTLDKLYNLDWVSSAAKNECTAAVGLKWDAQSGXLMTHHQEIAEYFNRRGVSLIFLLRRNLLQRYVSILAXNDYDRNTKQLNGTHKAHVHHRGQADVLAQYKPTIDTKSLIAELKRSDKLAADGLVSFKKIRSIVLYYEDVVSNRTKLTDVLDFLKLPKMKLSSRHVKIHTKRLRDHIDNWTDVSNTLNGTQYQSXLERPKMTRLARCK

SEQ ID NO: 106880 - protein, 100 aa, Triticum aestivum
  Clone ID: PAT_TA_1298.pep
RACNNCRQPGHIARECKNDPICNLCNVSGHLARACPKTTTLASEIHGGPFRDISCRMCGQPGHISRNCMATVICDTCGGRGHMSYECPSARVFDRGVRRF

SEQ ID NO: 106881 - protein, 132 aa, Triticum aestivum
  Clone ID: PAT_TA_1299.pep
CLAVASSRAALFPTPIPIRSSGRHWSGGKHHRGHSCTAASISTPTVAARAQAFIDQPAMAGTLRCEGAYPCCDNRMSSRAITNVFPGTLDGYNIATPGFLGAANACYPPLQSGPRAILAPQGREVMNGLLDH

SEQ ID NO: 106882 - protein, 278 aa, Triticum aestivum
  Clone ID: PAT_TA_1300.pep
MESSDDEHAMESDTVTESDLISELPEDILQKILSCVWIRTVVRMRRVSRKWMELCESLQFIRLDYRDFEHWKVEKFTRFVNNLLLVRRKVDLHTFQLHWNPHGPLNCNDVRMWIGYAVKHNVKVLDVKLCLYDKTVLPPAIFTCRSLQELNLQWGNAPYRDYDHTGLVLPDIINLPSLKKLTLRDVEVDELSLNRFIARSPGLEDLNLIDSAMRLDLIASKALKRLTLDGFLGECDGFTIAAPHLISFECTGMFTGSYFLERPTISRERTHRYLWVYI

SEQ ID NO: 106883 - protein, 198 aa, Triticum aestivum
  Clone ID: PAT_TA_1301.pep
AQPLVPSSPSLSLSGTLALHSSLAAATSGARSWRPQAGIEDRCPARSGPRGEIHLSLTHEKENPPPHSHDSSAPPSIPFLPEDARAAPSPIHISPRPPTSCRHPPRRLPDGCRRLNPVRVHGIHDRGGARGDGRAGPAAPHGGGPGGRHRRLAGGGRRHHVLHLARGLALWRLCTAMTTSSPVICLHLLLLAPSFLLL

SEQ ID NO: 106884 - protein, 133 aa, Triticum aestivum
  Clone ID: PAT_TA_1302.pep
MRLLTHNFLASNVKGVSTGYPLALEVAKTSIKEVELNVDFLRGILPKIDWRALFAAMPAAGFPELLAAEQPPEAELFAEGAADVEGSAIRRLHHALLEIHVQEGTLVCPDSGRSFPILKGVPNMLLHEDEVRH

SEQ ID NO: 106885 - protein, 170 aa, Triticum aestivum
  unsure (1)..(170): unsure at all Xaa locations
  Clone ID: PAT_TA_1303.pep
TQKYQKYYFTVYPSLSDLTLQITMKGLTTPLSRWVQVGVCLCRYSVTCALSPTGLIPWFSKAEGNTYSTLLYHPFLFKGKINASSRSSRKNFWRRCRGDLRQAETYQVPIINSHLSHYIIRHSPLIFPSPTSKTIFEKTPFXALXRHLLVCFMCPCXXCXLSRWSRYTNX

SEQ ID NO: 106886 - protein, 305 aa, Triticum aestivum
  Clone ID: PAT_TA_1304.pep
SARGLRNWKPAAGCRSAPFARALPPARARPKQGHRRRRRRRRRSKPAVLKCWTKMEAAGDGSMGMFGGTPDAAAAIGRSAEVAGLLNKLVNGLGAAVMDIPSDEFTIHPSTDLLIQALQNYSCNTYLVEPVHHTTDPCSHMVDCWAAKLKKDAEMIRRGEKGGKYIFLLNNTYDVLQMLQPPSASFAGAQEMASRLTSMVELYNKCYLDECWAPLHRLNLDMFAAEFRAICDCQSTWKVGAELRYNLRQEIVDSVVPPYEALLSDRSACSGPSFSLKRMVFGGKKQKRYDTGAQLEGKIRGLFEG

SEQ ID NO: 106887 - protein, 146 aa, Triticum aestivum
  Clone ID: PAT_TA_1305.pep
RRRESLGCLWYSHVGAFTGGNFDTPTSAPTGRRATPPCLPRLRHSPRALAWHMVGRQIWRATEPLHTGSVACSHNRGELHHHGTGTPPLSRCTDEHAVTAPAVAANTSALPARKWLPSHRGREEESSAWLVLVDGEEKDELLWAMK

SEQ ID NO: 106888 - protein, 183 aa, Triticum aestivum
  Clone ID: PAT_TA_1306.pep
MAMQTGCCSAAAVLLLLVVAAAGASVAGASYVRYKDPKQPIQARVEDLLGRMRIEEKIGQMTQIERHNASSAVIEKYFVGSVLSGGGSVPSEKASAATWQEMITKMQKAALSTRLGIPIIYGIDAVHGNNNAYNATIFPHNVGLGATRDPDLVKRIGRATALEARATGIPYTFAPCVAVCRDP

SEQ ID NO: 106889 - protein, 149 aa, Triticum aestivum
  unsure (1)..(149): unsure at all Xaa locations
  Clone ID: PAT_TA_1307.pep
MENGGANPEIGQADSGMAEMVCDGVLTDAQGGARRRRDESHTRSAQSIDRVNPEAPGWTKRHRLGSAPPGRVPCPSRMSALELSIRKYAKHHDKSVVRPELSLSFDSLGEAYDFYNLYPXKIGFGIRYGKDPTPGQRHHLWFSVNGITR

SEQ ID NO: 106890 - protein, 175 aa, Triticum aestivum
  Clone ID: PAT_TA_1308.pep
MRPPAALVVVAAVLLVLSGVDATVETTCKAAADEDAHVNYDFCVSELRKHYQSSDADTWGLAKIAANMGVNNAYGAIHDIERLLARPGTDAKTKVALGQCQGLYDNMKFAFAGAYDEINGRNYAAGKEEVAKAVSLAHQCDDAFVKAAVPSPLKQRSLYSVQTAIVCRAITNLIK

SEQ ID NO: 106891 - protein, 183 aa, Triticum aestivum
  Clone ID: PAT_TA_1309.pep
SSTTRTQKAVHLIKRKRTSLEVSMQRSLAVGIKSENNGKRDYTGTGTVPSLHKQDSKILTKKTIKLLDAPPCPKRPKLEPTQTTRGAEAKGHESLPHKIVPEMVRCTASEKSGLLKQRRISDAKRIDKKNARSGVRSKYDCFTLKSGLGNHDSSFLGNGMLGAHGLKSDIRDITNHIENLTLS

SEQ ID NO: 106892 - protein, 87 aa, Triticum aestivum
  Clone ID: PAT_TA_1310.pep
LLMAPIGSNTRALCLVVLLLMSTTFLSCHASGTAGGWTKFCVAEKACAPTAGPKDDHVCKADCGRQGYDKDKSYCAPDPSGICCCQK

SEQ ID NO: 106893 - protein, 53 aa, Triticum aestivum
  Clone ID: PAT_TA_1311.pep
RHMGVGGDDSWTPCVHEEYLLSPAASYRFSLRLRPLLPSSSSCHDIYLSQLPH

SEQ ID NO: 106894 - protein, 229 aa, Triticum aestivum
  unsure (1)..(229): unsure at all Xaa locations
  Clone ID: PAT_TA_1312.pep
RWKNCQGRDFTINGLMFNPYSEKIYDYLGGIEDIKKAKVRTVXXXATSFHEDCARILRAIRIAARLGFSFPKETAYYVRNLACSVARLDKGRLLMEVNYMLAYGSAEASLRLLWRFGLLEHLLPFQAAYFSSTLFKRKDNGTNMLLVLFSKLDSFLAPNRPCHNSLWISILAFHEALVRKPRDPLVVATFALAVYLGGDLPLAVDIGQSINRQHDAGFAELLEPRMWGK

SEQ ID NO: 106895 - protein, 619 aa, Triticum aestivum
  Clone ID: PAT_TA_1313.pep
MYISWKFAMGRATWLATSCLIAQVNGVLWDIDSNEERDTFWHSSAHILGEAIDTLYGCKACILGESTERVYFCYVSIGPCTTIGEGFYYDAHYKDLTLNDTHFGLIDKQAKKAVAEKQPFERIEVSRAEALEVFAENEFKVEIINELPEDKTITVYRCGPLVDLCRGPHIPNTSFVKAFACLKASASYWRGKADRESLQRVYGISFPDSKRLKEYQHMIEEAKKRDHRLLGQSQKLFFFHPLSPGSCFFLPNGAIIYNKLMDFLRKEYRERGYQEVLSPNIYNMQLWETSGHAANYKDNMFVFEIEKQEFGLKPMNCPGHCLMFGHEVRSYRELPLRMADFGVLHRNELSGALTGLTRVRRFQQDDAHIFCTESQIKDEVRSCLEFIDYVYKIFGFEYELELSTRPEKYLGDIETWNKAEQQLTEALNEFGKPWKINEADGAFYGPKIDIGVFDALKRKFQCATLQLDFQLPLRFKLTYSAEDEAKLERPVMIHRAILGSVERMFAILLEHYNGKWPLWLSPRQAIVCCVSANSLTYAKEVHAQIRAAGFHVDIDMTDRTIQKKVREAQLAQFNYILVVGAKEAESGKVSLRVRDRADLSTESIADVIARFNDEVASFQ

SEQ ID NO: 106896 - protein, 137 aa, Triticum aestivum
  Clone ID: PAT_TA_1314.pep
VRGRVGGRVGDYVKWRGVLFLRFLPSLVDESDKIRHLADYLFGSILKAKAPLLAYNSFIEAIYVLNNCTGHGGYSESQSQSSQGSQSSDRGQALFAIWGTDERSRSKRMHIYVSLLKQMAPEHLLATSAKLCAEILA

SEQ ID NO: 106897 - protein, 152 aa, Triticum aestivum
  Clone ID: PAT_TA_1315.pep
MEHINIPKKHLLKIDMWLSYSSCHKYDITCSSTWNNAAVADLREMISKTKSTARTTASTAASRSMTSPRLWCSRSLGPANPQSSSMVTPSKHQVRGWLQVRTSILNAGNQESNLMGGIQHQQILTEKKNKRRGERGSAKNILTVSRPPPRAA

SEQ ID NO: 106898 - protein, 226 aa, Triticum aestivum
  Clone ID: PAT_TA_1316.pep
SSDIVCCPLPRWSKDEARLVDREMDVAGCLRRVVGLPVPLCDQATAVWLAAMPNRTRDEIGRHRFVSCDLFLASTKRRCAGPNLGRSYPVRLIKTLLTVRFFRPHHAVLYSANHASAMDELLDPSDLHRSPPLSAAPPRRRCTPSSSPVVSAPPPDGCIFAKRRTQQLALAPPITAQHRRRSRPAPPDSTKKHISAQKRTPVGSCSKTKNWFQQKNKGFQQINLST

SEQ ID NO: 106899 - protein, 66 aa, Triticum aestivum
  Clone ID: PAT_TA_1317.pep
APVPRWPRVPASRRTLGTSPAPPSPPRRTAAATQAGTPRPPAAPGTSPRSASARLPQSTGRRRRVP

SEQ ID NO: 106900 - protein, 87 aa, Triticum aestivum
  Clone ID: PAT_TA_1318.pep
MTQKQAMFKGQTKKKYIPPKHHGNAPHIRKGKRAVKQTKWTKELANDKDLTKFINHANEIKAANKASKEASELSKDKADVENSNSKQ

SEQ ID NO: 106901 - protein, 66 aa, Triticum aestivum
  Clone ID: PAT_TA_1319.pep
NGDNMNIGYDYEQCIGLKVKPRKGDGLLFYSLMVNGTIDPTSLHGSCPVVRGEKWVATKWIRDKTL

SEQ ID NO: 106902 - protein, 188 aa, Triticum aestivum
  Clone ID: PAT_TA_1320.pep
SCSAAAVPPPPAPTRAAEAAPTAPRCRSRSSSSSPPPPATRAAAAGSGPPRSRRRGDVGPARPRRRPPVSLTRPHGCRPNRCPRRRRSGIPASSTPPPRRHRRLPRRRSGTRASSPPAPRHRRRHYHRRQGHPPPRQRNGQQVSPWSWTPWLAIASRLYARAVEQVSDNAGRPMVDGFLFPARPARSG

SEQ ID NO: 106903 - protein, 228 aa, Triticum aestivum
  Clone ID: PAT_TA_1321.pep
MVSSCLASPATARGGSALRLQFQPRGCRVTCLPDAGGAGSGGRAKAVGGFACGLLAAWAVASAPSPVIAAGQRLPPLSTDPKRCEAAFVGNTIGQANGVYDKVLDLRFCDFTNDKSNLKGKTLSAALMSGAKFDGADLTEVVMSKAYAVGASFKGTNFTNAVIDRANFGKADLEGAVFKNTVLSGSTFDEANMKDVDFEDTLIGYIDLQKLCRNTSINEDTRLELGCR

SEQ ID NO: 106904 - protein, 80 aa, Triticum aestivum
  Clone ID: PAT_TA_1322.pep
TYDHTVCFIVKLWAFWLLEALDLEILLLRSEKNIEITSKKTTTDVAQTAKIHIFDDLASLFDLCTPDTVSVALSTACCLI

SEQ ID NO: 106905 - protein, 250 aa, Triticum aestivum
  Clone ID: PAT_TA_1323.pep
SSITVVSSRKNGIRDWQLSFRGKRVLELGCGSGLAGIFACLKGASIVHFQDTNAESLRCRTMPNVLANLEQARDRQNRPSESPVTPSRQLLAPVVHFYAGEWDELPTILSVVHPPAQPTNLSFSEDDFMDGCSSHDGSSIVGQDPRRSRKLSGSRAWERASETDPADGGYDVILISEIPNAVNSLRKLYALITKCLRPPYGVLYVASKKNLVGSSGGARQLKSLMEEEGVLGGHFLTEISDREIWKFFFK

SEQ ID NO: 106906 - protein, 174 aa, Triticum aestivum
  Clone ID: PAT_TA_1324.pep
MVLELDRVLMLRAAVLAVVTGFAAAGFISNDALQSHSHGGAGRSLLQAKKECPVTFEGANYTLITSKCKGPLYQPALCCAALTEFACPYDTYINDVATNCAATMFSLIHLYGKYPAGLFANTCKGDNLGLKCPEDVPQVQPGEEGKSSAAVATAAQAALAAASAAVMSLLIVMS

SEQ ID NO: 106907 - protein, 94 aa, Triticum aestivum
  Clone ID: PAT_TA_1325.pep
SYRLLPNGGGGVSQIRQANLKFLPVLTQQQAVIGNRCSQNSQSLDRAITRESQPHDVDVCGARKAYNMVAKMVSNNQFRDAKLNKRSTTVLCWS

SEQ ID NO: 106908 - protein, 155 aa, Triticum aestivum
  Clone ID: PAT_TA_1326.pep
MATSSRRVPLLLLCLGVLVSCSFAAGSLDQELDITWGDGRGKVLDNGRLLTLSLDRTSGSGFQSRHEYLFGKIDMQLRLVPGNSAGTVTAYYLSSQGGAHDEIDFEFLGNVSGEPYTLHTNVFTRGQGQREQQFRLWFDPTADFHTYSILWNPKH

SEQ ID NO: 106909 - protein, 357 aa, Triticum aestivum
  Clone ID: PAT_TA_1327.pep
PVVAWVSGTCARLFKSEVQFGHAGAKSGGELESAQAKNQALRDAGAVVPTSFEALESVIKETFEKLVEEGNIPPVPEVTPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 106910 - protein, 439 aa, Triticum aestivum
  Clone ID: PAT_TA_1328.pep
VGFVSKSGGMSNELYNTIARVTDGIRQGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPLVPEVTPPPIPEDLKTAIKSGKVRAPTHIISTISDDRGEEPCYAGVPMSTIIERGYGVGDVISLLWFKRSLPRYCTQFIEICVMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHAHFPSVKYMEYAVQVETYTLSKANNLVMNVDGAIGSLFLDLLSGSGMFSKQETDEIIEIGYLNGLFVLARSIGLIGHTFDQKRLKQPLYRHPWEDVLYTK

SEQ ID NO: 106911 - protein, 289 aa, Triticum aestivum
  Clone ID: PAT_TA_1329.pep
MAVSSVLAILLDASCALASATFDKEFDITWGDGRGKIMNNGQLLTLGLDKVSGSGFQSKHEYLYGKIDMQLKLVPGNSAGTVTAYYLSSQGPTHDEIDFEFLGNVTGEPYTLHTNVFTQGQGQREQQFRLWFDPTNDFHTYSIIWNPQHVIFAVDGTAIRDFKNHEARGVSFPKSQPMRLYASLWNADDWATQGGRVKTDWSKAPFVASFRNFNADACVMSGGAQRCPAGTMEASAAGANGGSGSWWNQELSGMGYRRMRWVQRKFMIYNYCTDPKRVAQGLPAECKLR

SEQ ID NO: 106912 - protein, 258 aa, Triticum aestivum
  Clone ID: PAT_TA_1330.pep
MARMAVSVLAILLASCALAAASFDKEFDVTWGDGRGKILNNGQLLTLGLDKVSGSGFQSKHEYLFGKIDMQLKLVPGNSAGTVTAYYLSSQGPTHDEIDFEFLGNVTGEPYTLHTNVFTQGQGQREQQLSGSIKRLHTYYERLREPVAATGVAYPRSQAMRVYASVWDAEEWATQGGRVRTDWSRAPFVASYKGFAASGCASQDAAACARSNGAWMYQELDATALDRLQWVQKNYMIYNYCTDTWRFKDGAPPECATK

SEQ ID NO: 106913 - protein, 116 aa, Triticum aestivum
  Clone ID: PAT_TA_1331.pep
GTTFFLMGRTSIIQTRDTTNTNSARRQTTYTVHVPTGWARTRRLQEHRQQKNFLPPHHARTSYCVTNRQVLYLSTMFRCLSSCLDPVIDTDRRSGSSRADHMHTHARARHCWTGEE

SEQ ID NO: 106914 - protein, 290 aa, Triticum aestivum
  Clone ID: PAT_TA_1332.pep
MARMAVSVLAILLAASCALAAASFDKEFDVTWGDGRGKILNNGQLLTLGLDKVSGSGFQSRHEYLFGKIDMQLKLVPGNSAGTVTAYYLSSQGPTHDEIDFEFLGNVTGEPYTLHTNVFTQGQGQREQQFRLWFDPTNDFHTYSILWNPKHIILMVDDMPIRDFKNLEGKGIAFPKNQPMRLYSSLWNADDWATQGGRVKTDWSKAPFVASFRNFNADACVMSGGAQRCPAGTMEASAAGANGSGSWWNQELSGMGYRRMRWVQRKFMIYNYCTDPKRVAQGVPAECKLR

SEQ ID NO: 106915 - protein, 359 aa, Triticum aestivum
  Clone ID: PAT_TA_1333.pep
MAVSALAILLASCALAAASLDTEFDVTWGDGRGTILNNGQLLTLGLAVLRSSRPESGHNTPEYNTECRRIQIPTMASSPRRTVVCSVLPLLLLLAGAARAAGNFYQDVDITWGDGRGKILGGGDVLTLSLDRASGSGFQSKNQYLYGRFDMQIKLVPGDSAGTVATFYLSSQGSAHDEIDFEFLGNASGQPYTVHTNVYSQGKGGREQQFRMWFDPTADFHTYSVVWNPTHILFYVDGTPIREHRNREAATGVAYPRSQAMRVYASVWDAEEWATQGGRVRTDWSRAPFVASYKGFAASGCASQDAAACARSNGAWMYQELDATALDRLQWVQKNYMIYNYCADTWRFKDGAPPECATK

SEQ ID NO: 106916 - protein, 314 aa, Triticum aestivum
  Clone ID: PAT_TA_1334.pep
LFFLLYLLFPASSSRLSFCWSTLSPARMAVSVLAILLASCALAAASFDKEFDVTWGDGRGKILNNGQLLTLGLDKVSGSGFQSKHEYLYGKIDMQLKLVPGNSAGTVTAYYLSSQGPTHDEIDFEFLGNVTGEPYTLHTNVFTQGQGQREQQFRLWFDPTNDFHTYSILWNPKHIIFMVDDMPIERLQGNCGGKGIAFPKNQPMRLYSSLWNADDWATQGGRVKTDWSHAPFSASYRGFKADACVVTAAGRPRCGASVGTEVAPGTGAAGEWYNQELDLTRQQRMRWVQSNYMIYNYCTDPKRFAQGVPAECSM

SEQ ID NO: 106917 - protein, 132 aa, Triticum aestivum
  Clone ID: PAT_TA_1335.pep
SKSLRWSLASYSTMTNGDSLFTASSSCASNNGTEIMLSWRRCIVSIKWFPGSLARTYLWRRRFNLAASRRCSVPGGVSGLTIGHHGRLESCLGWKTTGKKKAMSRRRVFLAKQVKPASGRWTRRAVLVDWNN

SEQ ID NO: 106918 - protein, 306 aa, Triticum aestivum
  Clone ID: PAT_TA_1336.pep
MSAPPMAASAQELPPAQQQPAAEQAPSLALALVPQPQAQAQIKPTRVSLSYEEISKLFSLPIAEAASILGVCTSVLKRICRTHGIVRWPYRKIVSGKGDDAKNAEREKAMQLLELSKIAKQKAISSSGSLATSSSGAFQGVPKAQQGSAKAGTAIGRQNAPSLSQFSQAKDIPTYMDDFKYGFPSSGLSTETMKWWGTDSHTETAPAKDDNREGSESTNEASKGTDDELDWGADEPEADADGVAAATDPSAQLCSLRRKAAGDGRRLLNGDTGRVQQLCRLNKRQKIVLAQVFGASLPEQRRSKLA

SEQ ID NO: 106919 - protein, 236 aa, Triticum aestivum
  Clone ID: PAT_TA_1337.pep
MAAEGGLKLLGLTVSPFVIRVRMALQMKGIGYEYMEQDLFTKGELLRKSNPVHMKVPVLIRDGRPICESLAIVQYVDEAWAATGPSILPADPYDRAAARFWAAYADSKLLPAWVGIMWAATEEERAEKVGDTLAAIGQLEEAFGKCSKGKAFFAGDSVGYLDLVVGSQLLWFEALQKMFGVVVVEVGRAPLLAAWVKQFGETDTAKEVVPDVDTAVEYLTKLQSRRAGSTVAQLLS

SEQ ID NO: 106920 - protein, 440 aa, Triticum aestivum
  unsure (1)..(440): unsure at all Xaa locations
  Clone ID: PAT_TA_1338.pep
TPTATPISPRPHDSPSAQQPRTHQGGCGSARRATDAVPPVASAPGARQLDVRLPRAAMGRAVVLQGGAAPSSCRGADCAEGLKAVHATNIRDTFRVLIHVGPLPIFGGQVPVVKVGRLAGRMAKPRSDNFEDEEGVKLPGHSGHNVNGDALDLKSRTPDPDRMIRAYAQSVATLNLLRAFATGGYAPMQRVIQWNVDFMDHNEQGDRHRELAHRMGAALGFMTPAGXVLDHPIMTTTDFWTSHECLLLPYEQALTXERTQHVVIPSTGWTKWAGFVKRTDIFNPSNKEGRLAIATRLGVKNMKMKLPHLIRAVRNSGQIIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLTNNLPLPPLAF

SEQ ID NO: 106921 - protein, 158 aa, Triticum aestivum
  Clone ID: PAT_TA_1339.pep
MAPAAARLLPAAMPITPHRPLNWCRSAAARRPSPSMRLLRSNSRLLVVASAQSNLSKAVQKTWRVSKEAVDAGSALVPGSVPRPIARIGVTFVAVSVALFLLKSVISTALFVLAMMGLIYFAFLAMNPKEGSRSMDEGDSPSSDDPAEEARRIMEKYK

SEQ ID NO: 106922 - protein, 119 aa, Triticum aestivum
  Clone ID: PAT_TA_1340.pep
KKDRGSASKATVAIPNSALTQATARRGTPATSVLRRPLSTVAHPARQRASSFSGLSLPSTPRPRPSPARHLSSAEPSILRNERSQLLRSPARSAAPSLHPLTTVIYLPSPVLSLCRTSD

SEQ ID NO: 106923 - protein, 136 aa, Triticum aestivum
  Clone ID: PAT_TA_1341.pep
PPPMPGSSHASGCLGRRRSVAGEWAEAVWCEWAQGSCSLVGGQPVRLPELSVDRTHHRVNCSVGCPCKKDCCGGSASLPLLHQQSGDPYAKVQKSYFVYMSCYWQWTDCLCRVRREKNAHIQTQTTSSRRLEHPTD

SEQ ID NO: 106924 - protein, 103 aa, Triticum aestivum
  unsure (1)..(103): unsure at all Xaa locations
  Clone ID: PAT_TA_1342.pep
MSGRGKGGKGLGKGGAKRHRKVLRDNIQGITKPAIRRLAXRGGVKRISGLIYEETRGVLKIFLENVIRDAVTYTEHARRKTVTAMDVVYALKRQGRTLYGFGG

SEQ ID NO: 106925 - protein, 192 aa, Triticum aestivum
  Clone ID: PAT_TA_1343.pep
AVSKDGKLIISTSRDSAILLFNRDTKQERLIEEEHTVTSFSLSEDGDFLLVNLINEQIHLWNIRNDPIQVKQYTGHKRSRFVIRSCFGGSEQAFIASGSEDAKVYIWHRASGDVIETLSGHSGAVNCVSWNPTNPHMLASASDDHTIRIWGLKKATVKRRDAGSSSGSNGIHMNGSANGNGFVHQCNGSRSK

SEQ ID NO: 106926 - protein, 680 aa, Triticum aestivum
  unsure (1)..(680): unsure at all Xaa locations
  Clone ID: PAT_TA_1344.pep
FAETAARLRRRAESPLSVGRARERRGDVQRPSAPRRARAVTRGSGTGLQTAVTDSFLWWHVLVACVTLFSTEVKNIWADFGISWDGFEDAEPPSIRARASSVESANLPETTCYSIPTHPLGGTMARPLASPRKDVMVGSKGVIKRDGCGAFSSLPLYTLGYEKSGAVLEEESGITLHSPSVNLFRKQVLDGNWDNAVATLNKLGLLDENXLKSAAFLLLEQKFFDLLRNDNLMGAIKTLQNEISPLGVNRKRVHEMSSCIISSHAELLACISKXGTEASDSRLKLLEELQKVLPPAVMVPERRLENIVEQALTVQREACYLHNSIDGLSPYVDHHCGRDQIPSRTLQVLRAHGDEVWFLQFSNNGKYLASSSNDKSAIIWKVDEDGELLLKHRLTGHEKPVMMVAWSPDDSQLLTCGMEEAIRRWNIESGECIHVYEKPGLGLTSCGWFPDGKQILCGLSDQSLCLWDLDGKEADCWKGQRSSKTSDFAVTKDGKFIIIMNRDSTILLFNRDTKQERLIEEDNTITSFSLSDDGDFLLVNLISEKIHLWNIRNDPSRVKQYIGHKRSRFVIRSCFGGSDQAFIASGSEDSKVYIWHRATEDVIETLSGHSGAVNCVSWNPTNPHMLASASDDHTIRIWGVKKASTKRKDIGSSSSSNGTHMNGSANGNGFVHQCNGSRSK

SEQ ID NO: 106927 - protein, 164 aa, Triticum aestivum
  Clone ID: PAT_TA_1345.pep
KRTDQRLPRKLSSPPRSYRLQPSASRALGPWQGGPHRSLRCLSHGHPLASKTWYRQEREQGHGVAALQLPEPTTPCPPGALRPASRRPAKTCSRLHQKASTTVKDQPRKIDTIGGDQIRCIDLVVVVYQLWFSCMYATMGSIVCLNSLICFDVYVLTATRSLKC

SEQ ID NO: 106928 - protein, 373 aa, Triticum aestivum
  Clone ID: PAT_TA_1346.pep
MAVSLLANDVSDLCIGKPAVRSLPLSAAAGDLAATVRKGPRAAAAACIAVGPARGAVVGRAGLADVLCLLCSSPDALARPTAALDRPVSALLPKDGAGEVRRVDPRSSVLEALDEILSGAQVLAVPLRSGGRKKQLGGVAGVTGDFCWLTQEDLVRYFLNSISLFYHVAARSVSSLGLVRPDFLSARPDEAALSAVPLIRRAIAAETAVAVVSADGHLVGEISTAHLAACDETAAAAIATLSAADLMAYIDYFGSPPEHILRAIKTGLKAKGLDAMLELMEDETMTSFSLSSSSSDDDTGRPHLRRPSSGSFGRRSTEEPVVCSPASSLVAVMVQALAHRVSYLWVLDEEDDCRLAGIVTFADILRVFREQLQ

SEQ ID NO: 106929 - protein, 382 aa, Triticum aestivum
  Clone ID: PAT_TA_1347.pep
RPLAESAKLQFSCRDYSDHLAIVRAYDGWRDAERDRNGYDYCWRNFLSAQTLKALDSLRRQFLFLLKDTGLIDENMTMCNKWSRDENLVRAIICAGLYPGVSSVVNKEKSVSLKTMEDGQVMLYSSSVNGKEAKIPFPWLVFNEKVKVNSMFLPDPTAMSDSIWLLFGGNIQQGGSDGHLKMLGGYLEFFMSRDLASTYLNLKGELENLIHCKLQNPRIDIQTSEELLSAVRLLVTEDPCSGRFVYGRQEPRSKKAKTMISSASVASMDRGGGGGHGGDNPKNQLQTLLTRAGHDNPSYKTKQIKNTLFRSTVEFNGMQFVGQPCANKKLAEKDAAGEAISWLTGGEAPPVTANARGRQDADHMSMLTKPATRRRRHHHRRS

SEQ ID NO: 106930 - protein, 149 aa, Triticum aestivum
  Clone ID: PAT_TA_1348.pep
MEQTFIMIKPDGVQRGLIGDIISRFEKKGYYLKAMKFMNVEKSFAQQHYADLSAQPFFAKLVDYIISGPVVAMVWEGKDVVLTGRRIIGATRPWEAAPGTIRGDHAVEVSRNVIHGSDSVENGKKEIALWFPGGLAEWKSNLHPWIYEN

SEQ ID NO: 106931 - protein, 238 aa, Triticum aestivum
  unsure (1)..(238): unsure at all Xaa locations
  Clone ID: PAT_TA_1349.pep
RPTRPGPTRQRTRGEQEGLEGGGRIEERSQKMAPVKKPKKAKRKISDSGETKIDDSSEAKTKDASKVKRTKSGGSLALLPADLRGPDTEWWYVFLSKHGELHKEAESGGRAPVPSDDEEAFRYFFRTSRRTFEYICSIVREDLISRPPSGLINIEGRLLSVEKQVAIAMRRLASGDSQVSVGAAFGVGQSTVSQVTWRFIESMEERARHHLVWPGXQERMEEIKARLEAVSGLPNCCG

SEQ ID NO: 106932 - protein, 299 aa, Triticum aestivum
  Clone ID: PAT_TA_1350.pep
SPRHHRRTPPDRRAAAGSADHHMTQPPRRPTATAEPVFLGATSIPSPWPEPATNIPVFRHPPPPPPPQKHPHGKHRSRPARLMRSVRAAFRSFPILPAPSCRGMPSLPHLPSLNGASLVRNQFHGSTRTTGTLYGRRRSRITSAFHDNPGSPPGLLLEMCVPTAKFIQDVSAAGMVRVTLECDKQQQYQHQHAGEASPAQRQLMDEPTWSAEVNGESVGHASRREATEEDELVMRLLYATSMGAGVLPDDVAEHANGELTYMRGHFDRVVGSQDSETYYMYNPEGTATGPELTIFFVRN

SEQ ID NO: 106933 - protein, 78 aa, Triticum aestivum
  Clone ID: PAT_TA_1351.pep
TRHRKPVSRDHQKLLDDSSPLIVVYSLENQGKANLDGNDDYRRRQADDAQALAFASGGEAASSAWIIDSVAACKLQPL

SEQ ID NO: 106934 - protein, 121 aa, Triticum aestivum
  Clone ID: PAT_TA_1352.pep
GSSAAWVKLRCSSACSSQLRAPRVKSFLATPSSRPPCGHYAAAQEPPASTPLQHRHAHAAATPNATTTAECCDEARGGRLLMLRQTCCGGDTADGGHRCSSASKRRRGGGVRRRHGSSPLP

SEQ ID NO: 106935 - protein, 123 aa, Triticum aestivum
  Clone ID: PAT_TA_1353.pep
PASSSPHRSIDGFPPAAAASHHPWCRRGASRHKGGARGGEAAQDVLPKPSVGAQGMQARRRRRGRRTVAGCLLAVAPDQSPISLDADDLISSITYIHKWSACQSRMKMAGSAFQCSSCLHCLG

SEQ ID NO: 106936 - protein, 300 aa, Triticum aestivum
  Clone ID: PAT_TA_1354.pep
MGEVEDMLKDYEIKKEGEAEILMLASNAVFFNPVQVHNRDMSIAVLRTFVAKRKEEYEELMNKRNNKSHKKGNQVETPVVNGDTALTSQHDEIGVVHEKETNQATNEIEDLSKEETKTPSRKVTRELKPPIVLEALAASGLRSLRYAREVDGLGKVVALDNDKASVEACKRNIKFNGASAISKVEAHLADARVYMLTHPKEFDVVDLDPYGSPSVFLDSAVQAVADGGLLMCTATDLAVLCGTNGEVCYSKYGSYPVKGKYCHEMALRILLACIESHANRHQRYIVPVLSVYMEFLCPCF

SEQ ID NO: 106937 - protein, 234 aa, Triticum aestivum
  unsure (1)..(234): unsure at all Xaa locations
  Clone ID: PAT_TA_1355.pep
MGRSPCCEKAHTNKGAWTREEDERLVAHVRAHGEGCWRSLPSAAGLLRCGKSCRLRWINYLRPDLKRDNFSRDEDELIVKLHSLLGNKWSLIAARLPGRTDNEIKNYWNTHIRRKLLGRGIDPVTHRPLTDAATVSFVHPAEATKQQATEERKPPRCPDLNLDLCISLPFXQEEERPPARACAKPVICEQLQQGGICFRCSILRVRGAPTECSCGSNFLGLRAGMLDFRGLEMK

SEQ ID NO: 106938 - protein, 124 aa, Triticum aestivum
  Clone ID: PAT_TA_1356.pep
DRDDDTQHWIKDMKYSTRVKDEEGYPAMALVNKASGEALKHSLGQSHPVRLTRYNPDTLDESVLWTESRDVGAGYRCIRMVNNIYLNFDALHGDKDHGGVRDGTTLILWEWTEGDNQRWKIVAW

SEQ ID NO: 106939 - protein, 338 aa, Triticum aestivum
  Clone ID: PAT_TA_1357.pep
MEFPHGHGHGHGRRDDDDEDRRAPAPYGRHEPDAYGAPPPSYGRRPDDDAGDAYGRHPPAAYGAPPPAYGAPPPAYGGGREDEYGGRAPAYGAPAPAYGGGREDDYGRHAPAPAGYGGGDYGRHAPAPAYGGGRDEGYGAPAYGNVVHVSHESGDERPQYGGGGSGGYGHETRPHHGGGAAPATRQPTYRILCKAGEDSFSLAARDGKVCLVRTDRDDDTQHWIKDMKYSTRVKDEEGYPAMALVNKASGEALKHSLGQSHPVRLTRYNPDTLDESVLWTESRDVGAGYRCIRMVNNIYLNFDALHGDKDHGGVRDGTTLILWEWTEGDNQRWKIVAW

SEQ ID NO: 106940 - protein, 196 aa, Triticum aestivum
  Clone ID: PAT_TA_1358.pep
MVDVSRVQKELTECNRDSDISGVSIALHDGGSSITHLTGTIAGPRDSPYEGGTFRIDIRLPGGYPFEPPKMQFITKVWHPNISSQNGAICLDILKDQWSPALTLKTALLSLQALLSAPAPDDPQDAVVAQQYLRDKATFVSTARYWTEAFAKSDSTGMEEKVQKLVEMGFPEDMVRSALLSVNGDENMALEKLCSG

SEQ ID NO: 106941 - protein, 188 aa, Triticum aestivum
  unsure (1)..(188): unsure at all Xaa locations
  Clone ID: PAT_TA_1359.pep
MVDVSRVQKELTECNRDSDISGVSIALHDGGSSITHLTGTIAGPRDSPYEGGTFRIDIRLPGGYPFEPPKMQFITKVWHPXNISSQNGAICLDILKXIKWSPALTLKTALLSLQALLSAPAPDDPXDAVVAQQYLRDKAIFISTAHYCTDAFAKIDIPAMDDMLLTPLVMGIDAGFAEQRPAEQGYMT

SEQ ID NO: 106942 - protein, 193 aa, Triticum aestivum
  Clone ID: PAT_TA_1360.pep
VDLWAIIMDAGTGFTDQVYELSPHFLHKDWIMEQWEKNFYISSVAGANIGSSLVVMSKGTPYTQQSYKVSDSFPFKWINKKWKEGFYVTSMATSGSRWAIVMSRNAGFTDQVVELDFLYPSEGVHRRWDNGYRITAMAATMDQSALILSMPRRRPRDETQETLRTSQFPSAHVKDKWAKNLYLAGICYGRTVA

SEQ ID NO: 106943 - protein, 254 aa, Triticum aestivum
  unsure (1)..(254): unsure at all Xaa locations
  Clone ID: PAT_TA_1361.pep
MMEPGPPYFAGMGSSAGGSGSGFYPTYGGNMAGAAGVNSGIQNFPAVRLRGLPFDCEDVDISKFFAGLDIVDCLLVHKNGRFSGEAFVVFPSSMQAEFALHRNRQNMGRRYVEVFXRCKKQDYYSAIAAEVNQGGPLLEPRAPXSSPPLRSRRLSEDKSSMEYTEVLKLRGLPYSATIEDIIKFFVEYELTEENVHIAYRGDGRATGEAFVEFPTAEVAKTAMCKDKMTIGTRYVELFPSTPEEASRAKPRGRQ

SEQ ID NO: 106944 - protein, 429 aa, Triticum aestivum
  Clone ID: PAT_TA_1362.pep
MGYTPGLLIVGLFGIMIMWMYGYFWITGMLLVAGGCMCSLKHARFVIPVLAMYAVYCVAVRVGWLGVFFTLNLSFLTNDLLNKLLQGYEGSTEERPFEEMKDSDPATDAFFRGCEYPPAPESEPETVSSAKPFCAAPTQDVLHVQKEPSPSQIVNSNAPSWVGGKWIFGGAADCDVLGIPRSKSINQIELKKEYRKLAVLVHPDKNMGNPLACESFKKLQSAFEVLSDLTKRNGYDEQLRKEESRQMTQRSRVVSQPSGVEFLSEESRRPTRPPTRPFHLWICTKRSKAKARWCQDCSQYHVAKDGDGWVENRYSASLKIEIPRAFVCAESKIFDVSEWATCQGMECKPNTHGPTFMVNMVGADRMPQRSHSSRYPFSLDAEMIPEDEFELWLQQALATGVFSDSPKRRKSWSPFKLPQKGIRSWRRSS

SEQ ID NO: 106945 - protein, 157 aa, Triticum aestivum
  Clone ID: PAT_TA_1363.pep
MNKERLMKMAGAVRTGGKGTVRRKKKAVHKTATTDDKRLQSTLKRVGVNTIPAIEEVNIFKDDLVIQFLNPKVQAFIGANTWVVSGTPQTKKLQNVLPSIINQLGPDNMEHLQRIAEEMQKQVAAAGAIQPKEENDDDVPELVPGETFEEVAQETKA

SEQ ID NO: 106946 - protein, 114 aa, Triticum aestivum
  unsure (1)..(114): unsure at all Xaa locations
  Clone ID: PAT_TA_1364.pep
TRERLMKMAGAVRTGGKGTVRRKKKAVHKTATTDDKRLQSTLKRVGVNTIPAIEEVNIFKDDLVIQFLNPKVQASIAANTWVVTRDSPXTKKLQDVLPCAHPPNWALDQQESTL

SEQ ID NO: 106947 - protein, 163 aa, Triticum aestivum
  Clone ID: PAT_TA_1365.pep
MVAMSTLAAGSLPGTVVPNGLLTRRFQGSQFQTTQVNHISFEREVSTKATLRSVKCSAQTQSVQRKSSTATVKRSDPKGKVQGPKLDDGSGGFPPFRFGKGGGGGGGGGGGNSYFGGFLLFTIVLLLDYLKEFEKYLLARKHRAGDDDDAGYDTSGGMLGQSP

SEQ ID NO: 106948 - protein, 267 aa, Triticum aestivum
  unsure (1)..(267): unsure at all Xaa locations
  Clone ID: PAT_TA_1366.pep
DPGSALDLLRPLALAALCVVLLAAVAGAAATATDVEAQSSYIVHVAEAHAPRLPRRGLLTTRGYGSFLRDRIPVEMSSPAPSVLYSYEHAATGFAARLTERQAAQLASSGSVHAVVPDTMQELHTTLTPSFLGLSPSSGLLKASNGATDVVIGVIDTGVYPEGRPSFAADPSLPPPPSKFRGRCVSGPSFNGSALCNNKLVGAKFFQRXQEALRGRALGADFKSPLDTNGHXTHTSSTXGXSCCRGRRLLXYARGKAVGMGPGARMR

SEQ ID NO: 106949 - protein, 217 aa, Triticum aestivum
  Clone ID: PAT_TA_1367.pep
RHEPTLSTALPLLSSSLPISIFSSLKSDDSQRFHGEVMAFCKEESGGMTERRERWRGAGRGRGMKRRNSAASAPQGARSELPRSSRRHAFLPVAAELQGATSCNPAAAQALCPCARYPDGASSSISTTASATHEVERWWPHLLITTAAAMAPRAGIWPPAPSRIGAPPRGRGGLQGEGRRPRQERWWPLSTSCSTASTNPCPHPPPPVTAEFVPVSF

SEQ ID NO: 106950 - protein, 106 aa, Triticum aestivum
  unsure (1)..(106): unsure at all Xaa locations
  Clone ID: PAT_TA_1368.pep
MAVVAPTPAPPAAPAPAAAAAAPAPALAPAPAADQATDLLQKMSLESQXPKAGEDGTELAGAIKQGPVASQPLSVSIPQDRSITPVVQDFTDPNMFYLPTYYYGGL

SEQ ID NO: 106951 - protein, 185 aa, Triticum aestivum
  unsure (1)..(185): unsure at all Xaa locations
  Clone ID: PAT_TA_1369.pep
GTRVIENFVLCECRKCGRSSRVERQTQFTHQLTAASTRCIKSKYPEDSFDVLLKREMEISKLCLSCCETTCLKECLGRCPHAFVVXLEWCHEEAAGDIGLTLGAISSSIDLSVIYGALHQNTNHVLVSMLCHSEGSHFTCFTLENGSWMFYDAANKEVAGLWENVKDICVKRVLKPQILLFAEQE

SEQ ID NO: 106952 - protein, 78 aa, Triticum aestivum
  Clone ID: PAT_TA_1370.pep
MSCCGGNCGCGSACKCGNGCGGCNMYPEVEAAGATLLVSATATHKASSGGMEMAAENGGCGCTQCKCGTSCGCSCCSC

SEQ ID NO: 106953 - protein, 275 aa, Triticum aestivum
  unsure (1)..(275): unsure at all Xaa locations
  Clone ID: PAT_TA_1371.pep
NGNKKLDAXAYQEAQAKGSSLPIFLVFSVNTSGQFVGVAEMTGPVDFEKTLEYWQQDKWNGSFSVKWHIVKDVPNNILKHIVLENNEGKPVTNSRDTQDINLEQGIQMLKIFKEHVSKTSILEDFAFYENXQKLMPEKRIKQQQIQKQVWDSRAPNPVAGEKQQEVANGKPRVSVPNGVNGEKPEDALHGEPQSAWGEWWYRGSQSFRKKKAVPPVVSFRRLPTGGKGGPNQPRPEKNTCGRTAKKPCVSPTGAVKKPRKIVLIRFSPASSYSRA

SEQ ID NO: 106954 - protein, 80 aa, Triticum aestivum
  Clone ID: PAT_TA_1372.pep
MSCCGGNCGCGSGCKCGNGCGGCKMYPEMDEGVNTTSETLIMGVAPSKGTPSFEAAAETGAENGGCKCGPNCTCNPCTCK

SEQ ID NO: 106955 - protein, 76 aa, Triticum aestivum
  Clone ID: PAT_TA_1373.pep
MSCCGGNCGCGSGCECGNGCGGCKMYPEMDDGVNTASQTLIMGVAPSKGTPSLEADDENGGCKCGPNCTCNPCTCK

SEQ ID NO: 106956 - protein, 120 aa, Triticum aestivum
  Clone ID: PAT_TA_1374.pep
RPVRDQLHSLNATTLKNTYLSHQQLYKQPPSCVSPSPPLPPLSSPSLRPASPVSRSPRRSRLVRLSRPSLFVRTTSRASSTLPSSSATLPTLTPAPSARSSTLLLSERPSPTRLTTSRSS

SEQ ID NO: 106957 - protein, 178 aa, Triticum aestivum
  Clone ID: PAT_TA_1375.pep
FVRLLIEIVLDGAQELVRLVVGGPVGLRQRPGPAGRRQEAGRRRRRRGEDQGGRGHGAEEGEGGHRARLPVDQGQGPEEEAGRHRRRRRRGRRVLGSQARLIPGGWNADRSIGRSVGFLRPSIGCVHIVLTSDSGLAPPCRPSIVLDLYLLIDSFFKKKKKKKKKKKKKKKKKKKKKK

SEQ ID NO: 106958 - protein, 288 aa, Triticum aestivum
  unsure (1)..(288): unsure at all Xaa locations
  Clone ID: PAT_TA_1376.pep
MSDAPLGLDLNRVGSSDVAEVNPFFPYKKLGQSKVSDPSECGSTTGATGESESHRKWREMKQNGFLSSTHGTAVVPKPRGRPPKRKRDDELKRSTSTQNEQTKFTKVAAPSGLLSGLNPGIINHVRNSKQVYSIIKAMVRSEELENASQPGLAGQTGERGKEVIERIQDQKYGDSLMKCHFMMEGNNAMFQHGLPTASRFLAEDGDNLKLQLSSTVTMASDRTCSTLDHESQHDYMTVLSVKAASVASQWLELLQQDIRGRLAALKRXRKRVRNALQTELPHLISTEF

SEQ ID NO: 106959 - protein, 127 aa, Triticum aestivum
  Clone ID: PAT_TA_1377.pep
LTLFQGAQHGYMSDDEGSAVKNFIGLSAPEQKRKAGQPTNSRDKPPYDDQSAKSKKIKVTSQVDTGIGCSTSKRTRFCTICRGPIHKSTTCPLRGDTPQKKRKESKCSICGVGGHRKNTCTWKATYS

SEQ ID NO: 106960 - protein, 82 aa, Triticum aestivum
  unsure (1)..(82): unsure at all Xaa locations
  Clone ID: PAT_TA_1378.pep
MSCCGGNCGCGSACKCGNGCGGCNMYPEAEXAAGATLLXVSATATHKXASPGGMEMAAXENGGCRCTQCKWRTNCRCXCCNC

SEQ ID NO: 106961 - protein, 79 aa, Triticum aestivum
  Clone ID: PAT_TA_1379.pep
MERKNSFGSSWADQWDYGSDPAPRAGGKKQGGVEKTKAAAATGLKKVKEGTAHGFQWIKGKVQKKKQGGAAGDDATAGY

SEQ ID NO: 106962 - protein, 78 aa, Triticum aestivum
  Clone ID: PAT_TA_1380.pep
MSCCGGSCGCGSACKCGNGCGGCNMYPEVEAAGATLLVAATATHKASSGGMEMAAEDGGCGCTQCKCGTSCGCSCCSC

SEQ ID NO: 106963 - protein, 80 aa, Triticum aestivum
  Clone ID: PAT_TA_1381.pep
MSCCGGNCGCGSGCKCGNGCGGCKMYPEMDEGVTTTSQTLIMGVAPSKGTPSFEAAAETGADNGGCKCGSNCTCNPCTCK

SEQ ID NO: 106964 - protein, 169 aa, Triticum aestivum
  Clone ID: PAT_TA_1382.pep
RVRPGLFVLETVEEEEEREAEAAAEAENERSSIGPVSEGDEEEGEEVESARETPWQRRTKKTGGLASLDALDDALPIKRGLSSFFSGKSRSFANLQDVAGAGTTSSKDVLAKPENPFNKRRRILRCCSIRRVSSTSLTALPPFLPPEPSFNIGNDGVINGGGGGSGGSG

SEQ ID NO: 106965 - protein, 232 aa, Triticum aestivum
  Clone ID: PAT_TA_1383.pep
SARGLDAAYQEAQSKGSACPIFLFFSVNTSGQFVGVAEMTGAVDFEKTLEYWQQDKWNGSFSVKWHIVKYVPNNILKHIILENNENKPVTNSRDTQEIHLEQGLQMLKIFKDHVSKTSILDDFTFYESRQKLMQDKRSKQQQVQKQVWDSRTPISVTSEQQQEAANGKPNPSDVPNGVTAEVKAVKAPAEKPVLANGVTNGVTTTPAVSYAAKVAQTATGKPILANGVAKTG

SEQ ID NO: 106966 - protein, 78 aa, Triticum aestivum
  Clone ID: PAT_TA_1384.pep
MSCCGGSCGCGSACKCGNGCGGCNMYPEVEAAGATLLVSATATHKASSGGMEMAAENGGCGCTQCKCGTSCGCSCCSC

SEQ ID NO: 106967 - protein, 97 aa, Triticum aestivum
  Clone ID: PAT_TA_1385.pep
RQRLRSRRRPRTTGCPWRGRRRDRSRQRRVQVRLQLHLQPVHLQVIHQIRTRRWHGMDGPNEGALVVVMHGVCVCVLFLIAAENKTRSIVSYRIVSS

SEQ ID NO: 106968 - protein, 357 aa, Triticum aestivum
  unsure (1)..(357): unsure at all Xaa locations
  Clone ID: PAT_TA_1386.pep
IDQLPPFKPLTKAQLARLTKEQKNAYFDEYDYRVKLLQKKXWKDEIRRLKEMKKRGXTDLDDYGYANITGEDDQDPPPENVSVPLPDMVLPPSFDCDNPTYRYRFLEPTSTVLARPVLDAHGWDHDCGYDGVSVEETLAILSRFPANVAVQVTKDKKEFSIHLDSSISAKHGEDASSLAGFDIQTVGRQLAYILRGETKFKSIKKNKTTGGFSVTFLGDIVATGLKVEDQLSVGKRLALVASTGXAMRAQGDTAYGANLEARLKDKDYPIGQSLSTLGLSLMKWRRDLALGANLQSQFSIGRGSKMAVRLGLNNKLSGQITVRTSTSEQVQIALLGLVPVIASIYRSFRPGEPSFAY

SEQ ID NO: 106969 - protein, 78 aa, Triticum aestivum
  Clone ID: PAT_TA_1387.pep
MSCCGGNCGCGTACKCGNGCGGCNMYPEVEAAGATLLVSATATHKGSSGGMEMAAENGGCGCTQCKCGTSCGCSCCSC

SEQ ID NO: 106970 - protein, 62 aa, Triticum aestivum
  Clone ID: PAT_TA_1388.pep
FKPFYRYECSISDKFYISYFPFKFGTNTNIVVERVPLFAWTSSSLALTVLMVSHSWFIENQS

SEQ ID NO: 106971 - protein, 533 aa, Triticum aestivum
  Clone ID: PAT_TA_1389.pep
SADAWAVLGSSIWFNAIVALTHAASAPPEGLNGAPMTYEVLMAQRSHIIQQSIRQAAGDMRLMNPVALVENHPSCRKNREGQKVLPNGQSWRHQMLLLCYSSKILSEANSLLKLQDPSPGKLFGFRFRSPPLPFLLSSLLQSRAHPKLSPDQGGNEGDSDIDLDEYSDIEQDEDEEEYDQLPPFKPLTKAQLARLTKEQKNAYFDEYDYRVKLLQKKQWKDELRRLKEMKKRGKSDMDAYGYASIAGENDQDPPPENVSVPLPDMVLPPSFDCDNPTYRYRFLEPTSTVLARPVLDAHGWDHDCGYDGVSVEESLALLNKFPGTVAVQVTKDKKEFSIHLDSSISAKHGEDASSLAGFDIQTVGRQLAYILRGETKFKSIKKNKTTGGFSVTFLGDIVATGLKVEDQLSVGKRLALVASTGAMRAQGDTAYGANLEARLKDKDYPIGQSLSTLGLSLMKWRRDLALGANLQSQFSIGRGSKMAVRLGLNNKLSGQITVRTSTSEQVQIALLGLVPVIASIYRSFRPGEPSFAY

SEQ ID NO: 106972 - protein, 235 aa, Triticum aestivum
  Clone ID: PAT_TA_1390.pep
QAIRHEVFFSVNTSGQFVGVAEMTGPVDFEKTLEYWQQDKWNGSFSVKWHIVKDVPNNILKHIVLENNEGKPVTNSRDTQDINLEQGIQMLKIFKEHVSKTSILEDFAFYENRQKLMQEKRIKQQQIQKQVWDSRAPNPVAGEKQQEVANGKPKVSVPNGVNGEKQQDAVNGKPKSPVANGVNGDAKVPAEKAAAPPAVTYAAKVAQTAAAEKKPVATEKKPVVANGAVKTGVAA

SEQ ID NO: 106973 - protein, 78 aa, Triticum aestivum
  Clone ID: PAT_TA_1391.pep
MSCCGGSCGCGSACKCGNGCGGCNMYPEAEAAGATLLVSATATHKASSSGMEMAAENGGCGCTQCKCGTSCGCSCCSC

SEQ ID NO: 106974 - protein, 163 aa, Triticum aestivum
  unsure (1)..(163): unsure at all Xaa locations
  Clone ID: PAT_TA_1392.pep
MSCCGGNCGCGSGCKCGNGCGGCKMYPEMDEGVNTTSETLIMGVAPSKGTPSFEGRRRXPGPENGGCKCGPNCTCNPVHPASDPSNPWQGRRHGRTLMKGALSSCYAWCVACVVSFLIANRRIRRRSIVPVLVKWLMVCPLWACTVLVCKASSCVVMRLFLLF

SEQ ID NO: 106975 - protein, 78 aa, Triticum aestivum
  Clone ID: PAT_TA_1393.pep
MSCCGGNCGCGSACKCGNGCGGCNMYPEAEAAGATLLVSATATHKASSGGMEMAAENGGCGCTQCKCGTSCGCSCCSC

SEQ ID NO: 106976 - protein, 78 aa, Triticum aestivum
  Clone ID: PAT_TA_1394.pep
MSCCGGNCSCGSACKCGNGCGGCNMYPEVEAAGATLLVSATATHKASSGGMEMAAENGGCGCTQCKCGTSCGCSCCSC

SEQ ID NO: 106977 - protein, 78 aa, Triticum aestivum
  Clone ID: PAT_TA_1395.pep
MSCCGGNCGCGTACKCGNGCGGCNMYPEAEAAGATLLVSATATHKASSGGMEMAAENGGCGCTQCKCGTSCGCSCCSC

SEQ ID NO: 106978 - protein, 78 aa, Triticum aestivum; identical to SEQ ID NO: 106962
  Clone ID: PAT_TA_1396.pep

SEQ ID NO: 106979 - protein, 465 aa, Triticum aestivum
  Clone ID: PAT_TA_1397.pep
WIPRAAGIRHEPTTTTGSATPTYPNRMYSSTQSYNQYGNSVKTGLMYGNTGYGSTGYGSTGYGSSGYGSNGYGSSGYGSSGYGSSGYDSRLYGRWGVSMDTRYNRPRGRGNGYYGFGNESQDGTIELNRGPRSGRFKNQKAFGHTVTIAVKGQTLPSSENKDASDIPDKAQFNLEDFPVQYDDAKFFVIKSYSEDDIHKSIKYNVWASTTNGNKKLDAAYQEAQAKGSSCPIFLFFSVNTSGQFVGVAEMTGPVDFEKTLEYWQQDKWNGSFSVKWHIVKDVPNNILKHIVLENNEGKPVTNSRDTQDINLEQGIQMLKIFKEHVSKTSILEDFAFYENRQKLMQEKRIKQQQIQKQVWDSRAPNPVAGEKQQEVANGKPKVSVPNGVNGEKQQDAVNGKPKSPVANGVNGDAKVPAEKAAATAAPPAVTYAAKVAQTAAAEKKPVATEKKPVVANGAVKTGVAA

SEQ ID NO: 106980 - protein, 78 aa, Triticum aestivum
  Clone ID: PAT_TA_1398.pep
MSCCGGNCGCGTACKCGNGCGGCNMYPEVEAAGATLLVSATATHKASSGGMEMAAENGGCGCTQCKCGTSCGCSCCSC

SEQ ID NO: 106981 - protein, 191 aa, Triticum aestivum
  Clone ID: PAT_TA_1399.pep
ASCVLLAASSSNAFPGVAFGDTTVIDDALTETSSPTSAPVGRAQGFYMMSSQSGMVLMMCVNLLLTTGDYNGSTLAVIGRDDIMTTTRELSVVGGTGKFRMATGYVVWKTNSSSGADATIELDVYTTGLNGTATIDANAPVSPIDGGGAGAAGGPTGKSSSGAAALRGAVPYGWANAWVAPVLVALAGCVW

SEQ ID NO: 106982 - protein, 178 aa, Triticum aestivum
  Clone ID: PAT_TA_1400.pep
EPNESKDSCLVREEIIKVVNLQNNLLSLKDLLDNRKQRILSTIRNSEELRRGTIEQLEKARIRLQKVELEADEYRMNGYSEIEREKANLINATSISLEQLEKSKNETLYFEKQRAMNQVRQRVFQQAVQGALGTLNSCLNTELHFRTIRANIGILGSLEWKSPLNIYLVLYRFRYIEI

SEQ ID NO: 106983 - protein, 76 aa, Triticum aestivum
  Clone ID: PAT_TA_1401.pep
MSCCGGNCGCGSGCKCGNGCGGCKMYPEMDEGVNTTSQTLIMGVAPSKGTPSFEAAAENGGCKCGPNCSCNPCTCK

SEQ ID NO: 106984 - protein, 727 aa, Triticum aestivum
  Clone ID: PAT_TA_1402.pep
ADQATDLLQKMSLESQPQPKAAADGTELAGATKGPVASQPLSVSIPQDRSITPVVQDFTDPNMFYLPAYYYGGYDGTMSEWDEYTRYVNQDGVEVTPAVYGDIYGYGYAPYGAYSPASSPVPTVDGQMFAAQHYQYPAYYQPPTPISSTTQGDQQHSANADNKPAAKADAAKTTTNVVPNGTAQSNSGTAPLGSSYQNSSLTPDGTYRAPLIGGVPSTGYVDSTYGYDTTGAHYAWYDGSAYTNAQQRPTTANYTPSSAYNSNGSSARYQTKSPTPQQTGNRRPTTTTGSATPTYPNRMYSSTQSYNQYGNSVKTGLMYGNTGYGSTGYGSTGYGSSGYGGSGYGSNGYDSRLYGRWGVSMDSRYNRPRGRGNGYYGFGNESQDGTIELNRGPRSGRFKNQKAFGHTVTIAVKGQTLPSSENKNASDVPDKAQFNLEDFPVQYDDAKFFVIKSYSEDDIHKSIKYNVWASTTNGNKKLDAAYQEAQAKGSSCPIFLFFSVNTSGQFVGVAEMTGPVDFEKTLEYWQQDKWNGSFSVKWHIVKDVPNNILKHIVLENNEGKPVTNSRDTQDINLEQGIQMLKIFKEHVSKTSILEDFAFYENRQKLMQEKRIKQQQIQKQVWDSRAPNPVAGEKQQEVANGKPKVSVPNGVSGEKQQDAVNGKPKSPVANGVNGDAKVPAEKAAATAAPPAVTYAAKVAQTAAAEKKPAATEKKPVVANGAVKTGVAA

SEQ ID NO: 106985 - protein, 729 aa, Triticum aestivum
  Clone ID: PAT_TA_1403.pep
MAVVAPTPAPPAAPPPAAAAAAAPAPAPAPAPAADQATDLLQKMSLESQPKAAADGTELAGAPKGPVASQPLSVSIPQDRSITPVVQDFTDPNMFYLPAYYYGGYDGTMSEWDEYTRYVNQDGVEVTPAVYGDIYGYGYAPYGAYSPASSPVPTVDGQMFAAQHYQYPAYYQPPTPIPSTTQGDQQPSANADNKPAAKADAAKTTTNGVPNVSAQSNSATAPLGSSYQNSSLTPDGTYRAPLLGGVPSTGYVDSTYGYDTTGAHYAWYDGSAYTNAQQRPTTANYTPSSAYNSNGSSARYQTKSPTPQQTGNRRPTTTTGSATPTYPNRMYSSTQSYNQYGNSVKTGLINGYGSSGYGSSGYGSSGYDSRLYGRWGVSMDTRYNRPRGRGNGYYGFGNESQDGTIELNRGPRSGRFKNQKAFGHTVTIAVKGQTLPSSENKDASDIPDKAQFNLEDFPVQYDDAKFFVIKSYSEDDIHKSIKYNVWASTTNGNKKLDAAYQEAQAKGSSCPIFLFFSVNTSGQFVGVAEMTGPVDFEKTLEFWQQDKWNGSFSVKWHIVKDVPNNILKHIVLENNEGKPVTNSRDTQDINLEQGIQMLKIFKEHVSKTSILEDFAFYENRQKLMQEKRIKQQQIQKQVWDSRAPNPVSLPNGVNGEKQQDAVNGKPKSPVANGVNGDAKVPAEKAAAAAPPAVTYAAKVAQTAAAEKKPVATEKKPVVANGAVKTGVAA

SEQ ID NO: 106986 - protein, 81 aa, Triticum aestivum
  unsure (1)..(81): unsure at all Xaa locations
  Clone ID: PAT_TA_1404.pep
MSCCGGNCGCGSGCKCGNGCGGCKMYPEMDEGVNTASQTLIMGVAPSKGTPSFEAAAXERGPKNGGCKCGPNCTCNPCTCK

SEQ ID NO: 106987 - protein, 149 aa, Triticum aestivum
  unsure (1)..(149): unsure at all Xaa locations
  Clone ID: PAT_TA_1405.pep
TMFLFIFVSNWSGALLPWKIIELPHGELAAPTNDINTTVALALLTSAAYFYVGLXKKGLSYFEKYIKPTPILLPINILEDFTKPLSLSFRLFGNILADELVVVVLVSLVPLVIPIPVMFLGLFTSGIQALIFATLAAAYIGESXMEGHH

SEQ ID NO: 106988 - protein, 80 aa, Triticum aestivum; identical to SEQ ID NO: 106963
  Clone ID: PAT_TA_1406.pep

SEQ ID NO: 106989 - protein, 208 aa, Triticum aestivum
  unsure (1)..(208): unsure at all Xaa locations
  Clone ID: PAT_TA_1407.pep
MWWPSSLLYPPPPSAFVTAMSVVSFASLASAGLSELRGQHMAYSKFWHVVSGQQHNXGLRAELLAVHFLKRVLEVLFIHRYSGNMPLNTALAISSSYLLSAITMIYAQHLAVGLPDPTTDLLSQLRKGGDDDTGYKIPKGGLFEFVTCPHYLFEITGFFGFAMISQTVYALAMAFGTAAYLVGRSFATRRWYESKFEEFPTSIKALVP

SEQ ID NO: 106990 - protein, 273 aa, Triticum aestivum
  unsure (1)..(273): unsure at all Xaa locations
  Clone ID: PAT_TA_1408.pep
MWWPSSLLYPPPASAFVTAMSVVSFASLASAGLSELRGQHMAYSKFWHVVSGQQQKKGGTGGAQLPGRDGMLVAYAPALVAAAASFVVXVPAAGLRAELLAAALAVHFLKRVLEVLFIHRYSGNMPLNTVLTISSSYLLSAITMTYAQHLAVELPDPSTNLLYPGVLLFAVGIAGNFYHHYLLSATHGREXDVDRGYKIPKGGLLEFVTCPHYPSEITGSFGCAMISQTVYALAMASGTAAYLVGRSSPTRGWYESKFEEFPASIKALVPYIL

SEQ ID NO: 106991 - protein, 400 aa, Triticum aestivum
  Clone ID: PAT_TA_1409.pep
MASGNVSTVYISVIDDVVAKVREDFITYGVGDAVLNELQALWEMKMLHCGAISGNIDRNRAPPASAGGAPGAGATPPVHDLNVPYEATSEEYATPTADMLFPPTPLQTPIQTPLPGIDTGMYNIPTGPSDYAPSPISDMRNGMGMNGSDPKTGRPSPSVPTPSPWMNQGPLGVDVSVAYGERREDPDRMMQPQPLTKDFLMMSSGKRKRDEYPDQLPSGSFVPQQDGCADQVAEFVGSKDNAQQVWNSIMNKQESVTKTLSIEESTIPPVLPQQDGIQDDYNDQFFFPGVPTEDYNTPGESSEYRTPTPAVATPKPRNDTAGGDDDDDDEPPLNEDDDDDDEIDDLQDGDEEPNTQHLVLAQFDKVTRTKNRWKCTLKDGIMHLNGRDVLFNKASGEFDF

SEQ ID NO: 106992 - protein, 248 aa, Triticum aestivum
  Clone ID: PAT_TA_1410.pep
MRHILLVLAAAAAVVVAGAEPVLRQVTDFPTAVSSGVSDADALFCDSWRLSVETANAGPWRTVPARCGASVRAYMEGERNASDSAVAAAESLAFAAQAFASGVGGAMPAWVFDVDETLLSNAPYYAVSGWGLQEFNETSFDAWVDIAKAPALPSSLKLYNELQGLGFHIILLTGRSELQRNATEENLLFAGYHSWEKLILRQISDIGTAAGKLKSERRAAMEAEGFKILGNSGDQWSDLIGLPMATSL

SEQ ID NO: 106993 - protein, 117 aa, Triticum aestivum
  unsure (1)..(117): unsure at all Xaa locations
  Clone ID: PAT_TA_1411.pep
MASVDAAGDPLRSFASATSLLFRTLGPAAASASPSRAPGALLGGSLKRSKELMEQASLVLKERGDIQKLYQEDRVDGKNNQQGRRPGLDRKRAQFSLKPTQSNPVNVDFSQALXIDD

SEQ ID NO: 106994 - protein, 116 aa, Triticum aestivum
  Clone ID: PAT_TA_1412.pep
SSKQKAKKRGRKPKNLPAHPSSATEAPTQSDRRCSHCGVQKTPQWRAGPEGAKTLCNACGVRYKSGRLLPEYRPACSPTYVSSVHSNSHRKVLEMRRKKEDGPLTVTATAPAVASF

SEQ ID NO: 106995 - protein, 306 aa, Triticum aestivum
  Clone ID: PAT_TA_1413.pep
MAPFATPMRSASLQLSALLCILLCSEVWVLQCGAAIGINYGQVGNNLPTPAQVVSLLSSLRVGKVRIYDVNPQVLAAFAGTGIELIVTVPNDLVQPMAASAGQAMQWATANIKPYFPATRVTGIAVGNEVFTDDDEALKASLVPAMRNLHAALAQLGMDGYVHVSTASSLGVLANSYPPSQGAFTPECAPLMLPFLRFLAETNAPFWINAYPYFAYKADPANVSLSYALSDPYHVGAVDPYTHLQYTSMLYAQVDAVTFAAARLGYGGIPVFVSETGWPSKGDADEVGATVENARAYNRKPPLALG

SEQ ID NO: 106996 - protein, 152 aa, Triticum aestivum
  Clone ID: PAT_TA_1414.pep
MAKPRLLLCLLVAAAALLLVASAKKSGDVSALQIGVKYKPESCSISAHKGDRVKVHYRGTLTDGTVFDSSFERGDPIEFELGTGQVIKGWDQGILGMCIGEKRKLKIPSKLGYGDQGSPPTIPGGATLIFDTELVAVNGEPSSKSEEDDADL

SEQ ID NO: 106997 - protein, 158 aa, Triticum aestivum
  Clone ID: PAT_TA_1415.pep
MSGFVGVVVSDPSLQGQFTQVELRSLKAKFVSLKRDSGHVTTKNLPGLMKKLRGLHEVVPEEEIAAFLSESYPDSDQEIEFESFLREYLNLQARVSAKEGSATAGGGGAGGRKNSSSFLKSTITTLLHNLNQAEKSSYVAHINTYLGEDPFLKKYLAI

SEQ ID NO: 106998 - protein, 144 aa, Triticum aestivum
  Clone ID: PAT_TA_1416.pep
TKYATKLVLWENTNYLQVHSDIASTHMFGAQESRITVMSSSSMQQCENSSFVHVVTQLGSIFMCNLMRTMSFLCSDQPSATTPVYFPAAPNPHRQLGDRVPLHISLIQPTVPTQRHAEIHFGVMHRQRDHRIPLCTLCRVICQC

SEQ ID NO: 106999 - protein, 161 aa, Triticum aestivum
  Clone ID: PAT_TA_1417.pep
GPVQLMQLFNKLASRSAKYKSGLVQFLLKQAGVDKRTGDLYGNRDLLNIARNMARGLKGVENVYTQHQPLIFQTMEGIVKGRLRDADYPLVGNHFQQGRPQDVVIFIVGGTTYEEARSVALYNAANPGVRFFLGGSVVLNSKRFLENLGEAQRISKSSTLL

SEQ ID NO: 107000 - protein, 168 aa, Triticum aestivum
  Clone ID: PAT_TA_1418.pep
MAARAVTMLAVVAAVLAGGASAQSTSGCTQTLIGMSPCLNYITGNETAPSKSCCSQLATVVSSKPECLCVALNADPAALGLGTVNKTRALGLPDQCGVKTPPLSNCASAPTTSPSSGSPAGQTPTSSGAGSKSTPTADVGSGAASLQSSAAGIVAGFIVAAVYAVSAM

SEQ ID NO: 107001 - protein, 172 aa, Triticum aestivum
  Clone ID: PAT_TA_1419.pep
MAARAVTMLAAAALVVVAAVLAGGASAQSTSGCTQTLIGMSPCLNYITGNETAPSKSCCSQLATVVSSKPECLCVALNADPAALGLGTVNKTRALGLPDQCGVKTPPLSNCASAPTTSPSSGAPAGQTPTSSGAGSKSTPTADVGSGGASLQSSAGIIAGFIVAAVYAVSAM

SEQ ID NO: 107002 - protein, 583 aa, Triticum aestivum
  unsure (1)..(583): unsure at all Xaa locations
  Clone ID: PAT_TA_1420.pep
RTRGRTRLIRCWDSTIFHEKYRITAGLGGAGSGSEFCIWSLLFLRCGTLVSGDSSGSVQFWDNRHGTLLQAHTYHKGDVNALATVPSQNRVFSAGSDGQVILYKASKNEFSAHNEKVAEEQMHKWVYVGYVRAHSHDVRALTMAVPICKEDPAPVGGVGSARVQFWVSRRGSPLLALPFLIAGGDAPAPVPCPARVFSPGSPRHVCPAPPPPLVFRARDGTVAGDPVLLGLSVGCVGARPLAVRALTMAVPICKEDAVPEEKVVKVRRKDEFSYRKWAHLGVPMLISGGDDTKLFAYSARAFAEYASLNFSPACQREYXCSHKMMFTDDSSSLVLSXVDGKIYVVDIASRKISNIFRPTSKADGTKTSKEPPVTKMFVSADGQWVAAANCFGDVYIFNLEVQRQHWFIPRMNGGSVTSGGFCPKNNALVITTSKNEVYVFDVEAKELGEWSKRHTHELPTRFQDFPGEVIGLSFHKMSPFSVMIYSARAMCVIDFGLPVVQDVQLSTSEKTDSQKAAKTKVKRKHRDEDLKQEKRSNFTFFAFKDPVLFAGHLLDSSILVVEKQWMDVVQGFGPPVHRHIYGT

SEQ ID NO: 107003 - protein, 178 aa, Triticum aestivum
  Clone ID: PAT_TA_1421.pep
MVLPATLSRDARAHSCPAQDGQGEAGPPRPCRPPAFYSSVFAQIEEVGWGQLVSATGDDGVSCITFRVVDEQRRQHLLEITLPMNYPACPPSIAADVPYLPKLQWSKSSRLKDVLCQFQAHLKVLQDYWSTMDGIDKALWVVDPTKPTYAMSHHRIALGDDCYILLHVDTHKPNSLPE

SEQ ID NO: 107004 - protein, 104 aa, Triticum aestivum
  Clone ID: PAT_TA_1422.pep
TRILLHLATRSAGYWCGWYPDISVRLLGPDLCTSAVTTHFRFVKSAIFSDAADFCQLPLVVLFEKPHQNRSPHVFLLLMKDERTRFSFRNTNTNTQLLQVVIRP

SEQ ID NO: 107005 - protein, 97 aa, Triticum aestivum
  unsure (1)..(97): unsure at all Xaa locations
  Clone ID: PAT_TA_1423.pep
QKRGAGEGLLRDAEEGEAQRVVGGREFGPAVVGRGGGGGAAAGGCGGSXAGGTGRGRGGAGGRGGGGGGGGMVSAAARAGAGRGAARMPPLSHHRCL

SEQ ID NO: 107006 - protein, 334 aa, Triticum aestivum
  Clone ID: PAT_TA_1424.pep
EPQQLDRPHTQITIRERRNETTGGPEAEPSTGPREPCRRRPPLLRPTRRPRGRRRRPRPSSSTATSARPPSPSLRRPPRPRGYLLCPRCRSDFLEENPNPSTSSPPPPPPPPPGFLSDSSEEPDDIDLGIDHTAAQAYLTRLVRRLYDDPTSVATAAAAAVSVLQQQGHIGGQGQPPAPAASIAAVPTVEVSEPASVCAICKDDLPLAVAARRLPCGHLYHSVCIVQWLEMHNSCPVCRSCLPPTILEEVEPQELDRPPTQITIRFTTNRRRIRTNSDAVAPAATSPTQLAEAMTGEGGAGPANSAETVSSEWPPPPESDAVVSETREIEGFFD

SEQ ID NO: 107007 - protein, 546 aa, Triticum aestivum
  unsure (1)..(546): unsure at all Xaa locations
  Clone ID: PAT_TA_1425.pep
RTRGAAAMATATRAKDLARRSPKKYVEEALYRRLFRRGSTPQAVREEVDGFLGSRKRAFKWEVGVCVRRLRRQELYRPALKLTEVMTRRGMNPTVGDQAIRLDLVAKSRGIAAAEKYFMDLPETSKTHLTYGALLNCYCKEVXMTEKAXGPLMEKMKELNFAFTAMSYNSLMTLYTKVNQPEMVPSIIQDMKADDVLPDVYTYNVWMRSLAARQDILGVERVIEEMTRDGRVAPDWTTYSNLASIYVDAGLPEKAEAALKELEKRNTSNDLEAYQFLITLYGRTQNLVEVHRVWRSLKRNNPRKANMSYLNMIQVLANLKDLPAAEACFKEWEARFIRPPKTKATDAVTTETSKLEEEASTEASNNDSDVKEAEDKETEELDLKRPKYDIRVANALMKAYVTEGMLDKAIALKKRAKMRGGRLNAKTWEIFMEHYLKVGDLKNAHWCADRAIKKGHSSGRIWVPPHDVTETLMGYFEKKKDVDGAESFVEVLKKVQKDLGTVVFEPLVRTYAAAGKKFPGMRHRLKIENVELSEETDKLVDSICVD

SEQ ID NO: 107008 - protein, 128 aa, Triticum aestivum
  Clone ID: PAT_TA_1426.pep
SEFFDYFKVLCIQRFLTCRKHAERVILLVEMLQDSGFPCFKGGTRTILNLRKRFHLSLTEEQCVSLVLSLISSSMDAWRSPRWEGFLRGLLGPRCPAPGALTPWRVLGPFWAWPRPPLGHFRISLGLI

SEQ ID NO: 107009 - protein, 260 aa, Triticum aestivum
  unsure (1)..(260): unsure at all Xaa locations
  Clone ID: PAT_TA_1427.pep
MESGEPLPRRDGRRGGWRAALFIVAVGFLERIGFTGVGGNLITYLTGPLGMSTAAAAAGVNAWSGTVLVLPLVGALAADSRLGRYRAVLIAGVLYLLSLGMLTVSSMLQTPQPHPAGCHSTGSTCSPLPSASSPARLAFFYTAIYLLALAQGFHMPCSEALGADQFDPSVGASRSSYFNWFHFSISWGYAIAAIVVTYIEENVGWTEGFAVCXATMVVYLVVFLLGTRTYRVEQPVDSSSLAHLTRSSHLGTHMPPLTHT

SEQ ID NO: 107010 - protein, 379 aa, Triticum aestivum
  unsure (1)..(379): unsure at all Xaa locations
  Clone ID: PAT_TA_1428.pep
MAASTAARRFLLLLAAVTVVSVAAAAPAPAPPPPFRTVYAFGDSFTDTGNTHSTTGPYSYGYVSNPPYGATFFHRSTNRYSDGRLVVDFLATDALALPLLPPALTVSPCARAQXTIRQEAGARDYYGANFAVAGATTIXHGCLAWTDLRGDITPLKASTEMGGFDAHVKARQVKAGAHRAASPLPASXSAPTRTPTAARAPTPLRRLPSRGAAVVGVPGLPLTGCLPLAMTLARPEDRDNLSCVASVNKQSMDHNRHLQAGIHRLRQAHPGAVLAYADYYAAHLAVMRSPARYGFAEPFKTCCGSGGGAYNFEIFSTCGSPEVPAACAHPARYVNWDGVHMTEAMYKVVAGMFFRDASGTFIRPSFGSLLAAARKGHGN

SEQ ID NO: 107011 - protein, 253 aa, Triticum aestivum
  unsure (1)..(253): unsure at all Xaa locations
  Clone ID: PAT_TA_1429.pep
AKGRCLRPPTADAPSGRASPPQLPHFIGLRSILPLSPPRLTPCVLIGSPSFQLVMASAVSMTSVSAQAASVSRPRSHGITSYGGLKASSSSVNFELGSSFLGKTASLRASVTTRVVPKAKSVAQILPEASYKVAVLGAAGGIGQPLGLLIKMSPLVSELRLYDIANVKGVAADLSHCNTPSQVMDFTGPAELANCFWTAGMXVVIPAVIPAGVPRKPGVTRDDIFNINAGIVKSLRGPVPGCRPPAFLHIISN

SEQ ID NO: 107012 - protein, 261 aa, Triticum aestivum
  Clone ID: PAT_TA_1430.pep
MARLATILSFGDHAEEGAGAFTEPQEDYQQEHDDDDDAASDASGDSFEFAFARPLAPAGGEALADDLFAHGRILPAYPVFHRRQAHDDDASASATSATAPPSPDTYCAWAPRSAPGSPAREPAAFPKSASTGTGEAARRFRLRDILGSGGRSHSDGKEKFLFLQPTPAKPKSRTSALSTPSAPAAKKTQAQQKQSKKKGAAAAPTEMDMATAHRLFYSKPGAAAGPGGERTTTKTSYLPYRPAIVGFFATAHALRPKHHPY

SEQ ID NO: 107013 - protein, 189 aa, Triticum aestivum
  Clone ID: PAT_TA_1431.pep
AFLPPPRLLRVWCAAGAPVACRRAHQRAAAVLLSCLFAVLPCSSLTSLCLTSTGTSGRRRRAERSRPNWIHALHHRPLSYRLSSPRIGHADSRRCQILAWPPAERSSTLCLATSRLSPSRAVGTMESCMCRLLCGACRATGLRNGCRPGARPASSSMHAWLAAETSEELQQRNESAEPNLLNQAAKFEY

SEQ ID NO: 107014 - protein, 163 aa, Triticum aestivum
  unsure (1)..(163): unsure at all Xaa locations
  Clone ID: PAT_TA_1432.pep
METKAKDAWGLALVLFLGQLVAFSMAAASFASSFLANLGVNTPLTQSFFAYLLLTLIYVPILLHRRQKPRIPWYWYLALAFVDVQGNYLVVKAYQYSSITXVTLLDCWTVVWVIILTWYALGTRYSFWQFVGAGICMAGLTRVVLFFVGTFDEPGTCVAGLRA

SEQ ID NO: 107015 - protein, 240 aa, Triticum aestivum
  Clone ID: PAT_TA_1433.pep
MACRPAVSNPSALTPAPRRCVVPGRSSTRGRVDCSLRSSSAGAVRLGARRAPAAAFVVRAAAAEGDLDLQAKVTSKCFFDVEIGGERAGKVVIGLFGEVVPRTVDNFRALCTGDKGYGYKGCSFHRIIKDFMIQGGDFQNNNGTGGRSMYGECFDDENFTLKHVGPGVLSMANAGPDTNGSQFFICTVKTPWLDDRHVVFGHVLEGMDVVRELESQETSRSDIPKQPCRIVDCGELPLDG

SEQ ID NO: 107016 - protein, 471 aa, Triticum aestivum
  unsure (1)..(471): unsure at all Xaa locations
  Clone ID: PAT_TA_1434.pep
KPPPSPILLRCHRRRLRRSRRPRRHRPPPPPPPIPTPSASSPPRPTPRXSTPSHPNPNPNGAPNPPPLLPSPHVAHLQPLPPPRPLLTVAAVEAAMASIPPPPQYGLECLDRRTVALSDGTVRTYFALPLEPTPQLRQPPIFPAPARGRPGPGSGLNRWIPPLMHAVPPPWPPQKRKREGQSNGGPPVESSGRQHQQHQKPEERRTAKQVKVETSELDAKTLESSFLKMVRVINENTEVKKNYRANGQISQLRCVVCNRDSMDLHALLNHSYNTRNPELRADHLGLHKAICVLMGWNYSIDPVNRKAYQTLSTADAEANRGDHILWPPTIIVENTYKSNNDGQKDVMTNKEMDGKLREMGFAGVSVKPLVGKDGAMLVTFASNLAGLKEAVRLAELLEAEGHGRAQWVHARGLTPSFVGGSNPMFVKVDEKGEPTWVLYGYLATAWDLDTLDAELRQNVVIKSMKELDLSE

SEQ ID NO: 107017 - protein, 487 aa, Triticum aestivum
  unsure (1)..(487): unsure at all Xaa locations
  Clone ID: PAT_TA_1435.pep
RTAPPPVHTPLTCPWPPPPLLPLSALLLLLAAASHASAKPVQTQALLATPLSPDRVSAPSELAREDDTNPLAAADDARRLDSSFPRCPPGATSQRNATARRARSRTGWERDREDGRRGSRRPAGRGQRHASRLCRGAGGGRCPSAGVFATGALTVAGGARVARLALGXGRGDEGLIVVAAALPGLARGSLDFPTQISRRXGRSFSYCLVDRTSSANSASRSSTVTFGSGALGSTGASSFTPMVKNPRMETFYXVQLIGISVGGARVPGXANSDLRLDPSSGRGGVIVDSGTSVTRLARPAYSALRDAFRGARRWAPALSRRLLPCSDTVLRPERAPAAVTFGSGALGSTAGSSEAALPPDNYLIPVDSKRTFCCALGRLGASGTISARRPRQGRPAARARARPPAAPAPAACCGRVSGGASSAAASAAPSGPRAARGDVAGLAVGGTAGSGVSPARGAPLVKVMGESFGCCESPGGAQSCRAGQGRV

SEQ ID NO: 107018 - protein, 251 aa, Triticum aestivum
  unsure (1)..(251): unsure at all Xaa locations
  Clone ID: PAT_TA_1436.pep
MVSRARLLRAVALTARLYGETAHAGSGGERCSLEFFHGDSARSPFHDPTPSPPARGLEAGPRSAARAAALSRSYVRADAPSADGFVSEVTSRTSEYLEAVNIGTPPNRMVAIADTGSDLTWLNCRYGGDGPGSXAAARDADAQPPGVQFDPSKSTTFGLVDCNSGTCSELPEDSHSCDANSKCTYIYSYGDGSQTSGLLSTETFTFTDAPGAHGDGTTRVAKVNLGCSRPSSXRXVGDGIVGLRRRRLSPR

SEQ ID NO: 107019 - protein, 113 aa, Triticum aestivum
  Clone ID: PAT_TA_1437.pep
LETLQGPLRRRAAAPKGWGRSLPRPAVSPPAPAPAAVGRAQAGSAHGHPLRSLKTTCHSPRPGPWSMRASSSPSTAARIAPSAAPPGCRTGGPTPPVPSRRPGSVPSSISVCP

SEQ ID NO: 107020 - protein, 441 aa, Triticum aestivum
  Clone ID: PAT_TA_1438.pep
MAENTPEPAAALLSSLTVAEDTTATPAATALLSAPATAVVGTPSPPPLQLFNSMTKKKEPFVPRVEGKVGMYVCGVTPYDFSHVGHARAYVAFDVLYRYLKFLGYEVEYVRNFTDIDDKIIKRANQNGETVTSLSSRFIAEFLADVAELQCLPPTHEPRVTEHIDNIIDLIKEIIKNDKAYVVDGDVYFSVDNFPEYLSLSGRILDHNRAGSRVAVDTRKRNPADFALWKAAKEGEPSWESPWGDGRPGWHIECSAMSAHYLGHVFDIHGGGKDLIFPHHENELAQSRAAYPESEVKCWMHNGFINIDDQKMSKSVNNFFTIRDIITLYHPLALRFFLMRTHYKSDANHSDKALEIASDRVYYIYQTLYDCDEVVSLHREENTSVPVPAPRLGLVVVLGKAFLESMSDDLRTTDVLDGFMELLKAINGNLNDLKKLQQKLE

SEQ ID NO: 107021 - protein, 94 aa, Triticum aestivum
  Clone ID: PAT_TA_1439.pep
FKDFWVLMAVFRKNSVVAVCVGALMLMTTLLSSEGSEFVGCMEPHQNCFPDDCQKTCADNITGKNVKGSCEPEHGPLKPYPALVCCCYRDGLRS

SEQ ID NO: 107022 - protein, 223 aa, Triticum aestivum
  Clone ID: PAT_TA_1440.pep
MSANSTINVKNIAPATSDSEIKDFFSFCGKIQDLKVSQDGETKSAEVIFEKETAKKTALLLNNTQLGTNHLEVTSATADGEDDVPTTKNTDRDSDEITQEEKPRARILAEYLAHGYVVGDAAIQRALDLDATHGVTNRFFSTLKGLDEKYHATDRAKATDESYGISQRANSMWLGLSSYFEKASNTPTGKKIAEFYTEGSRQVQEVHAEARRLADLNTEEHVG

SEQ ID NO: 107023 - protein, 127 aa, Triticum aestivum
  Clone ID: PAT_TA_1441.pep
VYPASIHPPSVLENGKAFKAVAAVQGDVVETLDLKGLATYKYFEVILVDVAHSAVRNDPRINWLCKPVHKHRELRGLTSAGKKFRGLRGKGHRHHKNRPSRRATWKRNQTVSLRRPFFFFLHTAYDY

SEQ ID NO: 107024 - protein, 204 aa, Triticum aestivum
  Clone ID: PAT_TA_1442.pep
MGAYKFVSELWRRKQSDVMRFVQRVRCWEYRQQPAIVRITRPTRPDRARRLGFKAKQGYVVYRIRVRRGGRKRPVPKGIVYGKPKHQGITQLKFQRNKRSVAEERAGRRLGGLRVLNSYWVNEDSTYKYFEVILVDVAHSAVRNDPRINWLCKPVHKHRELRGLTSAGKKFRGLRGKGHRHHKNRPSRRATWKRNQTVSLRRYR

SEQ ID NO: 107025 - protein, 192 aa, Triticum aestivum
  unsure (1)..(192): unsure at all Xaa locations
  Clone ID: PAT_TA_1443.pep
MGAYKFVSELWRRKQSDVMRFVQRVRCWEYRQQPAIVRITRPTRPDRARRLGFKAKQGYVVYRIRVRRGGRKRPVPKGIVYGKPKHQGITQLKFREEQRRSVADGRSWAQGLVGPSCPQRSHWVNEDSTGYKYFDXSSMLDVAHSAVRHEXKGINWPGNPGHIAPVELRGLDLVAGRRYSGGLGGRRLVGQT

SEQ ID NO: 107026 - protein, 204 aa, Triticum aestivum; identical to SEQ ID NO: 107024
  Clone ID: PAT_TA_1444.pep

SEQ ID NO: 107027 - protein, 223 aa, Triticum aestivum
  Clone ID: PAT_TA_1445.pep
MAPAKWLMHWHPNPGVTLNTQILSEACGCAESLGGTKDGRWKTSIIFYRPMTRDGAGGAQQNLPPDVPRELLGVALHERPGLYFSILRNQRLVLQADAAFSQVMEKLQSFKARVNLNFEGFQYQLGDFCLRIGKCVPNNTETLRGIMMEVEYYPLSSIEKSRAIMVDFFDIWQETLAKKSLPGRFIHVESNFAEYGLSDHYSFQHTAVQYATCLQQLMAAVRA

SEQ ID NO: 107028 - protein, 153 aa, Triticum aestivum
  unsure (1)..(153): unsure at all Xaa locations
  Clone ID: PAT_TA_1446.pep
MARAAAPLLPFFFLLLSSTSPAAAQKNRLGRTPQMGWNSWNHFGCKIDEVIIRKIADAMVDTGLAKLGYEYVNLDDCWASHDRDSQGNLAANGTTFPSGMRALADYVHGKGLKLGXYGDARLRTCRXLQPGSLGYEDQDARTLAAWGNDYFKL

SEQ ID NO: 107029 - protein, 59 aa, Triticum aestivum
  Clone ID: PAT_TA_1447.pep
LSEWKRLDTNIHLWNYITPIMAMLASGLHETTRRLWLRARGRRTPRPRRGRRCRRPRVR

SEQ ID NO: 107030 - protein, 116 aa, Triticum aestivum
  Clone ID: PAT_TA_1448.pep
QAAGPRSAPAEDEEREGEVQLLQGRQGGDPCRRRPRGWRVPTRRGGRGDRVRGAGAGAGRRADVDGGHRAEPGAEQQPAGVDPPGRLRPHLVALHRLHLRPRRGRGVRRPLALSYT

SEQ ID NO: 107031 - protein, 152 aa, Triticum aestivum
  unsure (1)..(152): unsure at all Xaa locations
  Clone ID: PAT_TA_1449.pep
MLQHQQAGGKQRKHSNQMATISAAAATTVVARAAIARPQALGLPQLXDEEREGEVQLLQGRQGGDPCRRRPRGWRVPTRRGGRGDRVRGAGAGAGRRADVDGGHRAEPGAEQQPAGVDPPGRLRPHLVALHRLHLRPRRGRGVRRPLALSYT

SEQ ID NO: 107032 - protein, 63 aa, Triticum aestivum
  Clone ID: PAT_TA_1450.pep
MGLWDAMYRVVMRRNGVYVTFVVAGAFAGERLVDYGVNKVWEMNNVGKRYQDISVLGQRPVEE

SEQ ID NO: 107033 - protein, 172 aa, Triticum aestivum
  Clone ID: PAT_TA_1451.pep
HPAREFYNIIVPKENAKTWSFIRCLISLKRSWEIWASMSSLLNRPLPQNRYVLIPFPDVVHLPDLVDAVVHQPLASEGAGDDEGDVHAVTAHHHAVHGVPETHRRRRRRRRARGMVEIRYATTDEPVASLTGAEAAARGGDRGDSARADGEAAARGGDGGDSVRDDGRTRWA

SEQ ID NO: 107034 - protein, 149 aa, Triticum aestivum
  unsure (1)..(149): unsure at all Xaa locations
  Clone ID: PAT_TA_1452.pep
NNETGRSSRRVDNRWRRRFVPRRERCAAASFSEHRIRICRRAPQRPSRRDSGGSAMPGAPFADFAPQDHLILLITPSMECNQPRNQLRSSVMRNTHHGGQIITLSFYATYFCIQSRFYRNRCNALAVARIMGGLFQGTFGWGPSHTTGX

SEQ ID NO: 107035 - protein, 207 aa, Triticum aestivum
  Clone ID: PAT_TA_1453.pep
SILSFPSIHLILKSHLRQQHRRGPPPLRAPRTRSFSAASHPFYAAVGFLRRTHPLLSLQVMPNPLFHSSVSAVEGVGCPKRLETGGCACTRWAASSPDFCWMPAVLGDDGGEPEPRTQGCCNHGDHTLEPAVVKAASIVTTPCDPSAVVLQSLWPRVGDIAGARRATALAPAPTAGQILVLRFGSGKPGTALVSLPLLFSSLLLFFL

SEQ ID NO: 107036 - protein, 110 aa, Triticum aestivum
  Clone ID: PAT_TA_1454.pep
SSHSSGRLQRRKRCCLRSSYSPVAPSDASQLPVRPSGVSDLSCTLVVAPHCNKSIVLIRTARIDQRSSGPSHCWPTGMMADFSQAIKRISTRHKGMRLLRAPEEEAIVER

SEQ ID NO: 107037 - protein, 244 aa, Triticum aestivum
  unsure (1)..(244): unsure at all Xaa locations
  Clone ID: PAT_TA_1455.pep
MNGGSKQTLIYSFVAKGSVVLAEHTAFSGNFSTIAVQCLQEXWPPNSTRSTYSCDGHTFNFLVDGGFVFLAGWPKRALGRSVPFVFLERVREDFMQRYGSSIDEEGQHPLADDADEDDFLFEDRFSIAYNLDREFGPRLKDHMQYCINHPEEISKLSKVKSHLSEVKGIMMDNIEKILDRGEKIELLVGKTETLQSQADSFHRHGRELRRKMWLQNLRFKLMVGGGIAFLILILWLMVCRGFKC

SEQ ID NO: 107038 - protein, 136 aa, Triticum aestivum
  unsure (1)..(136): unsure at all Xaa locations
  Clone ID: PAT_TA_1456.pep
LKSKYTHVHIHMVVPYTKSEVQWSLLAPRAALEEAGLKGGSDVGPVTVATPSDWAKPPWPASSNVEERPIMSWSFRVLWTGAPLPAAEEIISSESSAAKSKAALLFFIAASASVARDQCVRVYVWITRWVXNRXGA

SEQ ID NO: 107039 - protein, 233 aa, Triticum aestivum
  Clone ID: PAT_TA_1457.pep
NRNQWRKKRNHVSTHPRPICALHHDPHTHPPPSLQCCRPPDPLPHPRVLPATGAAAHTHAHKPRRSLAMSAAPPPQGSGDLRPYAPHCRPKAPTTFCPVRRAAAVPPVHASMLPTRPPPSPRQDPVHRAVISGVSPPTHVPTRRPRTPISCAPLPTAGISHLQPLLHHNPTSCSTATAVVLHLSSISSTHAPNIPLSLFVPVRQQQASVVSCCLFYDLLTILYDPKDLMYQQS

SEQ ID NO: 107040 - protein, 129 aa, Triticum aestivum
  Clone ID: PAT_TA_1458.pep
FKSRTHAASPLAIIPRLDASRRCTPATTETARLRRRVSWSPAPSTSHATRRQRGRPAARSPRTRSRPRGAPGGSTRRRRRAGRPPPWWRPTCPTSAHGAGAHRFPAGRHLFFLPRRAHAVGHSLTAAAH

SEQ ID NO: 107041 - protein, 393 aa, Triticum aestivum
  unsure (1)..(393): unsure at all Xaa locations
  Clone ID: PAT_TA_1459.pep
GTITFFGSRWTRPQSSTLTKNIQDRLNLFAGNLKKAAASDALIERDVKESYPLMSILDRRPIESALPSISRPIMSLDGNEDAIVGALKQSLRQLESLGAQRAGLEDHLKEMKRKDDILPKLMAGVGAHDDLFRKEIAKYDPICAEIADNIVAQEQLLLQIQEQNAQFAAVFNLDDYKVARERCYKQIAAAVAKYQAIKKNMNDGLNFYVSLQDATGKIQQQCSDFIMTRNIQCREMIEDVQRKLAGFNLSSSSHNTNTPRSSSVPTXQHSPPPPPPPPAPSPLRAPPGGDPGPVYSQPESRPPYSQPYPTYGAPPQQXPPYGAAHLVSYQQHPQQHQPPPGHDYGQPAYPGWRRPYYNGQQPQPQQPGPFPQAPYSAPGAYPPHHQSNYYRPQ

SEQ ID NO: 107042 - protein, 501 aa, Triticum aestivum
  unsure (1)..(501): unsure at all Xaa locations
  Clone ID: PAT_TA_1460.pep
NIPIFKIAKIPRGSLLLIHTNSNTSQIXPYIVCAVLRGVTFDEVRYNSFIDLQDKLHQNICRKRTLVAIGAHDLDTLQGPFSYEALPPQEINFIPLKQEQSFRADALMEFYRSDMKLKKFLHIIENSPVYPVIYDSNRTVLSLPPIINGAHSAITLKTRNVFIECTATDLTKANIVLNTMGAMFSEYCENKLVVEPVEVVSYDGSTAIYPDLSCYKMEVPLSDIVGPIGISLYETQVISLLNKMQLQAELCSSNGEPCISVSVPPTRSDVLHARDLAEDVAIAYGYNNVPKSKPKSMTIGGRQPLNRFSDKIRAEVARAGYMEVLTFVLTSHEENFDMLNRTDDGNKAVIIANPRTSEFEVVRSSLMSCLLKTLKHNIDHPRPIKIFEVGDVVSLDTSRDVGASNNRRLAALYCNSNSGFEEIMGLVDRIVKIVRAPHINFGQTYYVPSSEPEFFTKRQCKIVMSDGKQVGYLGIVHAEVLRKFGIPDPCTFVEIDIEALL

SEQ ID NO: 107043 - protein, 158 aa, Triticum aestivum
  Clone ID: PAT_TA_1461.pep
SLHMHNKAHLLITNKYEVFDFSILNWLTTSTQYMVLALQHCVPPCLPKKKYNMVHQFSQKNKISPDHVTCGLTNSYPISKPGSVIGHRFVVSVQSESSSLLFQKLVQSEYPSSSASNYFFAFFALFVVWVFLVPFLATFAFFCPFAAGFTVAFLWFSP

SEQ ID NO: 107044 - protein, 106 aa, Triticum aestivum
  unsure (1)..(106): unsure at all Xaa locations
  Clone ID: PAT_TA_1462.pep
TEAKIEAIVNDFIQLEPHSNLFESETMMEGTLDGXFTFDSDGEGDRLHELNASQNDPNNESEDQPKGKTKRKAAVKPAAKGQKKAKVAKKGTRKTQTTKRAKKAKK

SEQ ID NO: 107045 - protein, 248 aa, Triticum aestivum
  unsure (1)..(248): unsure at all Xaa locations
  Clone ID: PAT_TA_1463.pep
MAAPPSHSFVYIDAEALHAVLPFPSLISHLRAGLPAFSEDIHCPHRVSFPVPTSPSAALLLMPSWCAHPSLPYLALKAVTSFPANSPHRPSIHATVSLFSSASGVPLASVEGSALTLLRTAAVSALAASLLVSPSRPPSTLALAGAGALAPYLADAHLSALPSLSRILVWNRTKAKSAALVAKLRDAHPGVAVEEVDGMDEAVSAADIVSCATGSQEPIVRGELLRPGAHLXTWVGSFTPAMRECDDE

SEQ ID NO: 107046 - protein, 373 aa, Triticum aestivum
  unsure (1)..(373): unsure at all Xaa locations
  Clone ID: PAT_TA_1464.pep
AKVDLPGVGLNFQDHYMTFSVYRAKAETESFDDFVRGDPEVQKKVFDEWNLKGTGPLATNGIEAGVKIRPTEQELKEXIERWPTPHFIDGWKSYFKNKPDKPVMHYSVIAGFFGDHMLMPPGKFFSMFHFLEYPFSRGFTHIKSADPYDTPDFDTGFMNDERDMVPMVWGYIKSRETARRMDAYAGEVENMHPFFDYACPARAHDLDLQTTKAYALPGNLTAGIGHGSWSSPLPEADRLPAANILNSNKAHIREELKYSEKDIKAVEEWVKRHTESTWHSLGTCSMAPKEGNSIVKHGVLDERLNVHGVKGLKVADLSICPDNVGCNTYSTALLIGEKCAMLVAEDLGYSGEALEMKVPTYQAPGEFVVRHRL

SEQ ID NO: 107047 - protein, 164 aa, Triticum aestivum
  Clone ID: PAT_TA_1465.pep
GLQGTRQKQILRTSAVERERDTEMTSAIRSAAALRQRLPRLLSSATRSVPRALEEERPLLVRRAGGPAMGDPRLFSSSSAGKSYTHPCKLNLRHKKQSLEDSLAYLNRMAKKEARDWREMREHLEASEQRQIELEKVYKRQDRVVNCAAATLFLALLAGNVFFG

SEQ ID NO: 107048 - protein, 250 aa, Triticum aestivum
  unsure (1)..(250): unsure at all Xaa locations
  Clone ID: PAT_TA_1466.pep
MFAAATATAVRLHAAATRRAAPRRPARFAVRADAARAATALTQDDLKRIAAARAVEQVQSGTALGLGTVSTAAFAVAEIGALLASGTVSAVNGGCTSKRXSRQASLGGIPLAMPVEVVQFCWKYNQVRLQGLFNEEGCEAKLRLNEDDKPYVTDNSNYIVDLYFKTPIKDALGAGKEIATLEGVVEHGLFLNMASSVIIAGSDGVSVKTNGRRRSRRRRGAYGEFVNLKMICRLSLSKVLIGIGCACVCS

SEQ ID NO: 107049 - protein, 325 aa, Triticum aestivum
  unsure (1)..(325): unsure at all Xaa locations
  Clone ID: PAT_TA_1467.pep
MAAAATAVRFHTAAARRAAPRRPARFAVRADAAQAATALTQDDLKRLAAVRAVEQVQSGMVLGLGTGSTAAFAVAEIGALLANGKLSGIVGVPTSKRTFEQAMSLGIPLSTLDDHPVIDLAIDGADEVDPDLNLVKGRGGALLREKMVEAASGKFVVVVDETKLVAGLGGSGLAMLVTTRLLLDIDGAGAATPIKPGKGAEPSTEXAQLPESSTSISKDTLRTGQGGRALAWRWRSCSCCWKHNQVRLQGLFNEEGCXAKLRLNEDGKPYVTDNSNYIVDLYFKTPIRDALGAGKEIAALESVGDVDMGLNMATSVIGVSAGACI

SEQ ID NO: 107050 - protein, 230 aa, Triticum aestivum
  unsure (1)..(230): unsure at all Xaa locations
  Clone ID: PAT_TA_1468.pep
MARYDRAITVFSPDGHLFQVEYALEAVRKGNAAVGRHGRPTPVVLRGGAESSPQXSIDSRSVRKIASLXAHLAXGCAGLKADARVAHQPGPASSASSHRLTVEDPVTVEYITRYIAGLQQKYTQSGGVRPFGLSTLXVGSDPYTDKPALYXTDPSGTFSAWRANPTGRLSTPMRDFLQKGXNNDTAGKETIQDLHRLPSLRHVESCDTNIEIAEMTYKDRPGKLNRRLNS

SEQ ID NO: 107051 - protein, 255 aa, Triticum aestivum
  unsure (1)..(255): unsure at all Xaa locations
  Clone ID: PAT_TA_1469.pep
MVADHQSSSPASPRPRFTIGYALPPGKAGSVIQPPLEALAAERGMRLVAVDASLPLADQGPFDLIIHKLFDRPWRAQLEAFSALHPSVPVVDAPAAVDRLLDRFTMLDVVPGLAAGLDFPLSVPAQVTVSDAAALAADDPSHGLRFPLIAKPLAVDGSAGSHDLCLVYRTEGLRGLHTPVVLQEFVNHGGVLFRXYXGVGGRXPCASRRSSLAGRARAPRGPRRRRLCPLRHISAARAGTRGRLDAARRVRRQVA

SEQ ID NO: 107052 - protein, 174 aa, Triticum aestivum
  Clone ID: PAT_TA_1470.pep
STGLNASPRLRIGIHLQLSTAALACTTPAPPAQPPSRRSPPSLACPAILWRTATVGGPPVRLTVGGRPRTRGVALGACAWPVPHTADGDSAVLHTAVNKDYTTPRQRRSSSLSRCVLPLRHLWNSSCAQCRRFDGLQMFDLRCPTVLHVHGRRKLNEPKLGKRNNQGGEGRSHP

SEQ ID NO: 107053 - protein, 112 aa, Triticum aestivum
  Clone ID: PAT_TA_1471.pep
MGFEKEILKAGTGPKPVKGQKVTVHCTGYGKDGDLSKKFWSTKDPGQQPFSFNIGLGSVIKGWDEGVMGMQLGEVARLTCTPDYAYGTGGFPAWGIQPNSVLIFEIEVLSAK

SEQ ID NO: 107054 - protein, 193 aa, Triticum aestivum
  Clone ID: PAT_TA_1472.pep
MGAELLLLGGKVSAGGAAGSGAVAASSAGAGRCVAGGRRLAPVQPAALQWRHSSRTSTDQKPPLQRCAAAELWRGDAEDGKMGFEKEILKAGTGPKPVKGQKVTVHCTGYGKDGDLSKKFWSTKDPGQQPFSFNIGLGSVIKGWDEGVMGMQLGEVARLTCTPDYAYGEGGFPAWGIQPNSVLIFEIEVLSAK

SEQ ID NO: 107055 - protein, 112 aa, Triticum aestivum
  Clone ID: PAT_TA_1473.pep
MGFEKEILKAGTGPKPVKGQKVTVHCTGYGKDGDLSKKFWSTKDPGQQPFSFNIGLGSVIKGWDEGVMGMQLGEVARLTCTPDYAYGSGGFPAWGIQPNSVLIFEIEVLSAK

SEQ ID NO: 107056 - protein, 171 aa, Triticum aestivum
  Clone ID: PAT_TA_1474.pep
SSPSTQTEDPKRRREKKYFPFPCTAHHPSSKTETRTCGRVGARVTRQGCSSCPSRGGRRRRRRGGACTGTTRRASSASRGTPVGSPAGARAWAPATTPWAWSPSPPAPPRRPCPRQRGPCGGSGGASSTAPRSYSPPPSCAAAPPCCPPSTERRRRQSRSTSLLKWKTNVQ

SEQ ID NO: 107057 - protein, 148 aa, Triticum aestivum
  Clone ID: PAT_TA_1475.pep
MVHAATAERFSSVFASFDCDADGKISAAELRQCMKAALGEDVSVEDAEALVASADADGDRLLNEEEFLKLLARPETEAEEDRCRGLREAFAMYEVKGQGCITPASLMRMLARLGSEQGIEECRAMIRSFDLNGDGVVCFDEFKVMMDA

SEQ ID NO: 107058 - protein, 300 aa, Triticum aestivum
  unsure (1)..(300): unsure at all Xaa locations
  Clone ID: PAT_TA_1476.pep
GLWYLFNIYFNIYNKQVLKVFPYPINITTVQFAVGTTISLFMWATGILKRPKISGAQLLAILPLAIVHTMGNLFTNMSLGKVAVSFTHASEAMEPFFSVLLSAMFLPPRPRRRPTPWVVLSLLPIVGGVALASISEASFNWAGFLSAMASNVTFQSRNVLSKKLMLKKEXSLDNINLFSIITVMSFFLLAPVTLLTEGVKVTPTYLQSAGLNLQQVYTRSLIAAFCFHAYQQVSYMILASVSPASHSVGNCVKCVVVFITCILFFKFPLSPINSMGTVIALAGVFLFSQLKRLQTRPKTS

SEQ ID NO: 107059 - protein, 85 aa, Triticum aestivum
  Clone ID: PAT_TA_1477.pep
MSQASKLTLLGTSLLTVGTVVAVHYQQKFEKAAMHEGVVRDMEQQRVKRERQLDFDMQKQLEAEYKREQTVHDSIAAAEKGLPNQ

SEQ ID NO: 107060 - protein, 276 aa, Triticum aestivum
  Clone ID: PAT_TA_1478.pep
MARQILTRNRKYTGRGSSRTSLLRTLTRIIPSKELALGKMSQYRNQMTKMATQQSSADFLQDPLIGECDPSHRCLIEKQKFIACLKVSGDSSALSLLMDNKGANPLDVSITAPDYVILAEDTVHVEANGHNETQVSVSVSDTVNDMAIVLKVAEETCKINLETAVTRNTGRVIPMRLTPTYMLVPVFVLLGLAGLCVKLRRARKQDGGPAYQKLDAPELPVSIGGKKEADQPDQWDDNWGDDWDDEEAPSTPSNSMPNLSSKGLASRRSTKDGWKD

SEQ ID NO: 107061 - protein, 191 aa, Triticum aestivum
  Clone ID: PAT_TA_1479.pep
IPASDTCGTHGLAASMAQELLSVGHVHGRALAHRMMDLMFMSRLCFTILSTMLRQAFVPVAVIAMACRWRCGFHARAGVCLDPLLPVVLEPLQDLGRPTVREGAAGQPDTSRSACMILSWRILHGSARTPPPCASTMTRFVACPWHPALSCHVMASTSALGCHLPPPRRARCRHIGPDAQRRLRCRLCPLQ

SEQ ID NO: 107062 - protein, 222 aa, Triticum aestivum
  Clone ID: PAT_TA_1480.pep
MYPVGTAPRPGSRLPAASRVDKATSHLLQGPDWAVNLEICDTLNADRWQTKDAVKAVKKRLQNKDPKVQFFTLTLLETMMKNCGEYVHSEVAELHVLQEMVKIVQKKHDMQVKDKILILLDSWQEAFGGPGGKYPQYYWSYIELKRSGVMFPRRPMDAPPIFTPPVTHQSQPYGSPAYPTGSLNDRMASDVETLSGDLDNIRCTELLSDMVNALNPADRMAG

SEQ ID NO: 107063 - protein, 226 aa, Triticum aestivum
  unsure (1)..(226): unsure at all Xaa locations
  Clone ID: PAT_TA_1481.pep
MSRLASALLALATAAAVAVAVAARPAVDVTATVAFGEGYTPLFGFDNILRSADDRTVSLLLDRTTGSGFISSAMYQHGFFSASIKLPSDYTAGVVVAFYTSNGDVFPKTHDELDFEFLGNIRGKPWRMQTNMYGNGSVSRGREERYVLPFDPTTEFHRYSILWARDAVVFYVDDVPVRHLRHARAGRDFPAKPMSLYATVWDASNXGTSGGRYRVNYHYGPFVRLF

SEQ ID NO: 107064 - protein, 140 aa, Triticum aestivum
  Clone ID: PAT_TA_1482.pep
PPRRPLCLTALQNPRLKRLPQPRPDLFLEYARVCISYIKEEGQSMPPQYNYITRVYGLTARTHSTRSPEAYSSLLSAQNYSLALEYTDTRPVEEPSAITACAQHTSKAHTLTSARQDTHTRRKNAHGHTSCCEAQMDWNG

SEQ ID NO: 107065 - protein, 216 aa, Triticum aestivum
  Clone ID: PAT_TA_1483.pep
RVDEEAHDAARSKNKAAQTSTTVHVPRHSQEAQDQQRHGTCSAIRMIGQDQAGGSRGAQDQHARQHAGTSGARSPGRDTAPSNIVRSSSTSRSSRRPPLPPTTPAEALARAQLLLDYPPTSDKIDEWRATIQSLIGYANGDTPRRTSASPSRQGCRARAGDDETGGGATTMQSPPRRPRSPTRRIHLDSDSTASSDPQARRDQRQVLHDQQPRAEF

SEQ ID NO: 107066 - protein, 336 aa, Triticum aestivum
  unsure (1)..(336): unsure at all Xaa locations
  Clone ID: PAT_TA_1484.pep
MICAISGEVPDEPVVSKRSGLLFERRLIERYIEDHGKCPVTKEELSMDDIVLVKTNKVVRPRPLQAASIPGLLGIFQNEWDALMLSNFALEQQLHTARQELSHALYQHDAACRVIARLKKERXTVHATQKYFVTAAKDNTWCFYDISTGSCLSQVGEASGQEGYTSASFHPDGLILGTGTTEAVVKIWDVKTQSNVAKFEGHAGPVTAMSFSENGYFLATAALDGVKLWDLRKLRNFRTFSPYDSDTPTNSVEFDFSGTYLAVAGSDIRVYQVANVKTEWNLIKTLPDLSGTGKVTSAKFGTDAKYIAVGSMDRNLRIFGLPGDDQMDDDAKPSAE

SEQ ID NO: 107067 - protein, 257 aa, Triticum aestivum
  Clone ID: PAT_TA_1485.pep
MDASYRRSGAGGGGGSAPRTVEDIFKDYRARRNAIHRALTHDVEEFYAQCDPEKENLCLYGYANEAWEVALPAEEVPTELPEPALGINFARDGMKRSDWLALVAVHSDSWLVSVAFYYAARLTRNDRKRLFGMMNDLPTVYEVISGMRQSKERDRSGGIDNSGRNKLPSKHTVEAPPPPRAENNARDADEGYDEDDGDHSETLCGTCGGIYSAEEFWIGCDVCERWYHGKCVKITPAKAESIKQYKCPSCSSKRPRQ

SEQ ID NO: 107068 - protein, 453 aa, Triticum aestivum
  Clone ID: PAT_TA_1486.pep
MDFQVVVLAGGTSEKLSPLVSKDVPKALLPVANRPAISYVLDLLESSDLKDIIVVVEGQEAARLVGAWISSAYLDRLVVEVVAVTEDIGTAGALRAISKRLVANDVLVISGDLVTDVLPGAVAATHRRNGAAVTALLCSVPVSGPSDAASSGGKDKAKKPCRLNIVGLDITRQFLLHVVSGTDVEKDVRVYKRKIRAVGQMEIRSDLMDAHLYAFNRTTLQDVLEQKETYRSIRLEVLPYLVKSQLRSAPSGGEGTIVDETGNVVVPPSSNLQCLSQHRAIAPSAFKQDLLPSSGGGTHRCCVYIASKNKYCHRLNSIQAYCDINRDVIGEASHLSGYSFSSHNNIIHPSCVLGSKTTVGPQCMLAEGSQLGDKCGVKRSVIGRHCRIGSNVKIVNSVVMNHVVIEDGCHIQGSVVCNNVQLQERAVLKDCQVGAGYTVTTGSDHKSESLARK

SEQ ID NO: 107069 - protein, 180 aa, Triticum aestivum
  Clone ID: PAT_TA_1487.pep
MAMHPQVALLLTLILLLAAGDGSLAVGTPSAIIRKTCTALDRPGGSVDYDYCVGVLSADPAGASAKDARQLAVIATNLTVANITSTVLVLEDLVNSLSDCLRIYREMNRPLEAALGDLRAGHVKAANDKLSHVFGEPEHCDMLLFAGSAHKNPISKENTDADLLTRLGFDITSLILGYIR

SEQ ID NO: 107070 - protein, 144 aa, Triticum aestivum
  Clone ID: PAT_TA_1488.pep
LRHRTSTSGSWTAATRRTPATSWLDGFYGFMAHHVTKHPREAYVNFRDLDIGQNALADDFGAAENARFCGHSATYSRNYEYLAKENAAVDPNNYFQERSEKPAHGQASHAQSSKIRVAHPRQGLHRINKLNHSMGPDDGLLLLG

SEQ ID NO: 107071 - protein, 146 aa, Triticum aestivum
  Clone ID: PAT_TA_1489.pep
MAGRKGGDRKKAVTRSVKAGLQFPVGRIGRYLKKGRYAQRVGSGAPVYLAAVLEYLAAEMLELAGNAAKDNKKTRIIPRHLLLAVRNDQELGRLLAGVTIAHGGVIPNINSVLLPKKSPAAAEKEAKSPKKKTSTKSPKKKVAAKE

SEQ ID NO: 107072 - protein, 111 aa, Triticum aestivum
  Clone ID: PAT_TA_1490.pep
AVGGGGSCGGCYCCSKALASSRCAQPSICDMPVQNRFVLLVFFFYSYAQLYLYVNNMSYVLAGFVVSTPRVSFFKEIVLCRFFAKKKYYVDSMSYYVLTGLHINNNEDGGC

SEQ ID NO: 107073 - protein, 448 aa, Triticum aestivum
  Clone ID: PAT_TA_1491.pep
MGRRKATAGPARGSSRAGDGVISEIRGKHRLELENLTLTKHPFRTLHFCNLAMLQYLKRSAAYILSKRALFVLLIVMVVIPGVALLVTDGLHKKHVQEFLNYARFVLWWVSLGVASSIGLGSGLHTFVLYLGPHIALFTIKAVQCGRVDLKTAPYDTILLKQAPSWLDKKCSEFGSPMYPSSDHSVMIPVIDLLPQVQLEAVLWGIGTALGELPPYFISRAGSELEAVKELDVAPSSEDGPIASTVNRTKRWLLSHSQHLNFFTILILASVPNPLFDLAGIMCGQFGIPFWEFFFATLIGKAIIKTHIQTLFIISLCNNQLLYFLEKELIWIFDHIPGFSATLPSVIAKLHSAKEKYLSPPVSVSPSSQMEDKQWNFSFALVWNTVAWHVEENQWKETVAPGAEDCRQGREGGVVEPVSDTLAPGFLRKLTNSKHGCIYSAAHCEYSP

SEQ ID NO: 107074 - protein, 218 aa, Triticum aestivum
  unsure (1)..(218): unsure at all Xaa locations
  Clone ID: PAT_TA_1492.pep
RKASSSRPATGGSSWRSTPSSSPPPRCSSSAATSPSSPSPTRSIWTPRRXTAPTPAARSSPSSCRRSRMTPGSSCSWARGSSCWRSSSARPSGSSSSSPPSPRTPTRSSLLLPPWARSWGKPRRSSRALCSRSPSSTSWRSSAPCFWAFVGALLGVLMVMLKQYFAVLLLASILIVAAATVFLVYFSFLCSFSIVVAVAEPGCHGAAALGKAWRLAKG

SEQ ID NO: 107075 - protein, 218 aa, Triticum aestivum
  unsure (1)..(218): unsure at all Xaa locations
  Clone ID: PAT_TA_1493.pep
MAPVKVFGSAAFTNVARVLVCLEEVGADYEVVNIDFLAKEHKKPEHLARNPFGEIPAFQDGDLVLFESRAIAKYILRKYRTGEVDMLRESNPEEAATADVWXEVEAHQYSKAVAPIVYECIVYPTAYGIPTNQKVVDESVEKLKEVLEIYEGRLSKHEYLAGSFISVADLNHFPFTFRFMETPYASVFDSFPSVKAWWEKLLLRPSVKKISADMQKEV

SEQ ID NO: 107076 - protein, 120 aa, Triticum aestivum
  Clone ID: PAT_TA_1494.pep
HRPFPLLSSSFSHGCSRSQVGRRRAPGRPLRCRTGPSGVRAADGCASGMHRGLRVCALPGRTGLHHCVHAPAVLRGQMPLHLFRHGLLGRLRPWQRRLRVPRHRPPGSLAPQALKPAGSS

SEQ ID NO: 107077 - protein, 140 aa, Triticum aestivum
  Clone ID: PAT_TA_1495.pep
MARLLAQSLARPSPATASLLPLRGLSTKVELIEIDLAEEDPSSVEVVGIRRMEEAIHGVMVRRATPEWLPFVPGGSFWVPPVRRPRGVAELVGRIAASGVGEVSYEAEPYVPMTEEEVLSLSTARGWPSAAYFVEGERDE

SEQ ID NO: 107078 - protein, 57 aa, Triticum aestivum
  Clone ID: PAT_TA_1496.pep
LRSPMSARLRSLRRLLSRGKQAVVGASSSPSPRGGGDIEQGLVGRPPKTPKTPPAAN

SEQ ID NO: 107079 - protein, 267 aa, Triticum aestivum
  Clone ID: PAT_TA_1497.pep
MVSTSTIRPLAGRMARASSTRISSAVPQVARFSTTAPQCKRKTKDNNPKRGVSSLYGSGPREPLSMSNIPLPKPRDFKPKIEVDPNHGLWGFFPGQGKLLATPKETEEHGRAWTVEELRKKSWEDLHALWWVCCKERNMLSTSRAELLRTKVGFGEREIDSRDEEVMKTQRAIKHVLTERYYTWQDAVDVAMNDPEINFEGGDGQAYTPSAYEDETNAAEWTQLGAESEAAKQIDPVATEAQGGQDREGAEEIIRNYHMARPCYVTI

SEQ ID NO: 107080 - protein, 354 aa, Triticum aestivum
  unsure (1)..(354): unsure at all Xaa locations
  Clone ID: PAT_TA_1498.pep
TRPGKQIHTAPAPAILALASFAGESAAFFACTGIVIANKPTVPPTTSFLTSLILVRSFDAGPPSYPYFGVPTKKELRSNGYPLPVWQNVGMRLLNNFEXKFSEDIWSKLERNVASNMSQSVVALASFSGKTRCFACTGVFIDCNGSTTRVLTSASLVRTSDNENKVADNLKIVVCLPDNRHTRGTLQHYSLHYNIAVVYIKNFCCTQTAQIDNQMLIKPHKEVVAIGRVYQSGKLMATSGIVIDKPSKLGCKELKISTCKITKAGIGGPLVDFDGNFIGMNFYGLEEAPYIPVNIILKVLKNFDAQGTVARDDDDSPNRWPVPKSFWCYPKWHEIEEEIDVEEEIIYHRQRQQF

SEQ ID NO: 107081 - protein, 561 aa, Triticum aestivum
  unsure (1)..(561): unsure at all Xaa locations
  Clone ID: PAT_TA_1499.pep
MASPPEGVEPAVIHAWSAPRSLSTSLMYSFSERDDMDVLDEPLYANFLRVTGVDRPYRQELLSKMDPDGNKVVKEVIFGPGEKAYRYCKHIAKQRLPNLTGDLMKKGKHFILIRNPMNILPSFDKVVPPSFLELGVAELVAIYSELCELGSPPPVIDADDLRRDPEAVLSGLCEDLGIPFQPQMLKWKAGPRDFDGIWAPWWYESVHTSTGFSKSRRYPMTFPFAFYDLLEQSLPFYNMLKRQVRRTTGSLLPPPPDPPLPVPENKKILVWVGDELLPRDSARVSVFDSVVQGGDAVWEGLRIYDGKVFKLEEHLDRLFDSTKAMAFSNVPSRDWIKDAIFKTLNANGMFNNAHIRLTLTRGKKVTSGMSPAFNLYGCVLIVLAEWKPPVYDNSHGIKLVTATTRRNSPNSVDSKIHHNNLINNILAKIESNLAQAEDAIMLDQXGFVSETNATNIFMVKKGIVLTPHADYCLPGITRATVMDLVVKENLVLHERRISLSEFHAADEVWTTGTMGEITPVVMIDGREIGDGKIGPVTRQIQSAYKVLTAGLGVPIPRNAEA

SEQ ID NO: 107082 - protein, 327 aa, Triticum aestivum
  unsure (1)..(327): unsure at all Xaa locations
  Clone ID: PAT_TA_1500.pep
MNQFAPQQSSLAMDSGESSAASNAAHAAMAVDYAPEVACCVSSMVDLGGAAGVESQRLFLARRTALEMLRDRGYSVPEDELARTLPEFRAWWSETPEIERLSFSTTLASDESNKVRIVFCPPEPVKIAAIREVYLRIKEENLSCLILILQSKITSRARESIKGGCSNSKVDVSKITELLVNITKHVLKPKHEVLTAXEKAKLLKQYNVXDSQLPRMLETDAVARYYGLGKGTVVEFTYDSELTVDRVTCGRSGPWGRGVSVGWCSLAAVCQNGLLAQVLALPCCLVRPRDNVVRKPGSQFQMLLRKWHKFVQCTMVAACLKTEMCAE

SEQ ID NO: 107083 - protein, 114 aa, Triticum aestivum
  Clone ID: PAT_TA_1501.pep
MKLVRFLMKLNNETVTIELKNGTTVHGTIIGVDISMNTHLKTVKLTLKGKNPVTLDHLSVRGNNIRYYILPDSLNLETLLVEETPRVKPKKPTAGKPMGRGRGRGRGRGRGRGR

SEQ ID NO: 107084 - protein, 120 aa, Triticum aestivum
  unsure (1)..(120): unsure at all Xaa locations
  Clone ID: PAT_TA_1502.pep
MKLVRFLMKLNNETVTIELKNGTXVHGTITGVDISMNTHLKTVKAHNXKGRNPVTLDPHHALRGNNITGTTSSLDSLNLXETLLVXEDTPRVEGLTKPTXGKPMGRGRGRGRGRGRGRGR

SEQ ID NO: 107085 - protein, 114 aa, Triticum aestivum; identical to SEQ ID NO: 107083
  Clone ID: PAT_TA_1503.pep

SEQ ID NO: 107086 - protein, 130 aa, Triticum aestivum
  Clone ID: PAT_TA_1504.pep
MARGKVAEWIRKRAMPRKSAAGRPSRASGASEPILRDAEESWSGASGAAAPMPARKAAGSGKGANGGAPAHSSSKVRAVGFLSALRWRPRVNVLAVVYEKVVYHVMWLVESVVVVGRLVFFLMRFGFKQL

SEQ ID NO: 107087 - protein, 193 aa, Triticum aestivum
  unsure (1)..(193): unsure at all Xaa locations
  Clone ID: PAT_TA_1505.pep
DCGRGGGRRGSRGXRGTRRGRGATRGAAAGGAAAQEAGARGRGRXRAMVMVPSWPRAPKALIGAPTPVSYPGGFPAAVHVVPRRGRARGPHAPAVANALRSLCKTCKSYRDAXALVLEAPMVATVLRDRTKLKPPVLVLXQIKPSPYFCFLRSLGKVQVEECTSRPEXLTLAVRPPSKGVGGYSGSTLWHQKF

SEQ ID NO: 107088 - protein, 260 aa, Triticum aestivum
  Clone ID: PAT_TA_1506.pep
SPGALSPAVAHPANAVMSDEMRAAVRHVASLFPTAIISGRSRDKVFDFVKLTELYYAGSHGMDIMGPIRKSESNGHHVECVRSTDSEGKEVNLFQPASEFLPMIAEVFENLSESIKDIEGARMEDNKFCVSVHYRNVAPHDYETVHQRVTAVLKDYPCLRLTHGRKVLEVRPVIDWNKGKAVEFLLESLGLSESDDVLPIYVGDDKTDEDAFKVLKANNHGFGILVSSVPKDSDAFYSLRDPSEVMEFLRTLAAWKEGSS

SEQ ID NO: 107089 - protein, 364 aa, Triticum aestivum
  unsure (1)..(364): unsure at all Xaa locations
  Clone ID: PAT_TA_1507.pep
SADAWVEMWKIKKLIKGLEFARGNGTSMISLIMPPRDQVSRVTKMLGDEYGTASNIKSRVNRQSVLGXHVTSAQQRLKLYNRVPPNGLVLYTGTIVTDDGKEKKVTIDFEPFKPINASLYLCDNKFHTEALSELLESDDKFGFIIMDGNGTLFGTLSGNTREVLHKFSVDLPKKHGRGGQSALRFARLRMEKRHNYVRKTAELATQFFINPATSQPNVAGLILAGSADFKTELSQSDMFDQRLQCKILNVVDVSYGGESGFNQAIELSAEILANVKFIQEKKLIGKYFEEISQDTGKYVFGVDDTLKALEMGAVETLMVWENLDVNRFVLKHSATGEIIIKHLNKEGEADQSNFRDPSTNAELE

SEQ ID NO: 107090 - protein, 420 aa, Triticum aestivum
  unsure (1)..(420): unsure at all Xaa locations
  Clone ID: PAT_TA_1508.pep
MSESHETEKNIEIWKIKKLIKELESARGNGTSMISLIMPPRDQVSRXAKMLGDEYGTASNIKSRVNRQSVLGAITSAQQRLKLYNPXGLVLYTGTIVTDDGKEKKVTIDFEPFKPINASLYVCENKFHTDALNELLGSDDMFGFIIMDGNGTLFGTLRKHVKNLSXSARMTLCTDPRRVGQVSPIFSTFCSPSRHNYVRKTAELATQFFFNPPTSQPNVAGLILAXGSADFKTELXNQDMFELHQRLXGAKYLMWLDVSXGGESGFNQAIELSAEILANVKFIQEKRLIGKYFXEEISQDTGKYASGVXDTGCSRNLDAVGTSWGRAVRAYARCVRKNFATGVCIIXVWPDQSNFRDPSTNAELEVQEKTSLLEWFANEYKKFGCTLEFVTNKSQEGSHFCRGFGGIGGILPVAPGHSLL

SEQ ID NO: 107091 - protein, 195 aa, Triticum aestivum
  Clone ID: PAT_TA_1509.pep
RGYISLGERWLACFIVLSLISINVVRILVESAHEAHQWVAKEEEAKYKAAKDAYELARRKLAKFNGPLSHRNREARDPAAEQPHLRAAALNAAQEEHDRLFTDEKLAKREMERLVQKQGMERIEGWPLVVIRGLFFFSVLCSQISCGFATAGFYYSRQIESRCALGPLDIFAFVLIGVVSLPYHLFLFWVSLRGN

SEQ ID NO: 107092 - protein, 299 aa, Triticum aestivum
  unsure (1)..(299): unsure at all Xaa locations
  Clone ID: PAT_TA_1510.pep
VSPLLPPLPPAALALAPALPHAAAGGGCGVYVPARVAQISWRPRAFLYSGCLSHAECDHLVKLAKGRLEKSMVADNESGKSVMSHXVAQRSGTFLSKRRGXFISGIEKRVAAWTFLPEENAESMQVLHYEVGQKYDAHFDYFSDKKNIKRGGHRVATVLMYLTDVKKGGETVFPIAEGRDLQHKDETWSERARHGLAVKPRKGDALLFFSLHVNATTDPSSLHASCPVVEGEKWSATKWIHVRSFDNPPDVMTDARCSDDNEQCPRWAALGECYKNAKYMVGTKDTLGSCRKSCGVCDA

SEQ ID NO: 107093 - protein, 215 aa, Triticum aestivum
  Clone ID: PAT_TA_1511.pep
MRPGAEFVAVSHRVGAPTVAPAHGLINGTVAPHSPWQSPVPYLFGGLAAMLGLIAFALLILACSYWKLSGYLDGDRDGQAAGDADGEKASASGAARPAMDFLEHVVVIMAGDERPTFLAKPAASRAAEVELATAAAAASALTGGEGQEKKVDEQGSEASSHLGADSARPSRDHHDTASRSHVHDQDAAGQSRDHHHDDQDAASQSSSTTLQESSQ

SEQ ID NO: 107094 - protein, 114 aa, Triticum aestivum
  Clone ID: PAT_TA_1512.pep
NGVLIQFIVAPADIGKLQRRTILCLQLASKPRWDGLVPETQSRDTERAGSEENTGRRRRGRRLARSLEQPRHGGTRTEAGGGEWRWLAAEYGLGEPRGAYFLSLARLARTRGRT

SEQ ID NO: 107095 - protein, 216 aa, Triticum aestivum
  Clone ID: PAT_TA_1513.pep
DSETNNLKEETIKKQYEVVKKRTSDMNRYSAGSHVMEYGDKTFKDEKLYLYQGFNPANTNITNKLFLQAPKAAINQRDADLLFLWRRYELLHEKSKEKTNVLREISETVTHRKHLDSSIDFIGKLLFGYENGPSVLQAVRPSGKPLVDDWDCLKRMVRIFESHCGSLTQYGMKHMRAFANICNNGISGTTMKEASIGACGVQNSARWSSLIQGYSA

SEQ ID NO: 107096 - protein, 449 aa, Triticum aestivum
  unsure (1)..(449): unsure at all Xaa locations
  Clone ID: PAT_TA_1514.pep
MAPRWCFALLLLLCAAAGADASKGKWDPVIRMPGEEEPARRRELRGGGADGVGTRWAVLVAGSSGYGNYRHQADICHAYQILRKGGVKEENIVVFMYDDIANNPLNPRPGVIINHPEGEDVYAGVPKDYTGEAGGGAVTIKNFYAVLLGNKTAVTGGSKKVIDSKPNDHIFIYYSDHGGPGVLGMPNLPYLYAADFIKVLQEKHASNTYAKMVIYVEACESGSIFEGLMPADLNIYVTTASNAEESSWGTYCPGMEPSPPSDYSTCFGDLYSISWKEDKENHYLEYEPANNNIAVEQIRQSEMTAFSASXASSSVFLXKTYELLHGNCNEQSNDETEISETVAHRKHLDNSIDFIGKLLFGFENGPSELQAVRPYGKPLVDDWDCLKRMGRIFESHCGSLTQYGMKHMRAFANICNNGVSGTTMKEASINTCGSHNSAKLSTLIQGYSA

SEQ ID NO: 107097 - protein, 158 aa, Triticum aestivum
  Clone ID: PAT_TA_1515.pep
HASAHASAGVTLSEEQLKYAQGKAREAGLEDHITFLLCDYRHIPPYKYDAIISICMIEHVGHECMDEFFACCESYLAEDGIMCLQFISAPEERYEQYRKRPDFLTEYIFPGGCLPSLARVVSAMSTSSRFSIEHVENIGPNYYPTLMCWMDNFTANKE

SEQ ID NO: 107098 - protein, 177 aa, Triticum aestivum
  Clone ID: PAT_TA_1516.pep
SITLQILIANRDERRNRRIARKGFWLSPVYVLAQLAYAKHFLRHTSMKNTATQTRRNISQHYDLSNDFFSLFLDKSMTYSCAIFKMENESLEAAQQRKLSLLINKAKVKRGHHVLDIGSGWGSLAIQAVKQTGCKYTGVTLSAEQLKYAEGKVREAGLEDRITFLLCDYRAHTTLQV

SEQ ID NO: 107099 - protein, 125 aa, Triticum aestivum
  Clone ID: PAT_TA_1517.pep
PRVRVCRLDQPVFGRVLQLPVNTISGCDRGDDVAASMGVVTLLRVSSLHLVSLTMSPALGTRGCWCCRGGHPGFWWWRVLTRGGACLGVADKGISRPDWGQRSAGVWCSMGGGLWVVGWSLHLRE

SEQ ID NO: 107100 - protein, 209 aa, Triticum aestivum
  Clone ID: PAT_TA_1518.pep
MKTTTFAVALLGLFPAIFAQETLAPSPTESVGCEPHGDHWHCDGARSTLATEAKVTTDAEHDDEHDHDHDHDTTGTGSLAPSPTESTGCEPHGDHWHCDAAKTGSSEAKATDDHDHDHEDEDHSHSAGATKSLSPSPTESTGCEPHGDHWHCDAAATAAATGSGSGSGSGSGSATASATESDSAAVTDNAAVIQIIPFAGIVAAAVLAL

SEQ ID NO: 107101 - protein, 226 aa, Triticum aestivum
  Clone ID: PAT_TA_1519.pep
MEEPSMADPPRIFWKSRRRPSSANGRSLQAQEHSNEAAATEEAAADNLPAQGEAMKIDDANAASTTTEDDAHQADPMANLSEKRKALFEPLEPINGKRSADMLLPPPDFEPTSYPKGWLVGKKRKLVNVDVVESMRRIAILEMNRKDREIGGLNEQLEEDSRVLELLQKQLTDERRKRSEIEKENSMLQEQVTMLMTMLAIKHFRQLQVPLFKKRRLQHVRLWVPI

SEQ ID NO: 107102 - protein, 163 aa, Triticum aestivum
  Clone ID: PAT_TA_1520.pep
GRAGTFVSDPARERDSEIPNPPNPNPPGEIGERDPAMAGEKVQFAIPMAAGEKEQAKVEKEAALKAKAGCGSKRRAEEDREEAPAAVGVKVQWNGEDESEDELYKACMAEDSFDYDSDDSLDVYAAKYKALFERFIEACDARCPWLVGKSKVANADADESLLV

SEQ ID NO: 107103 - protein, 481 aa, Triticum aestivum
  Clone ID: PAT_TA_1521.pep
MPPFRRWADLPADLLCRIGDSLDLKCYASARGACTAWRCALSPPSPSLLVVLDDARCCPSAASLPTHRSFELKNILSGGRCVGSSNGWLALSVCLYGGQSMFSLFNPITATEILLPPLIYESRWVSKLVFAPNPARDDFAAAAICDIDRLAYVTAGARRWAILDPVRLSSGDQLADVVYHEKGRVYCLTRYGDVHVLRLPERRRMKPIVVEDPAGPSEPEMPLGRPSLSLQGRRQRNLRMLCYEHRRWREQQLPIATMKAAFCPDVFMPLRRVPPGSVGPDLNAPATVEPMLSECNLPFDPATCFAAPYNTVSVFTSAKNLVFCDGNLYQIWRNASCTVTLQLPGGGHRRVAENEILVLRYYPRRQPCWDAVTDLGGYSVFVGRNNAVSMYAEDVPGLKGNCVYWIGGRGRDQGMVFDMGTGRSTPCLPVAGAGVVPGPPQSTICWYFLSDIVNNCNISAGRKVYQTRARVRAEREQDLED

SEQ ID NO: 107104 - protein, 273 aa, Triticum aestivum
  Clone ID: PAT_TA_1522.pep
RANTGTVFTYNKHYAHVFGDAGTKDLFNFLRTQLGVSRENKLPPLMIYAALNPEKFQSDKGTKMMQLAGLSADDMIAVNNMRCLCTDTKKSSGGGFTLKFDVQKKKHAHRKERTTEQSAWALSRFYPVLEELIEQLSKGELPKDEYNCMNDPSPSFHVGPTTTSTSARTSPAHSMRSRRTGGSWARPRGSDDGYSSDSVLKHASSDFQKHGQRIFVFVIGGATRSELRAAHKLSSKLKREVILGSSSLDDPPQFITKLKMMSAEELTLDDLHI

SEQ ID NO: 107105 - protein, 742 aa, Triticum aestivum
  Clone ID: PAT_TA_1523.pep
MASGGAQMEVERRQRDVAAGFVSLPESNKDLHALLEEADFWLSRVDQWPPDSMRSRIRPMMETLIRGCVPTHRAPGHPRGLTSCVRRCARISRPGCPCYANAMRGVIRAAVGAMSKVDDTKNPLYATRVSIMETIASVRSWVIMLDLDDDDLIHETFTHFFRIISPTLQESVITSMETIMMFVIQESEPVHPGLASCLLQNLKKERKDSHLASYRLAKRITRLCPEKLKPAFAELLQGTPLDEYSKVVASSVESSSDAGRDNNIDAVENDTESSKSEKDGQDGSPTNSTPNGLASSEQKSELPTDDKKTAVSDDKGAPEPVTAETEKLSGVNSKKSSKVGTSTESKVTEHSKVASDNQDLASGELSPGANDGNNKPMVEACNKATDDTSKPLDSTPADDTSKPADGTPAVDKPKRGRPPAVKSQEKKPVGKSQGSGLESKEVRSGSPSGGRPARRPAKDDKLSSRKSSEEESSKKQPTASPDLRKEDTLSDEDTDEDLSLKEMASPKSLTKTGKSKGQPGDSGVSKRKLVQEAEEVPQSKKSKVFDGSLVGSRIKVWWPDDKKFYKGAVKSFDASAKKHKVVYDDGDIEHLLLKNERWEFIDVEQDDNPNAASDRSRGRRGKQDSTVDSNPSRKRGRPKIVREDSPVSSAKSKVKSAEKDAEGGGRWPRSASRGSSKDEAGGKTPKGASAVKASDGSKSNGLSGKRKPKEKVAESSDEEEEEEEPVSAKASTGKKRRRKMLN

SEQ ID NO: 107106 - protein, 115 aa, Triticum aestivum
  Clone ID: PAT_TA_1524.pep
MASEMLLRRIHSICRLARGDRRPQLFSRGEGLRRPVSPASHPSFCSVACEQAGAGSASKDQDNLGRFSDPKVAHEDRRFVQFLDRMLDATRNPQSLAQIRREKLPNDLKILDDEI

SEQ ID NO: 107107 - protein, 165 aa, Triticum aestivum
  unsure (1)..(165): unsure at all Xaa locations
  Clone ID: PAT_TA_1525.pep
HGEVESLKGLRTVRAACGVWHTAAVVXEVMVGNSSSSNCSSGKIFTWGDGDKGRLGHGDKETRLVPTCVASLVEPNFCQVACGHCFTVALTTSGHVYTMGSSVYGQLGNPQADGMVPARVEGKLHKNFGEEISCGAYHVAVLTSTTEVYTWGKSANGRLGHGDTD

SEQ ID NO: 107108 - protein, 175 aa, Triticum aestivum
  Clone ID: PAT_TA_1526.pep
PVTHQIAVVEEQYGDSSSILRTNYVRIPELSELDTRPWEDIALTLNLESCSMPNLRGNIPEPELPRSETPPPLGLRSGQGLELNPPTHPDINDLSHIRQEPQETVHHYWARFLLVMNKVKDRREEDAISFFCKNCTDKGILNAISRRDITHFADLAAIVREYCAMESAWKTQTNF

SEQ ID NO: 107109 - protein, 171 aa, Triticum aestivum
  Clone ID: PAT_TA_1527.pep
AAQAGRAGSQSPHGHQQKRLAFSVTFSSLSSPTSERKSRSRRRRRPRSARCAAARARRAASACSSSSSSSPSASSSASASTPAASTSSPPTSTSRTAPPTAPTATSTSRRRHPTTRAPSLPRDLLCQQHGMDWALSPVFRRAVGIDPLHSVMPSAKKRFRGRSIYIDFLLN

SEQ ID NO: 107110 - protein, 116 aa, Triticum aestivum
  Clone ID: PAT_TA_1528.pep
MSSRGGKLAPEVNRALFVKNLSYNVTPEELFDLFGKFGPIRQVRQGIANNTKGTAFVVYEDVTDAKQACDKLNGFNFQNRYLVVLYHQPDKMAKSKEDLEARRESLAQLKQQHGID

SEQ ID NO: 107111 - protein, 76 aa, Triticum aestivum
  Clone ID: PAT_TA_1529.pep
MATMGVGGAVKMIIGAKEERVVATGKAPGACPSCGGPVVATDVESERRILCLPLCLKSKRKYYCTRCFRRLVTVYS

SEQ ID NO: 107112 - protein, 87 aa, Triticum aestivum
  Clone ID: PAT_TA_1530.pep
MRGSNARLLCALLLVLLCVAACFQGACCRGGGGGGGRGGGGRGGGGWNGGRVTTGSRGSSAAGDPLAHGVWRVSGAAATLVAAAILW

SEQ ID NO: 107113 - protein, 444 aa, Triticum aestivum
  unsure (1)..(444): unsure at all Xaa locations
  Clone ID: PAT_TA_1531.pep
MKITVRGSTVVVPAEETPRLRLWNANPDLVVPRFHTPSVYFFRRGAGEGGGGGXYFDAERMRRALAEALVPFYPMXAGRLARDEDGRVEIDCNAEGVLFVVADAHDATVDDFGDFAPAMDLERLIPAVDFTGGISSYPLLVVQVTHFKCGGXVGLGIGMQHHVADGFSGLHFINSWADLCRGVPIAIMPFIDRTLLRARDPPTPSHPHIEYQPAPAMLDSEEPQALTAKPEAPPTAVDIFKLSRADLGRLRAQLPTGEGAPRFSTYAVLGAHVWRCASLARGLSPEQPTKLYCATDGRQRLQPPLPEGYFGNVIFTATPLAVAGKVTGSLADGATTIQAALEVMDNEYCRSALDYLEMQPDLSALVRGAHTFRCPNLGLTSWVRLPIHDADFGWGRPVFMGPGGIAYEGLAFVLPSASRDGSLSVAISLQAEHMEKFRKMIFDF

SEQ ID NO: 107114 - protein, 217 aa, Triticum aestivum
  unsure (1)..(217): unsure at all Xaa locations
  Clone ID: PAT_TA_1532.pep
LSNIRGCTVQLTGPALAVHPIRAELSKTSDMKSAVRISLVLCAAIYAAVGFFGFLLFGDATMPDVLANFDRSSGSGVPQALNDAARLSYALHLVLVFPLLHYSLRVNVDELLFPGRRPLAADTRRFVALTAVLMGLLYALAIAIPSIWTLFQYSGSTFAVCISLIFPGAIVLXGCSWDSEEERQGNGSDDDHSGSDHEQHRHRFQRHELHQGRSERC

SEQ ID NO: 107115 - protein, 147 aa, Triticum aestivum
  Clone ID: PAT_TA_1533.pep
MGFPLVCYCVAIPKPVIAFCKLVAAVRDAFLLLLSLVGLCRSPRRSVDDAPLPEEVKERLPAVEFSLLARPAKQGCHDGDDDVAAAAATCIVCLERLRAADEVRRLGNCAHAFHRGCIDGWIDLGRTTCPLCRSHLLPRARSLVPAV

SEQ ID NO: 107116 - protein, 337 aa, Triticum aestivum
  Clone ID: PAT_TA_1534.pep
MPPSWEQSDVAAVDGGVEENVMAILDSFVGIKDSRDLHDDRASFLEAVRSVCLAGDKPSTPTERMYDAVFQIFQSSSSLELTIASFHLLMELGKQYPRVYLTNSGSEFATSIVKESWSPFLLGNNVASGEIGRNTSRSDHLFDSLRFSLLTEAMVEASNDTGANSGLKHIENMVLFQYLVRTLEADFIPRHIAYKESLDWVIIRESVLNVLLGSRKLVFKMFVKNCISLLNQHQREIEDDISSKSASDLDSSLTFSLLEFEREALISVKKLFIMVINLDLIRKEADKLGLTSRADGLRNPILEVILEELTYNTIYLSPFLLAFTECKWKLQIILLYF

SEQ ID NO: 107117 - protein, 130 aa, Triticum aestivum
  unsure (1)..(130): unsure at all Xaa locations
  Clone ID: PAT_TA_1535.pep
VYEPSSAXIALRPIPRFMIKKLQARGEARKGRGFGFVTLASEELQQKAVTEMNGKEIEGREIAVKVAIDSPDKTDEEQHEGDATNGQKENIPTTEAAPVAAPATGAAAAAPAATKAAEATPTSTTPATTA

SEQ ID NO: 107118 - protein, 294 aa, Triticum aestivum
  unsure (1)..(294): unsure at all Xaa locations
  Clone ID: PAT_TA_1536.pep
FDIEDHPDRTTAVGCLPMLVSPTIRNLKVTKMLVDGGAGLNLISSAVLQKLQIPDSELEETGTFQGINPGRSKPKGKITLPVTFGSELNFRTERVTFDVADFPLPYNGILGRPALAKFMAASHYAYNVLKMPGPISVISVPGDKKDALICADKIYREAAAAAERKTLAAEAPGGKKKTKSGKSSDAHSGKRTSSECCATVEDAPSSSTGKCKKAMAAPPETKKVSAKEDGTGGTFTISATLDPKXESALVAFLRANVDVFAWQPSDIPGVPRKVIKHHLVVCPLARPVDPGVPD

SEQ ID NO: 107119 - protein, 319 aa, Triticum aestivum
  Clone ID: PAT_TA_1537.pep
CFSFFSGRHEPRAADEQEFQKATEVLCVDGGASLHTSHRQLKQWVREVNAAEPPVESRKPLKWSGTPIIFDIEDHAGGITAFGCLLILISQRIFVLHVTKMLVDNGAGLNLTSYANLQKLQIPESKLKDSGTFQGINPGGRKPAGKNALPVCFGSDVYFRAWTGRSDAADFPELYLGFLSHPRLLVLKLAVENPRLGLFPQGCNHDDQGSIRGGALGCCCCRLSAAPPALPVLPLPRLPCIVRSGPSPALPPSRKGCQRLHFEDVVGFGRGPTGSLAQMSQVARVAWGARRRPGVVAGVAGAAGRSWPGPRGCWERRRG

SEQ ID NO: 107120 - protein, 92 aa, Triticum aestivum
  Clone ID: PAT_TA_1538.pep
RDKENRIKERFIFEAKAGDLKKWSYVTNLSYSKFKPEELESCMGDYSDGEQHLKYFDMQYITTQIEAIASNKEPRGTLATDITGPNLENSPS

SEQ ID NO: 107121 - protein, 94 aa, Triticum aestivum
  Clone ID: PAT_TA_1539.pep
MSAKYAFTKSLREVRFLFCQTSEQSAALRSFITRSYPTMKRNNPNIPILIREAAGTQPKIFARYERGVEKSQILEGLSDKEIEDTVTSLVQPAQ

SEQ ID NO: 107122 - protein, 202 aa, Triticum aestivum
  Clone ID: PAT_TA_1540.pep
FLVALCQAIDLRHIEVNVKSAVKSCVIMVAKKTLSTNSTGGLHVARFCEKDLLQEIEREAVFAYADDPCSPNYPLMKKLRGVLVERALSNGMGEFDAETSVFAKVALFEEELRKTLPPAVEAARAAVESGTAEMPNRIIECRSYPLYRFVREELGTVYLTGEKTLSPGEELNKVLVAMNQGKHIDALLECLKEWNGKPLPIC

SEQ ID NO: 107123 - protein, 85 aa, Triticum aestivum
  Clone ID: PAT_TA_1541.pep
KASSQVKNVLPLLRTESEGLIPRVRRRVAESDQSRTASRGKLPMPTTTGHWSPNDANTVLRVLCYRHEEAATRFLKKTYGLPKKL

SEQ ID NO: 107124 - protein, 192 aa, Triticum aestivum
  Clone ID: PAT_TA_1542.pep
IPTSSGSIHLPNSPATMRFSTVFTALVACVSTTDAAITWTLEKAANPTADQRDAYGRIENAMRLAADRYNRLGSATKNIRVSYNTGVPTADANYNGSLRFGANRSYMNERTALHEISHTVGIGQTAAFDRKCAANDWPSATRLLRSWDGNAANINCGGGHIWPYGLNYDNEWSETNANRHVQLVNAMIRDGM

SEQ ID NO: 107125 - protein, 97 aa, Triticum aestivum
  Clone ID: PAT_TA_1543.pep
MADQALDQIRDVVDGQIDFEGQKLVEFLATALLIVSGLISFVVGYILQDIKLAVYLGLGGTALTFLVVVPAWPFYNKHPVKWLPAGYAYDLASKGNQ

SEQ ID NO: 107126 - protein, 122 aa, Triticum aestivum
  Clone ID: PAT_TA_1544.pep
TIFSNNFFCLQLTLLWHIEVSDSFCSSASSYDSDREASGRSRKHKKSSRSRKSRERERSKDRHHKRDKSKHREFLGREKEESGKRSVISGKKIMMKLEKSKEVKAAESKRNELLKFLNASYG

SEQ ID NO: 107127 - protein, 99 aa, Triticum aestivum
  unsure (1)..(99): unsure at all Xaa locations
  Clone ID: PAT_TA_1545.pep
FSTIIXTXFSHHTXKTXHYPPNTLTIXKXLPAPPGSSSNRRPTPQHAADRRLDADVPPPPYWPSPRCLFHAPPPSASLTPTEELTFSPLRDLPRGILSE

SEQ ID NO: 107128 - protein, 198 aa, Triticum aestivum
  unsure (1)..(198): unsure at all Xaa locations
  Clone ID: PAT_TA_1546.pep
MVMLLSLLNETKKGVSFVEGVEFKLWQVPETLNEEVLGKMGAPPKTDVPVIFPXELWRDADGLVRVAPPGSADDWAAHQWRRSSNAGGLVGGTGPGGEGGRPAGVFXSTGRRGXGGRKPTPLTAVTQLXHHGMVFVPVGYTFGAKMFDMDKVQGGSPYGAGTFAGDGSRWPSEMELEHAFHQGKYFAGIAKKLKGSSA

SEQ ID NO: 107129 - protein, 194 aa, Triticum aestivum
  unsure (1)..(194): unsure at all Xaa locations
  Clone ID: PAT_TA_1547.pep
SSPPGTPGSSRRSSRSCSPTLSSSSPSPSTSPTSTPCRAPRSGCTQRRCSSSTXPTSPASSPRRPPSRSPPAPRSAATGRARSPSSCAAPPGPAPSSPAPRWSPSRSSRARPSRRITSTPGTGTAGATRTPAAWSRSCRASCCSSSSPRSSSASASPRSSRSPSPRRRRRRQRKAATAVAARARPLISRARGGS

SEQ ID NO: 107130 - protein, 577 aa, Triticum aestivum
  Clone ID: PAT_TA_1548.pep
SHGPGARPPRAAPPLRVPPQLLPPLRGSVELVLLRAAWAELDWYFPLAPAAARGGAEDAPPVSSGRGAGVAARTRGRTRGQEYLNIKLWRDYLDYVEEHDQSVSQCSQSGLSKMRDLYERAITAGGLHVTEGSKLWEAYREYEMAILTINDGNDEEKAKQVQRVRALFHRQLSVPLADIESTLAAYKSWEAEEGNTRDPDSQVDDVPPNVLSAYKKASEMYNARKQYEDELSVAAESEANKLQVFLKYIKFEESFGDPARVQVLYERAVSELPVSSDLWMGYTSYLDRTLKVPAILKSVYHRATRNCTWVSDLWVHYLLSLERIRASEDELRHVFELAIQCSFPSMNEYLNIYLTRVDSLRRRMPTGLDFELIRQTFVDAAEFLSPQLGIEELLLLHAYWAKLECNIGKAIAAARGVWENALKKSGSVLEVWQHYISMEIEMGHTHEARSLYKRCYSKKFAGSGSEAVCHAWIRFEREHGTLDDYDLAIKKVTPRLKELIMFKAQQEAKSDPSSAPKETSYANDSSQKRKPSKMTKVQPPAKMKDNPPKTVSSDDHSKEQTDSHLQKVIKGNAVPVN

SEQ ID NO: 107131 - protein, 116 aa, Triticum aestivum
  Clone ID: PAT_TA_1549.pep
LFRELNDHEIENHYKMNCENVETWHGIIISPAQHVRKSREGHGKNWTHFVYLPGRPLRSIRVLDQNLSVTRALQCFLNLFELGTSFVFSMQHSKRRHQFPTCSDIICCFSVIYLIV

SEQ ID NO: 107132 - protein, 77 aa, Triticum aestivum
  Clone ID: PAT_TA_1550.pep
IFRFSLAIVAASSLLLPKCTIADKSVVFHSSHCSGSSRGMDSSSISLLSRHRDCRAQCEPVWCYLPGNQAEAPALFV

SEQ ID NO: 107133 - protein, 110 aa, Triticum aestivum
  Clone ID: PAT_TA_1551.pep
PFTLSPSRGLGIHLASRLRRASIATSCSILNHSALISIKMCFNAALVNGICVYTAELPAATLVSSPHMAPPPNCPAELRPNPPTTARRDPLANSFSHDQPHQSIQLGPPR

SEQ ID NO: 107134 - protein, 192 aa, Triticum aestivum
  Clone ID: PAT_TA_1552.pep
SNPRKERPSIHVPGQRFRQVFCVLVLLGIQRRSIQFQGRVRFFLGGHGSSPPPRLVPRRRRPRRDPRRELRAVRRRREARAAEPGDGAGVVADGDAAHGAEQARRGALIHRWLQPLIGEEYIHSLDLEIIPFGSWLILSFQNKPFPSLPCASKRCVYKCNIYVRMYTESSICRRNDLKQPNRIPLTRRSCVL

SEQ ID NO: 107135 - protein, 240 aa, Triticum aestivum
  Clone ID: PAT_TA_1553.pep
NHHPAAASRQLPLHSPGSSTGSADSTPWHHRALTTPPLLPFDTNDADEMLLLHMLSQHQQHTHKALAAPVKLEAADGEEAGHQVSDGRAFRGVRKRPWGKYAAEIRDSTRNGVRVWLGTFDSPETAALAYDQAAFAIRGGAAVLNFPADHVRRSLEGVADDVCGRAHSVSPVLALKRRHSMRSRKATAAGRKVKAATRGAQPEGMVMELEDLGAEYLEQLLGASEDTATMDSWCWSHHFI

SEQ ID NO: 107136 - protein, 133 aa, Triticum aestivum
  Clone ID: PAT_TA_1554.pep
IVCLYLSTHSTPTARTITPLISQQQLSTLLNSTLPKCLTFLLKTSSLSLLLPSHPSSHSHRLHLLHTLRSPPSAPTLVLLPSDEHQSSPAPAPAPAPTTATASSSSDLFTGASTPTTTSTTSTISFFTKSNVK

SEQ ID NO: 107137 - protein, 94 aa, Triticum aestivum
  Clone ID: PAT_TA_1555.pep
SARGDRFLILSSDGLYQYLTNEEAVAEVEVFIATTPEGDPAQHLVEEVLFRAANKAGMDFHELIEIPQGDRRRYHDDVSVIVISLEGRIWRSCV

SEQ ID NO: 107138 - protein, 325 aa, Triticum aestivum
  Clone ID: PAT_TA_1556.pep
ETLQKVAQEQTSLSSLVESLRLELQAVKEEHSQLKHKDAEIESIVGDLHVKLQKCKSDLETAVATESDATLASDDLMLALEQLSSESKNALQEAEVLQKRAAELRDEAEAARASLVEAEQKLQSSLKEAEVAKAAETRALDQINQLSEKASAVRASISEPGANITISKEEFEALSRKVEQTEKLAEMKVAAAMAQVDAVRASENEAIKKLEAARKEMEDMELATEEALKKAETAEAANKAVESELKRWREKEEQNKNAETYVPPVGATSLADAPSHKASSAKANEKSNGHQKNSKAVLRKSFMLPSITGMFHHKKKNNADGSSHS

SEQ ID NO: 107139 - protein, 136 aa, Triticum aestivum
  Clone ID: PAT_TA_1557.pep
HSYDNFCLIVKMRSRICTSINQYCRCTATHCAASCYLVATIIHMVPRPSPRYYLTCGRVGSYFILSVYGLQNEAIKEGDRVVLLEPYYKILDISWKEQRYKFKSIRVDFPEQIIINEKAPAAHQVARASIRAQHKP

SEQ ID NO: 107140 - protein, 249 aa, Triticum aestivum
  Clone ID: PAT_TA_1558.pep
MLNIKDGNSWYNLGNAYLTSFFASGAWDKAPLHHSMNAYQKADTNYYLICCTGLLGDQEKVYKYLENYESALRGFEAAALKDPALRADIEVQKIINLLDKLENATKGRLRPKRSASLVSSLNEVNFKLFHKKATISILSGGLNKTVAVVCKVVLWIRHDDDAPLYYLTCDLDQSYFILSVYGLQNEAIKEGDRVVLLEPYYKILDISWKEQRYKFKSIRVDFPEQIIINEKAPAAHHVARASIRAQHKP

SEQ ID NO: 107141 - protein, 159 aa, Triticum aestivum
  Clone ID: PAT_TA_1559.pep
MAYNMLDAINNGKDSWKVKVRVIRLWDAINLNNNELISLDMILLDEQGTMIHAKVIKHMVNKFRPLIQEGLVYMIANFKVMSAMNFRPVESEKVLNFLHTTKIQEIRGQKNIKIAEQSFTFCTVEVLSTRDSQKMFLSGMIIFVSNINFHVLCILIPLY

SEQ ID NO: 107142 - protein, 270 aa, Triticum aestivum
  Clone ID: PAT_TA_1560.pep
MFCSVEVLSTRDGQRMYLSDVIGVASYIGNIEETETTHGISKIRDIVLRIEDQKVNIRLWGNKVDQIDEDSMGRVVIVTSTTVRKLKEYSLSSTGATKVYIDLDIPETAELQTRYCLEDDIIEETRPEAHLQGTIQEQMLYNRKTLREITEIAYESEKQEKFYTAEATIKSIDTSDEWYYIGCGKCNKKLQKEGNHFYCPKCEKEPEKTCPRYKLKLEICDHTATTTCTMFETEAKKLIKQSARFLIDRDDCDIHEQAEKFQKICGQRLI

SEQ ID NO: 107143 - protein, 189 aa, Triticum aestivum
  unsure (1)..(189): unsure at all Xaa locations
  Clone ID: PAT_TA_1561.pep
MASNAAPDDNEVAHDYGLVRVYKSGRVERPLVAPPAAAGLDPVTGVESKDVQLGDYSARLYLPPAAAMAAVKLPVIVYVHGGGFVAESVASPNGHRFLNSLTAACPALAVSVEYRLAPEHPLPAAYEDCVAALGWVLSAADPWVAEHGDLGRVFVAGDSAGANACHHLVIQPDAVRLKGAVLIXPWFWG

SEQ ID NO: 107144 - protein, 464 aa, Triticum aestivum
  unsure (1)..(464): unsure at all Xaa locations
  Clone ID: PAT_TA_1562.pep
AELNRWSYHGTLWPSDVCYSVFQASGTNNQKGAVGVKQPYIRIVGLEQSRDDNTNGPSHFTLDEEMEFKEFAQRPDAYAKICSMIGPSIYGHGDVXLPDGVRLRGDIHALLLGDPSTAKSQFLKFVEKTAPIAVYTSGKGSSAAGLTASVTRDSNSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDVRMYEQDKRIANHIIKVHASGAATQVNRNADTNEGENWLKRYVEYCRNTCRPRLSEKAAEMLQNKYVEIRQKMRQQSHETGRAAAIPITVRQLEAIIRLSESLAKMRLTSVATPEHIEEAFRLFNVSTVDAARSGINEHLNVTGDANESSKRKRSKEKVGSGATFRTSALDELNRMGLNESIVRRALVIMHQRDEVEYKRERHVIVRKA

SEQ ID NO: 107145 - protein, 153 aa, Triticum aestivum
  Clone ID: PAT_TA_1563.pep
MNNNAVAGGYGGGDGSYNNASNSGGSGGSYGSGGGIYNNASNSGGSSGGYGGGGGSYNNASNSGGSTGGYGGGGGIYNNASNSGGSAGGYGGGGGIYNNASNSGGSAGGYGGGGGSYNNASNSGGSAGDYGRCGRSYNNASNSGGSAGGYGGG

SEQ ID NO: 107146 - protein, 170 aa, Triticum aestivum
  Clone ID: PAT_TA_1564.pep
MMTPLSPTIVVMALLLAPLVVLSSAHEDHHRTPTQAPSPAHHHGHFAPAPSPHHHHKAPAPSPIHHHHHKAPAPSPIHHHHHHAPAPSPIHHHHHAPALSPIHHHAPVPSPIHHHHHAPAPSPIRHHHHAPAPSPIHHHHHAPAPSPIHHHRHHAPAPSPVHLDADEVDT

SEQ ID NO: 107147 - protein, 124 aa, Triticum aestivum
  Clone ID: PAT_TA_1565.pep
LGRISGGRSTLGGSWRGDPCLAACTQLDPAIRPCPLLPTVGASLEAGDASSVLGHGVLFPEKAPVCWKQRGRHTGQLGRRGGLKLTRGPAPGKRIEGSLGQVMNYVCIFRSAQTFPCPADFSLV

SEQ ID NO: 107148 - protein, 176 aa, Triticum aestivum
  Clone ID: PAT_TA_1566.pep
VYLPDRFARQFGQEQHPVGDVGGFQRHQWNASVDWSLEYASEIKHFEQLINATRPDHTAVAATCKTTEDVFTPASTAREFPGLNLLAVVESIKKELPTITRFLEQRSLPVEVATSFARIHELLEDSNLKEGNAAVDAGGDGTSELTAPHPPAIPPHGPVPDEAVQNGSDHPAPECC

SEQ ID NO: 107149 - protein, 233 aa, Triticum aestivum
  unsure (1)..(233): unsure at all Xaa locations
  Clone ID: PAT_TA_1567.pep
MATNPRFVASFDVESSDKYTSFIAGIRSRLANTEHYSHNVPVLPPADPPGTPPRRWFHVVLRTRTSTLTLAIRADNLYLEGFRSSNGAWWELTPRIIAGATHLGFGGTYRDLLGDTDKLAGVALGPQQMAEAVNXLAGRTAADAGSGAKQQQAREAVVALLLMVNEAARFQTVSGFVAGLMXPRGRRRTKGPITGDMNAQVNGWHDLSAALLKTDKYEEEKPNKPDKKKPEKR

SEQ ID NO: 107150 - protein, 95 aa, Triticum aestivum
  Clone ID: PAT_TA_1568.pep
SVVPAGAPSSLPLNMPSRTMLVVCVITAMLLLVSRDVAGARRVHAQNEDGDARKAVKKANQAKTIGGYVTVKEGSPYTVDPNHPTAPCYGPPCKK

SEQ ID NO: 107151 - protein, 203 aa, Triticum aestivum
  unsure (1)..(203): unsure at all Xaa locations
  Clone ID: PAT_TA_1569.pep
LAGDASCLEWLDAQAXNSVVYVAFGSLTIFDLRQFRELAEGLELTGRPFLWVVRPDFTSGGLSKAWFDEFQTRVAGTGVIVSWCPQQQVLAHPAVACFVSHCGWNSTMEGVRNGVPILCWPYFSDQFANRSYICDIWRTGLGVTQSEDGLVTKEEVKIKLERLTGDKGIAERARVLRDAARKSVNEGGSSYENFKRFVDLLTE

SEQ ID NO: 107152 - protein, 656 aa, Triticum aestivum
  Clone ID: PAT_TA_1570.pep
AKARQRQAAIMAKMKAEQSKFAESMKASENEGHPDATFEPDASSSTAVASEESRPVCSLCRDSDSKSPLCYLILLQKSRLASFVETGNPSWDNLSQSKKTSGSIRREKSTDSSGAGSSSSEELVRDTTIEPSFELDSMEVDAFLDFSNEQHPLIRYISCFPSGRCTGNADDNISLETIEADAYKSIVNDLVGIQGGEQCLSTSNLTAGSKTSTSPKSSVLGTYVTCLSTKYRLSSFCDVASKSSAPVTIRNRFGPVDCDGIHISSCGHAVHQECHDRYLFSLKQRYIRRLGFEGGQIVDPDLGELLCPVCRRFANSILPASPDFSGITRKAMPIAQTMSTEAAATIHNLQFPRALALLGSARKIVGQSTFLKAFPGNVNDTAEPALDPSLRRLTMLYYPRSKSSFSASERLSPSLFLWETLRYSVVSTEIASRDRMSSYSAQSKSCLESLRSELNSSSGFILSLLFRVSHSARVLNRREVLLRFEGIQLLAGSICSGISGDKDLLDATKRKGTSLPMVDPESEGEIFPDIQFWKQCADPILAQDPFSSLMSALFCLPVEVLTSTEFFIPIVHLFYIVCVIQALITCYREEAFDRSNFRNCLLNDVCQEMSGYDIAREYFVSKHIDPSCDPKDMVPYSEHAWDANPPRPKSYWKVSN

SEQ ID NO: 107153 - protein, 209 aa, Triticum aestivum
  unsure (1)..(209): unsure at all Xaa locations
  Clone ID: PAT_TA_1571.pep
MAARRHAGSSSGPTSANLSMKLLVEVDRRGTPRRVVYAEAGKDVVDFLLTFLTLPIGTVVKLLRRNSMPMVGCVGNLYGSVEELPDDFICHRDARAAKDTLLRPAGGRLPLLTNAGSSSSSTGGFVRAGVTYTVMDDLEIAPRSNVDFITNLNKYGIRDISCLPXKDVQVGHTEGLQILRASLKSKTVLTDVFLRTNTPSPSPRALTAG

SEQ ID NO: 107154 - protein, 85 aa, Triticum aestivum
  Clone ID: PAT_TA_1572.pep
AFSITFFGEWGDKSQIATIGLAADENPFGVVIGGVIAQALCTTAAVMGGKSLASQISEKMVELSSGVLFLLFGIMSLLSGPEGQL

SEQ ID NO: 107155 - protein, 232 aa, Triticum aestivum
  Clone ID: PAT_TA_1573.pep
MSPSLLGGLTKSLAMTVLSEVGDKTFFAAAILAMRHPRKLVLAGCLSALTVMTALSASLGWVAPNLISRKWTHHITTLLFFVFGIWSLWEGFKEEGESEDLAELEAKLDADFKSNKGESKNKSKATEDTKKKQRPFLMQFFSPIFIKAFSITFFGEWGDKSQIATIGLAADENPFGVVIGGVIAQALCTTAAVMGGKSLASQISEKMVELSSGVLFLLFGIMSLLSGPEGQL

SEQ ID NO: 107156 - protein, 602 aa, Triticum aestivum
  Clone ID: PAT_TA_1574.pep
SAIDEEKPERPVCLVRGLSAKGPFMDDLSLRVTGLKANAVVCASSGEGLAEERKVSGAAVASLATARSSQATETVSLPPDSEEKDCVWDASLPPSGNVSPHSSIDSMGVVTAMSIASNRSNTYKSEAIASGTMLTVERNFGSVKSSVRGDSLESAKTSMSRASDSSGVSDDSSWGHITGGTSKPHKGNDPRGKAIHAVRIRDGVLGMGRVGLLLRPGRGDIGSVYLSELSGTRCYFAMKVMDKASLASRKKLNRAQTEREILQLLDHPFLPTLYTHFETDRFSCLVMEFCPGGDLHTLRQKQPGKYFSEYAARFYAAEVLLAIEYLHMLGVVYRDLKPENVLVRDDGHIMLSDFDLSLRCAVSPTLIRTSAFDSDPRRAGGSFCVQPTCMEPTSACIQPACFIPKLFGQKSKKKTRKTRSELGQSAINLPELLAEPTSARSMSFVGTHEYLAPEIIKGEGHGSAVDWWTFGIFLHELLYGKTPFKGSGNRATLFNVVGQQLKFPESPSTSYAGRDLIRGLLAKEPQQRLGVKRGATEIKQHPFFEGVNWALIRCSTPPEVPRPVEAELPVKYGVSEAVASTNKRVVGADAKSGGKYLDFEFF

SEQ ID NO: 107157 - protein, 120 aa, Triticum aestivum
  Clone ID: PAT_TA_1575.pep
QKIVHVPIHRRNGAGGEDGEGGDVCRRPRADAVLQRDRRDEVASRGRRAAVASAGRRVAEHDAGPAQGHSAGWLRQPGLGRPQPPPAVASPDVFTNLCRLIFVHSFAPPFVCTCTVALRV

SEQ ID NO: 107158 - protein, 135 aa, Triticum aestivum
  Clone ID: PAT_TA_1576.pep
RPTLLSPHLVRCQLLPCCFPLLLGSRTRAHGGLKKGGATQQRRHKPNQSVSRTRLEIGGAKKRVGRASLGQQPKRVPTPSALREEGIWCGREMGTRRRGGGMPGAASLLLLACCCSVWPRAQILVAATTDATDLT

SEQ ID NO: 107159 - protein, 449 aa, Triticum aestivum
  Clone ID: PAT_TA_1577.pep
MGQGTPGGMGKQGGAPGDRGKPGGDGDKKDKKFEPPAAPSRVGRKQRRQKGPEAAARLPGVAPLSKCRLRLLKLDRVKDYLLMEEEFVAAQERLRPTEEKTEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTAKMTLSDDVNLEEFVMTKDEFSGADIKAICTESGLLALRERRMKVTHADFKKAKEKVMFKKKEGVPEGLYM

SEQ ID NO: 107160 - protein, 67 aa, Triticum aestivum
  Clone ID: PAT_TA_1578.pep
TMHSFLSIFCINLFSYICSLITCYTRTLWYGKYARGSSTPQYGVRSPNTFTSAAPRTYSTICIGSES

SEQ ID NO: 107161 - protein, 102 aa, Triticum aestivum
  Clone ID: PAT_TA_1579.pep
INNASIFSYCISFLYICSLMTCCTRTLWYGKYTRGFCTPYYGVISPNTFTSAAPRTYSIICIGSESCFGSIVGFARLPCFGTLRSAISAKVALGEPLRLCPG

SEQ ID NO: 107162 - protein, 104 aa, Triticum aestivum
  Clone ID: PAT_TA_1580.pep
IKTMCKPSLLSLVASHPPGTQRNREGCRRYWHFVTPDLCTYLEIQGSLTRALLSPVYVVKSEYLMECSASRVWPYMHQLRIMSWVNSWVCPAPVFWYLTFRSIG

SEQ ID NO: 107163 - protein, 116 aa, Triticum aestivum
  Clone ID: PAT_TA_1581.pep
GVFGVASLALYASAPNHVFGQMLGLPGSRVLVPYVPLYRLRRHQENYCDCAPVRPGEHLSRESRKLTVMIWRELVNHSMTHQNFWDSSALMKGRFPAMNIRAPYSGERNHHQGLYK

SEQ ID NO: 107164 - protein, 160 aa, Triticum aestivum
  Clone ID: PAT_TA_1582.pep
PTRGEKPSAFDAAAFYRAQEGSSVESVFWSQYSKGGHPMPLSDQLKQLVELHKAAEQAMKGLIVRLWPKEAMPGSYFGLVRRLVDACPWVEVIKHSACIEGARRALARAKVHWGKMDAQKLVTDPPPPGKEHYTPEMYYKGVLKGARTIAGECSKDVIFE

SEQ ID NO: 107165 - protein, 95 aa, Triticum aestivum
  Clone ID: PAT_TA_1583.pep
CTMPQDTLAPARDPRPPSIHAARSLPSTRQQVCTCRLPRPRHIPAARPPMPQPRDEALPGLFDRLVKAPPDNLSFVAQWARGIGPLAQCDQQPPL

SEQ ID NO: 107166 - protein, 258 aa, Triticum aestivum
  unsure (1)..(258): unsure at all Xaa locations
  Clone ID: PAT_TA_1584.pep
RSRPGRENLSHQTINPLEYNQPWQRPHDTEAVEKQPDSDFKHIDQAPSKVSSDIDADHGFTPEEQRSIIKRIDRRLVITVGAMYCVSLMDRTNMSAANIAGMGAELQLTGFRYNIANLVFFIPYIIFQPPSTILIRRIGPRFHLAIITLLWGAVMIGMGFVEKFPQLAALRAVLGFFEAGFFPSCVYLLSTWYTRYEVGKRYSVFYLLGCVASAFSGILAYGLMQLNGREGLTGWRWIFIIEGALTCALGIAGYWLLX

SEQ ID NO: 107167 - protein, 65 aa, Triticum aestivum
  Clone ID: PAT_TA_1585.pep
MENMRSENNRGAAMEGVKLASEAAANTNRRALRDIKNILGAPHQPQAVRRRACRKTPLPCQEPSL

SEQ ID NO: 107168 - protein, 419 aa, Triticum aestivum
  Clone ID: PAT_TA_1586.pep
MENMRSENHRGAAMEGVKLASEAAANTNRRALRDIKNILGAPHQPQAVSKRGLQEKPAAAGAKSQPGAVGHRPVTRKFAAILQQTQPANAPLAPIGSERQKRNADTAFHAPSDMECSKASDDDLDEMMTNELKEIDMEDTEEEEMPDIDSCDVGNSLAVVEYVDEIYSFYRRTEELSCVSPTYMAHQSDINEKMRGILVDWLIEVHYKLELLGETLFLTVNIIDRYLARENVARKKLQLVGVTAMLLACKYEEVSVPVVEDLILICDRAYSREDILDMERKIVDRLEFNMSVPTPYCFMRRFLKAAGSDKKLELLSFFLIELSLVDYKMLKFQPSMLAAAAIFTAQCTLNGCMSWNKCCELHTKYSEEQLMDCSTTTVELHQGAARGKLTGVHRKYSTFKYGCAAKSEPAAFLLDARKA

SEQ ID NO: 107169 - protein, 108 aa, Triticum aestivum
  Clone ID: PAT_TA_1587.pep
MASRTKLSGIQRQALALYRGFLRTARLKSPEERRRIESVVSAEFRENARSVDRRNFVYIEYLMRRGKRQLDQLKNPDITGLSTLEINKASSIPEQRVEHDLGVSTGRQ

SEQ ID NO: 107170 - protein, 243 aa, Triticum aestivum
  Clone ID: PAT_TA_1588.pep
MGQEADADEQLQRRLRRVFAAEERSFRMDRRSPAAADLRSAVADVLPRFLGNHSDETLAEYIVILVCNGKHQYQARDDLEAFLGDDSAKFVAWLWGYLSKTAVALADDSSVQHRLENESQDRNDKKNLLVTKTQPGEAHIVNSNILVPQEHNGLHKLDLTKGQNVAQRRISSTVTISPKMVAGDECYREGQHQKKDWSSTAGRSSSVRQSGVAAKTEHTLMGRGPHDEHLGGNSSRRLACRGN

SEQ ID NO: 107171 - protein, 257 aa, Triticum aestivum
  unsure (1)..(257): unsure at all Xaa locations
  Clone ID: PAT_TA_1589.pep
RLWXGGRVVAKDVEAAAAAPKKAAPVAAARPDVPLGSTVPFTTMQGAVSKNMVESLAVPAFRVGYTITTDALDALYKKIKAKGVTMTALLAKATAMALVQHPVVNSSCRDGQSFTYNSSRTRGVAVAIDGGLITPVLQDADKLDIYSLSRKWKELVDKARAKQLQPQEYNSGTFTLSNLGMFGVDRFDAILPPGTGAIMAVGSSQPTVVGTKDGRIGIKSQMQVNVTADHRVIYGSDLAAFLQTLSKIIEDPKDLTF

SEQ ID NO: 107172 - protein, 183 aa, Triticum aestivum
  Clone ID: PAT_TA_1590.pep
MASSSPPHVVEDVPPFLQLLSDGTVIRFTDGYPLPIPSPPPGQPVVDWKDVVYDASHGLKLRIYRPAAASSSGNKLPVIVYFHGGGYSIGSFDMPNFHACCVRLAGELPAVVLSADYRLAPEHRFPAGLDDAANVVSWVRGQAAAVGDNADPWLSETANFDRVFVAGDSAGRGVVHHTAVRLA

SEQ ID NO: 107173 - protein, 166 aa, Triticum aestivum
  Clone ID: PAT_TA_1591.pep
MRRLWRQIKGACQWRSPPLRLDRSAAGSTMLCHGMGALQLAPLPSPDLPAPARAPDSANSLASDPIQTCTHSLTPPPAPQLARRPGRASSSCGLPVVSVSPAASTRPSPPPAPGLKQLPLFGSRGPPVEPGVPVVVVFARWTLFHFLRSFTLCRFLLFPFSAGFDF

SEQ ID NO: 107174 - protein, 355 aa, Triticum aestivum
  unsure (1)..(355): unsure at all Xaa locations
  Clone ID: PAT_TA_1592.pep
SSRVVIRAVAAVGAVLSVELMCFWGXWLDKSFGKKDIHGFRVEHCGGSYLVGFHGYPPSSTKDILKKLETMDEENIIGAGGFGTVYKLAMDDGSVFELKRIVKTNEGRDKFFDRELEILGSVKHRNLVNXLRAYCNPPSSKLLIYDYLPGGHLHVVLLEKTVRLEGEARINIILGAAEGLAYLHLDCSPRIIHRDIKSSNILLDGNFEARVSDFGLAKLLEDEESHITTIVAGTFGYLAPEYMQSGRATEKTDVYSFGVLVLEVLSGKRPADAXVVGNPLGIVGWPTFLAGESREREIVDPDCDGVQIETLDALLSLAKQCVSSLPEERPTMHRVVQMLESDVITPCGSDFYDSE

SEQ ID NO: 107175 - protein, 146 aa, Triticum aestivum
  unsure (1)..(146): unsure at all Xaa locations
  Clone ID: PAT_TA_1593.pep
DRSKYLIILSXSTYLDMILKVFKIXQSKKKFSVELSKTQDPTMAENRKRMXVIPYASVIGSIKYAMLXTRPIVYLALCLAKEYNFDLXVDHWTWVKNILXRTKEMFLDYGGDKRARRKSYNDASFYTNPDDSKSQSGYILKVGAIS

SEQ ID NO: 107176 - protein, 163 aa, Triticum aestivum
  unsure (1)..(163): unsure at all Xaa locations
  Clone ID: PAT_TA_1594.pep
KWTVFTSSANATMILVVDMKLTLVVLLVKLVVSGACSHSSFTNLLSWLKSHSYCHATSPFWIDAVPSGFWCGVDLDDGATLSGCSSSVQVQSLWVMWCXCVCARGWPAGAGLKKHXSPXXXCDCAXTGRATIFDWXTLFQLRXPVFGFGXMXKKVMFIKNPGN

SEQ ID NO: 107177 - protein, 231 aa, Triticum aestivum
  Clone ID: PAT_TA_1595.pep
SSAPPASPSGSALHHPEMAPLQARLHDQIKDSMVLINIKPPKKASVGKNKNDKGIFVMGTIIVLQPYFMYVVADPASFHGEGQLKLLIDCLEGTKLELTRPQIHLTEGIAGIRCPNPGGYNTQLMRAVPLCRSVIAKRQRVHLFSPEQMLLTSGTVMGVSGPTFQHNCSTLESSSLGAPVVNDNGHLVGICNDFRNDYLEAISTHAIASEIEMAQGREYIGIGQMLDHLQS

SEQ ID NO: 107178 - protein, 204 aa, Triticum aestivum
  Clone ID: PAT_TA_1596.pep
MAENPQLFGNGMPVPFHGEMFVLARDGVEFHVDKIPSAPGGHAKTKGTIYLSNIRTLGVAAKPVGNFFAFDMPLLYVHGEKFNQPIFHCNNISGFVEPVVPESQNRALYSTHTFKILFKEGGCGTFVPLFLNLITSVRRYNQFEAQPATVPRVDPMQAAQTPVDDMMRHAYVDPHDPTKIFLQQPAAESQLRRRNYHGPAENVY

SEQ ID NO: 107179 - protein, 236 aa, Triticum aestivum
  unsure (1)..(236): unsure at all Xaa locations
  Clone ID: PAT_TA_1597.pep
MAENPQLFGNGMPVPFHGEMFVLARDGVEFHVDKIPSAPGGHAKTKGTIYLSNIRMVFVAAKPVGNFFAFDMPLLYVHGEKFNQPIFHCNNISGFVEPVVPESQNRALYSTHTFKILFKEGGCGTFVPXLFLNLNTXVRRYYQLEAQPSTGPRVDPMQEAPAAVVIRMPYADAHHPTPALPPRRPQXDSLLRRRNYHGPPRCLRGRLRRPACCVRVLSSSWRSRALELFGCLVAFQ

SEQ ID NO: 107180 - protein, 186 aa, Triticum aestivum
  unsure (1)..(186): unsure at all Xaa locations
  Clone ID: PAT_TA_1598.pep
MSSKPASQSMPEQAAKPKEMGEDDRQRSAAEEVSGEPDQQQESPAPVLDKDAPDLSPDSGVLDVPLAPEAESDESKETKNSDSNENQEKKSSQKSSISDSFISAKVSDGTNSLGKTSGSAKTSGRDFTESGKSSMCRVSASSDLSDESSCSSMSSATTKPHXGNDSRWEAIQVVKSREGVLGLNQF

SEQ ID NO: 107181 - protein, 474 aa, Triticum aestivum
  Clone ID: PAT_TA_1599.pep
SKVSDGTNSLGKNFGSAQTSGRDFTESGKSSMCRVSASSDLSDESSCSSMSSATTKPHKGNDSRWEAIQVVKSREGVLGLNQFRLLKKLGSGDIGSVYLSELSGTKSHFAMKVMDKTSLASRKKLLRAQTEREILQSLDHPFLPTLYTHFETDKFSCLVMEFCPGGDLHTLRQRQPGKHFSEQAAKFYVAEVLLALEYLHMLGIIYRDLKPENVLVREDGHIMLTDFDLSLRCSVSPTVIRGANPGLDALQRNNAAYCVQPACIQPSCVVPTTCFGPRFFSKSKSKSKSKKEKPKPDIVNQVNLFPEMIAEPTDARSMSFVGTHEYLAPEIVKGEGHGSAVDWWTFGIFLYELLFGKTPFKGSGNRATLFNVVGQPLRFPESPLVSFSARDMIRGLLVKDPQHRLGHKRGATEIKQHPFFEGVNWALIRCASPPDIPKPVELDCRPKQAPAANGKVAPASNQKGSDNYLEFEFF

SEQ ID NO: 107182 - protein, 136 aa, Triticum aestivum; identical to SEQ ID NO: 106789
  Clone ID: PAT_TA_1600.pep

SEQ ID NO: 107183 - protein, 140 aa, Triticum aestivum
  Clone ID: PAT_TA_1601.pep
MRRTGRKWCPLPALGWWLVVVGTVRLVFAWSGFFDAWAVRSGTYSNTHVTDVHARTVGVWTLLSCTLCFLCAFNLDNKPLCAATLLSFVYAYGHFVAEYLVYRTITAASLGTLGFFAVPSIIWTLVHWRNTLGYRATKRS

SEQ ID NO: 107184 - protein, 134 aa, Triticum aestivum
  Clone ID: PAT_TA_1602.pep
RTRGRDVFRLQVHLVAAQMAARKGRRDGAGRVRVVLRSECEPMMDLFRCDEAAGREGDWWMYTVDAPRMEEKLRLPVGSCNLALPLWGPTGIHEVFNASDLTVVDAGSQRREAYATVLHSSDRYLCGAIMLAQS

SEQ ID NO: 107185 - protein, 545 aa, Triticum aestivum
  Clone ID: PAT_TA_1603.pep
MESRSINLRGFAGSAGKNIMQGIGGFVFGNEASESKEDSYVERFLDRISNGTMPDDRRSAMTELQSLVAESRSAQMSFGAMGFPVLLNVLKEDREDVELVRGALETLVSALTPIETSQGLKTADAWADAWADLLSRETDNISLLLSLLTEEDFYVRYYTIQLLTALLTNSLKRLQEAILLIPRGITVLMDMLMDREVIRNEALLLLTYLTRDAEEIQKIVVFEGAFEKLFSIIGEEGFSDGGVVVQDCLELLNNLIRNNASNQMLLKETMGFDPLISILKIRRGSAFNFTQQKTVNLLGALHTVELLLMGGPPGETGKDTSKITNQTALAQRNILDHLLLLGVESQWAPVALRCTALRCIGSLVLRNPQNLDSLASKQVGEEPHVQPALNAILAIILRTSVAQEFVAADYVFKCFCETNPNGQALLASTIAPHPNQGTATHGASSDMPFGSALLQALVSSDVNGDMEACCRASSVLTHIIKDNLQCKDRVLQIQLETPTPSLGRTEPLLHRIVTCLSFAALAGEDDQSSQSEGSYIQPVILRLLI

SEQ ID NO: 107186 - protein, 218 aa, Triticum aestivum
  unsure (1)..(218): unsure at all Xaa locations
  Clone ID: PAT_TA_1604.pep
RSSPPSRPPSPASSTRSSPRSRPSAGSTSTSRRSTRPSSPVPTRSTCTTRPRAVPRVSSPRSSPPPTRPRSSPTXAGLRADPRGQRAPPPVLRXSSPRPPPCSPSTPTTPPTWTPREPATPTSPGCTASRSLPSRRLCTTVTTSSSAFVANGRSLSKATAPINTFDPWSRRPDGLKVGCPGFRGVTSAVTELRGISIGHTDVVVLTEGYRTIPKAKGA

SEQ ID NO: 107187 - protein, 185 aa, Triticum aestivum
  unsure (1)..(185): unsure at all Xaa locations
  Clone ID: PAT_TA_1605.pep
XPLNXAXPIWIHPAFAXVXYFQVANTXXQQHCDILFGVRPLLVTLNQFQIYLQIRMXQRYARNSGVKVPAAPRKPGHGESAVRRAGATETGWPGRAGKGGRGGVRVGEAGGYDFIRAEDAELHELHLGHLSRRVREPRVHFTPTAAPPPPRVWVSDPAARRERSAARSLGRTASPCLEHAKLFGG

SEQ ID NO: 107188 - protein, 129 aa, Triticum aestivum
  unsure (1)..(129): unsure at all Xaa locations
  Clone ID: PAT_TA_1606.pep
KLRXRSPRSRTMAAGGSPYPTETNRHWRPPPLTTIAAHGAARSRTATTLPNLNPELAQGCTPIQTLAPERTARSRSSVRGPANPSCLAPESRRAARDLGIGEGIWSGEAWDLGIGEDSGWGVGVGVDSI

SEQ ID NO: 107189 - protein, 418 aa, Triticum aestivum
  Clone ID: PAT_TA_1607.pep
QVASRESERAERATLVTQEKLQQASNKTKQMRLNDVWIRPPFGGRGRKLTGTLEAHVNGFRYSTSRADERVDIMYGNIKHAFFQPAEKEMITLLHFHLHNHIMVGNKKTKDVQFYVEVMDVVQTVGGSRRSALDPDEIEEEQRERDRKNRINMEFQNYINKVNDHWSQTQFKGLDLEFDIPLRELGFHGVPYKASAFIIPNSTCLLELIETPLLVETLGEIEIVDRNRMGFGKDLYDMAIAFKEADEATRRLGTAPKKPKDEKAERDEATHPADNPGSRRLRRKRAPRWRRVTAEPPAAWDRVRLGTPPQPPQRKATGRLDAAPAVELHGNARWIGGGVESDEDEEEDSDEDSEEEKGKTWDELEREATNADRDHGAESDSEEERRRRKVKTFSNGNKSRPPPSSSKGGPPSKKPKFR

SEQ ID NO: 107190 - protein, 133 aa, Triticum aestivum
  Clone ID: PAT_TA_1608.pep
RSCMHEETSRACSLAGLFPDALHIILGSFALSLPLLLHLAHARVASKGYAAVHLNLDRTRRNNPVGSGNFHTSSTALVARIHDVLIDNAARRRTADGRYLLGGSNGAHQRDERRHGNEPREHCCCHEQMDAKM

SEQ ID NO: 107191 - protein, 134 aa, Triticum aestivum
  Clone ID: PAT_TA_1609.pep
RSCMHEETSCALSLAGLLLDALHLGTFALSRSLPRLLHVAKARVASKGYAAVHLNLTDFTRNNPVGSGIFVTFSEALEARIHNVLIDTVAHRRTADGRYLLGHSDGAHQGDKRRHGNEPREHCCCHDEIDAEYS

SEQ ID NO: 107192 - protein, 153 aa, Triticum aestivum
  Clone ID: PAT_TA_1610.pep
LKIRTMAVLVARQGRELQRYSTSTGGRIVVGCIPYRMRDGGDSDGEGELEVLVISSQKGHGMMFPKGGWELDESMDDAARREALEEAGVRGEMGKVLGCWHYQSRRYQTTYEGIMYPLRVTDELQQWPEMASRKRTWVSTASCFFNLAAAKSN

SEQ ID NO: 107193 - protein, 326 aa, Triticum aestivum
  Clone ID: PAT_TA_1611.pep
QLAKDSDDGRSYHLYSPLFKLKTFYFNIKPNITHINFIVTKRQTKEQKDRRRATWTTREEREHKQKSASTGGRIEVRPIPNRPRAGGDSASERARLSAGEQLSRFCTGAWCLPAFPRGGRSRVGAARRPALEEAGGLEGNYQVLTCPHYHRPPQSYHLRASSRHPPRHRRDPAVARAAPRRRRPGGPAPARPGAPAALDPGRPSGSTAPGMTSRSAPMAGARRAGGVTGSSSARDSRREEAGSEHQRPSVVLVVSLFFFPRCSGRPAGVSGWRYDDRNREHIFGRPCRAETDWDPPMARARRRFRGGAESVVVVVAANNGDELRNV

SEQ ID NO: 107194 - protein, 202 aa, Triticum aestivum
  Clone ID: PAT_TA_1612.pep
MLYFDNAHKGMRRQAHRSPSRLPATRSPPPPPAPRRRRTPPATVPGRPLPPCRPAQDRPWQRTRTPTRLQAWSSRPGPSPLHPYGQSRAEYSDGSGYGLVANSVDRSRARGRLPRQRNADEGFRGAQVRRLGLQPGVGGRLHAHLQQGGRRRAPRPRHRGSARTTSPMATAAGSTTTATSPRVAGALGGASRGGSTDDDGEK

SEQ ID NO: 107195 - protein, 105 aa, Triticum aestivum
  Clone ID: PAT_TA_1613.pep
TRPLCPLSLMSFSSDLSGGGDARIRQRFHHSVHLFLPPLHHHPHIAADFPFGGGPVAPMLSPSCRWRHILFVPKRSVRSPLTSLLWCHRPNPYAAPSSPLPWLQI

SEQ ID NO: 107196 - protein, 186 aa, Triticum aestivum
  Clone ID: PAT_TA_1614.pep
SIEQDSSDEGKKKSKSHGARTTTRRPPSAPHPADKTPPGATYPYDASRRTPDALVAGSARGGFSRPTPAPASPASFPGRQVGAADRAGTSASRARARCSRRGSQCAHGSRTPRGPPPRSPPCTPRTPCRPRSAPRTRPAAAATPAPPPARRGRRRRGRGRPGRTPRRRGRRRGGSGRGWRRGGTSP

SEQ ID NO: 107197 - protein, 279 aa, Triticum aestivum
  unsure (1)..(279): unsure at all Xaa locations
  Clone ID: PAT_TA_1615.pep
VKGHGISESLMTEVRDITRKFFHLPREEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDAFEGGVAGDAFWVLRLIGYPISDDIPQEERTDIGCGAHTDYGLLTLVNQDDDIXALEVRTQSGEWIYAKPVPGTFVCNIGDMLKVWSNGIYQPTLHRVVNNSPRYRVSVAFFHESKLHAAVEPVEFSREKTGGVAKYEKVVYGEHLVQKVLTNFVM

SEQ ID NO: 107198 - protein, 330 aa, Triticum aestivum
  unsure (1)..(330): unsure at all Xaa locations
  Clone ID: PAT_TA_1616.pep
MGSDFKAIPLIDISPLVEKIDDPAMAGDEGLLDVVRMLDDACREAGFFYVKGHGISESLMTEVRDVTRKFFQLPREEKLKIKMTPXSGYRGYQXRVGENVTKGKPDMHEAIDCYTPIXQGRYGDLAKPMEGSNLWPDYPSNFDALLENYISLLRDLSRKIMRGIALALGAPLDAFEGGCGGRCFLGSPVSDDIPQEERTDIGCRTIQICGAHTXLNQDDEILLVRSEXALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 107199 - protein, 86 aa, Triticum aestivum
  Clone ID: PAT_TA_1617.pep
MGSSSSNAREAPAAAPPPPPPAPPGPLHAMDADEDDESVKQLDECAALYLSLQNCLAESDRNWKACQAHVQALKACEASRNKNQKT

SEQ ID NO: 107200 - protein, 68 aa, Triticum aestivum
  Clone ID: PAT_TA_1618.pep
LMMLASGGCRSAVVGLVDEGEGSCQQESSGEVSQKHQKATGDLSFFSPFMVAAVWVSRKKEEEARGKT

SEQ ID NO: 107201 - protein, 110 aa, Triticum aestivum
  unsure (1)..(110): unsure at all Xaa locations
  Clone ID: PAT_TA_1619.pep
MADSGGVSANNAAAGNDDEEGNTAPXSPETVQIGGSPEYRVERKLRQRXALGHVFVGRRLTGGNRPPAARLLXXLXSKFEAQHQAKXAANYXPXHTEVAMXIPGSWGVLM

SEQ ID NO: 107202 - protein, 296 aa, Triticum aestivum
  Clone ID: PAT_TA_1620.pep
MARLLLVVLALHLTAARAFAASSVGGRNGDFDPSRVVQLSWHPRAFLHKGFLSDAECDHMIELAKDKLEKSMVADNESGKSVQSEVRTSSGMFLEKRQDEVVARIEERIAAWTFLPSENGESIQILHYKNGEKYEPHYDYFHDKNNQALGGHRIATVLMYLSNIEKGGETIFPNAEGKLTQHKDETASECAKNGYAVKPVKGNALLFFSLHPDATTDPDSLHGSCPVIEGQKWSATKWIHVRSFENSGKQGGGCEDENVLCSQWAAVGECAKNPNYMVGTKEAPGFCRKSCNVCAQ

SEQ ID NO: 107203 - protein, 163 aa, Triticum aestivum
  Clone ID: PAT_TA_1621.pep
MEEVQAAVTAHLDQVSGLVQALSSELRSGIGPAADSLLAFVRAVDWTEPWLMCLMAFHAGLLLTAVGLRRNANLQFFFLFLAYSGVYLAEKINIYLAEHWKIFASRNYFDRAGVFISVVWSGPLVFISIVTVVSSLITLCQLMVKWKRAELRHRARLARDKEE

SEQ ID NO: 107204 - protein, 120 aa, Triticum aestivum
  Clone ID: PAT_TA_1622.pep
GCMPLLVRRLEAKSNGAREVAAQATATLMSCPANARDVKKDEKSVPNLVQLLDPSPGNTAKKYAISCLLALSASKRCKKLMIAQGAIGYLKKLSEMDVAGAKKLLEKLERGKLRTLFTRK

SEQ ID NO: 107205 - protein, 223 aa, Triticum aestivum
  unsure (1)..(223): unsure at all Xaa locations
  Clone ID: PAT_TA_1623.pep
MATRIQFENNCEVGVFSKLTNAYCLVAIGGSENFYSTFESELADVIPVVKTSIGGTRIIGRLCVGNKNGLLLPHTTTDQELQHLRNCIPDQVVVQRIDERLSALGNCISCNDHVALTHPDLDKATEELIADVLGVEVFRQSIAGHIXFDATSHSLQVPHVAGNXKLGSEVIAAGMTVNDWTAFCGSDTTATELSVIESVFKLREGQPTAIVDDMRKSLIDSYV

SEQ ID NO: 107206 - protein, 223 aa, Triticum aestivum
  unsure (1)..(223): unsure at all Xaa locations
  Clone ID: PAT_TA_1624.pep
MATRIQFENNCEVGVFSKLTNAYCLVAIGGSXENFYSTFESELANVIPVLNHTISVPSKKDLVASPLEKECTGPXLLATHNPLDQDIQHLRNCIPDQVVVERIDEGLSAVGNCISCNDHVALTHXDLDKATEELIADVLXGVEVFRQTIAGNILVGSYCAFSNRGGLVHPHTSIEDLDELSTLLQVXLVAGTREPWLARSIAAGMTVNDWIALCGSETTATEM

SEQ ID NO: 107207 - protein, 73 aa, Triticum aestivum
  Clone ID: PAT_TA_1625.pep
KDLDPFPSCSIVVWDGPVHPPLFDLDAGRPHAAGNTVVLTPLNPTRYTVQSTLSVIFYPKQYDLTQQWTAIES

SEQ ID NO: 107208 - protein, 186 aa, Triticum aestivum
  Clone ID: PAT_TA_1626.pep
ELEGNSALPPVPDKTLCDCMVKSRSCVPADNLKAKDFNEIFGYICGQNKKICTAINANATAGIYGAYSMCDNESKLAYILDAYYKDQNSNADACDFKGKATTQKAQNQDSCKTKLESADKTNEEVATATAAAGAASTDGSDSSSKDDDESFGLESATIARAFSVGNYAVGAYMAVAGVVGAGMVLL

SEQ ID NO: 107209 - protein, 105 aa, Triticum aestivum
  Clone ID: PAT_TA_1627.pep
ALSSVPCSVRSSRPSCCRRYWREQSVDLGTVAVHPSLGVRNLQAVVLDRVGVAPQQISASLARPRSQCRVLLDEGADLAAAIARKGVVVAVICGKGGRVEVGGGG

SEQ ID NO: 107210 - protein, 381 aa, Triticum aestivum
  unsure (1)..(381): unsure at all Xaa locations
  Clone ID: PAT_TA_1628.pep
MPPHPAPRCLARRRRGSPAPAGAGAPTPFPPPPSLSCRLTLQIMSQAAPGGLEPAEWSEVLARRDLVSTPAAVSGTGAARDSPAVAALKGNIAAPFNVLQGFLLACHGSTGRAGRRRRRHSAGTPSGVGDASFPLVQGSXSAYGSGRSALGSQSCPPAPGCCGGRHVLGVETLQETIGAAFNLLQAHLLACHGSMVGAGTTLPIGNSDAAKAGKYSNGDAAMSFSDKDESFSDLEEDEGFTEEEIAVAKLIIAVTADSLDAVKETIRFITSLLKSSGNQSGAAEDKVESMENLLSHCRDVADQVNELGASVYAQDPSEMKSAIKRLYVGITGMCQEIAGLGGSPKNAYAAFSGFEKSLKALEEEIGEDVVDEMKNLTISPS

SEQ ID NO: 107211 - protein, 127 aa, Triticum aestivum
  Clone ID: PAT_TA_1629.pep
TRPRKTREKRRELGLAITHLHGDLQEQHRRDDLARPRCHARGPLHMLPRRRGGEMLSAYLGAGLQPEAVPEAVRGEVESTLLHGVGRRAAHGGNRLLLLSPQAREDCSCCLVDFVGTMKKSIIEEFF

SEQ ID NO: 107212 - protein, 130 aa, Triticum aestivum
  Clone ID: PAT_TA_1630.pep
IKAKQPITLGNNGSRSRRCGAPARRRRGSGTIRLRWPRGRSYRWRGNCHSGRWQLRYRPPALPGSRETREGCRQRCRPFRGQWRPRHRPPALPRNRVGREEGLIWATPLQHGLGGQVLNNGQTTNMYCRS

SEQ ID NO: 107213 - protein, 326 aa, Triticum aestivum
  unsure (1)..(326): unsure at all Xaa locations
  Clone ID: PAT_TA_1631.pep
MAAPIPREWVGLQQFPAATQTKLHELLGKLKEENVSTLTILVMGKGGVGKSSTVNSIVGERVANVSAFQSEGLRPMMCSRTRAGFTLNIIDTPGLIEGGYINEXASEIIKEFFLGKKTNVRPSFERESTCRIYRKDEQVIRNITNSLGNPIWRRTLVVLTHAQLSPPDGIDYNDFLARSFASLLRYIRSGAGIGKREYADFPLPIALAENSGRCKTNENGAKILPDGTPWIPNLMKEITIVVSNGSQSIHVDQKLIDGPNPNNRWKKYIPLILAVQYFFVVKGIRRAIHSDISNGKLDDWEQRYRDLVGSGNPVDQKVSSSRNPKA

SEQ ID NO: 107214 - protein, 211 aa, Triticum aestivum
  Clone ID: PAT_TA_1632.pep
IGAPLLTVRPQETRVDPLVKNRALECQDMEMSEESGATSKYNDDGQIDDSLQSIQKIRDEILRKESILQERSAQCDMDIQTLLSEGKMTPKAVSIIRKYKETCSDMTEVTNSSCSGDGGQSITKRKKLKEALLRQCKELDEICRGAHWILPRYTVLPSVSDGMYHASVRLRCPDFEMSLTGGLRPTPHEAKCSAAANMILELHKKAEEQEQ

SEQ ID NO: 107215 - protein, 100 aa, Triticum aestivum
  Clone ID: PAT_TA_1633.pep
MDAYVRAGMETSAIARIDPQLLRRVVVARSPATTEEAPAAPSPMTVFYNGSVAIFDVSHHKAEAIMQMARDVTMAERRDLGNNTPVGNSSKDIPLARTKS

SEQ ID NO: 107216 - protein, 110 aa, Triticum aestivum
  Clone ID: PAT_TA_1634.pep
MNRRPIVLVFLLLVLIISSQFEWKQQIGEAEASPEATRRRQQPQVVREDAVKEKIILAQEKNIQQLTELIQSLQVQLLHCRGSNSTAHGASSNQSSASYAEADRHQIIDD

SEQ ID NO: 107217 - protein, 156 aa, Triticum aestivum
  Clone ID: PAT_TA_1635.pep
GWQPAAEADLIRGCPARRGGSPELRPGRPSDSAARLCDGLWLLTAVINSSPIVLVFLLLVLIISSQFEWEQQIGEAEASPEATRRRQQPQIVREDAVKEKITLAQEKNLQQLTELIQCLQVQLLHCRGSNSTAHGASSNQCSASYTSADRHQITDD

SEQ ID NO: 107218 - protein, 77 aa, Triticum aestivum
  Clone ID: PAT_TA_1636.pep
ERGPLVQSPRPHAEPLPPSISLPRQPSQQRPRTLAPSHSPPLLPLPHHCREFSKGYHGSMSIWRVQGREGRHRRPIA

SEQ ID NO: 107219 - protein, 209 aa, Triticum aestivum
  unsure (1)..(209): unsure at all Xaa locations
  Clone ID: PAT_TA_1637.pep
GLRQTRGXFGLGAKMALIWSKMSTGLPIDIKSSMKGQDYITFCRLDIDIHKNVPHIHLHEKRENNDHWHGAEIQVIIEGNWTTHRSRRLRHERQMAVXTPYAQFLFRFLSDAAEKNLTIKFARRTDVMPPVPLLTKHHPSAVDLLLIKRLITDTTKPNLLQFLQHEFVNISKAHADRLIGEMGRGVRGRAPGNRRRPRQWGRQDENQIT

SEQ ID NO: 107220 - protein, 182 aa, Triticum aestivum
  unsure (1)..(182): unsure at all Xaa locations
  Clone ID: PAT_TA_1638.pep
MVSLKLLKRLAASVLKCGKGKVWLDPNEVSELSMANSRHKIRKLVKDGFIIKEASGSYTPRSQCKEGDNTRSKKGPHSXYGKRRGTKEIKLPTKLLWMRXRMPVLRRLLRKYREGKKMNKQKXQDMHMKFKAKRFKNKTILEKNIHKSKAESAREKTLLRKRSASRSYTTRSGKRKSKEVKT

SEQ ID NO: 107221 - protein, 177 aa, Triticum aestivum
  Clone ID: PAT_TA_1639.pep
VFLFSFESSSDKLSLATGRELLFSAFFLTSASPLLEELSPGAGSEARAIGALRGLWRCDLVTAGERLRLRGGPLACMSSGCDFMSSDGEVASPPTSSGGLITSLSPESATSANSSLSGLSLGRNFWLAPSSTPHAPMASATSDTASISHYHLKQDSRLLSGSSEISKEQRLPGAIPS

SEQ ID NO: 107222 - protein, 126 aa, Triticum aestivum
  Clone ID: PAT_TA_1640.pep
MDGKNLGSGQLAQQAKPDALTDDQGTLKHTADSHTENPTSVNGQSSVDMNMEAAISADDVMRAGGFGAKDDIGSLLPTAMDSTDFEASLRDARDFEGEQEQPARPGLGYRASEADAGIKPSDTPQQ

SEQ ID NO: 107223 - protein, 76 aa, Triticum aestivum
  Clone ID: PAT_TA_1641.pep
GAPSHCVCWSSRSSCTLLPHLFPDESIVLIQRARLSAVNSWTDPVQGMRFVSFAGTCHGMLPGFFGAEICISAFAS

SEQ ID NO: 107224 - protein, 226 aa, Triticum aestivum
  Clone ID: PAT_TA_1642.pep
MASSLTLILALLLAIAATTDAITVHLLNKCPYTVWPGAYPVGGGSRLDTGQAATIQVPPGTAAGRIWGRTGCNFDASGRGSCTTGDCGGVLACAAGGRPPATLAEYTLGKGGSPDFYDISLVDGFNVPMSFGPAGGGFHAISCAADINANCPSELKVDGGCVSACVKFGAPQYCCMPPLTPSTCGPTDYSRFFKGHCPDAYSYAYDDKSSTFTCPVGSDYQVTFCP

SEQ ID NO: 107225 - protein, 157 aa, Triticum aestivum
  Clone ID: PAT_TA_1643.pep
MASQAIEEHRSGADVHTELCEARAREFLVELGLPDGLLPLPSLVEVGYNRATGFVWLRQGQSGGLTHTFNAIGKQVWYAPEVTAVVERGRMHSMTGVKSKELLIWVTISEIVISPSGSKIVFRTPAGLGRAFPVSAFQLSPPATEGDAKAAEEAAAN

SEQ ID NO: 107226 - protein, 157 aa, Triticum aestivum
  Clone ID: PAT_TA_1644.pep
MASQAIEEHRSGADVHTELCEARAREFLVELGLPDGLLPLPSLVEVGYNRATGFVWLRQGQSGGLTHTFDAIGKQVWYAPEVTAVVERGRMHSMTGVKSKELLIWVTISEIVISPSGSKIVFRTPAGLGRAFPVSAFQLSPPAPEGEAKAAEEAAAN

SEQ ID NO: 107227 - protein, 136 aa, Triticum aestivum; identical to SEQ ID NO: 106789
  Clone ID: PAT_TA_1645.pep

SEQ ID NO: 107228 - protein, 224 aa, Triticum aestivum
  Clone ID: PAT_TA_1646.pep
MAAEASSSSAFSEDDSLLRPLAARGWRFRDAADESIQALLHAPPSPSPEALEADLLDTDLRLFGGKSLPDRAAATATKRLFYLHGPIVLQVVSVRDIYSSRVDASFKNPQPRRLLRFGLTDGISEAVAIEFSPIPFITEEIAPGTKIRLENKIPVNHGILCLGAKNVSIIGGSVQSLYEEWKMNQKFSGLSLPVLRLSQDDDGVGPPPFEKLDMEARPNRTFQL

SEQ ID NO: 107229 - protein, 187 aa, Triticum aestivum
  unsure (1)..(187): unsure at all Xaa locations
  Clone ID: PAT_TA_1647.pep
TTSVLLTWTLVVLGMHPEWQDRAREEVLSVFGKDKPNFDGLGRLKTVTMILYEVLRLYPPAVTLNRKTSRQMQIGGITYPAGVLLELPIIMVHHNPDVWGKDVLEFKPERFAEGISKATKDQPVFFPFGWGPRICIGQNFAMLEXKMALSMILQRFEFQLSXSYTHAPYTVITLHXQHXAQIILKSL

SEQ ID NO: 107230 - protein, 259 aa, Triticum aestivum
  Clone ID: PAT_TA_1648.pep
FSIQQPTENMAGDDGEHTRFPCLGWVRTSVAIVVTVLVLVLVVMAITDVGRPEKISLSSYGYVQTQQRWWNDSMTTTTGRTTTTKSRRLPAEGPEPELMPATLLTILVIVFAYNPSGRGSILCNITTISIIDMPYDDFTGMVEVHRVYSPKMPLKFSVPPQTWHRDRRSVNITEKNDNGVLSYLFAEHRQQEKFRVMVQVNTTYKAQHSAASVNVSHYCWPVFFVYLSPYVDGDQIPCKTSQEMGYSFSWQPLPDGADG

SEQ ID NO: 107231 - protein, 178 aa, Triticum aestivum
  Clone ID: PAT_TA_1649.pep
WGSRPKPPTFFQPIPHSPEAASDGPQAEKKPAAKKPAEEEPATEKAPAAKKPKAEKRLPAGKTASKEGAGGEAKTRGRKKGSKAKKGVETYKIYIFKVLKQVHPDVGISSKAMSIMNSFINDIFEKLAAEAAKLARYNKKPTITSREIQTSVRLVLPGELAKHAVSEGTKAVTKFTSS

SEQ ID NO: 107232 - protein, 315 aa, Triticum aestivum
  Clone ID: PAT_TA_1650.pep
RKLASMKAGYTQKTASPFADMLAFRKVKARLGGRLRLLISGGAPLSTEIEEFMRVTSCAYFIQGYGLTETLGPSTVGYPDDMSLVGTAGVAAIFTELRLEEVPEMGYDPLGVPSRGEILIRGSTVFTGYYKNPELTNEVMVDGWFHTGDIGEMTPDGILKVIDRKKNIFKLSQGEYVAVEYLEKVYVFPPIIEDIWVYGDSYKSMLVAVVNPHEENTMKWAGSNGYKGSFSEICKSEGLKEHVLKELAAAAQKNKLRGFEYIKGVVLDPVPFDIERDLVTATMKKRRNYMLKYYQPEIDKVYKTLEGQRAANKAK

SEQ ID NO: 107233 - protein, 643 aa, Triticum aestivum
  unsure (1)..(643): unsure at all Xaa locations
  Clone ID: PAT_TA_1651.pep
MAAAAANLAGRPGVRVVVIGDPGTGKSSLVVAVATEQFPENVPKVMPHTRLPADYFPDRVPITIVDTSSSPEQKPKLIAECQAADAVVLTYACDRLSTLDRLSSYWLPELIRIQLKAPVIVVGCKLDLRDDQQNSLEQTMAPIMQAFREXIETCIECSALRQIQVPEVFYYAQKAVLHPTAPLFDQEAPAREPRCVRALKRIFILCDHDRDGALSDVELNDFQVRCFSAPLQPTEISGVKRVVQEKMPEGVNDSGLTLTGFLFLHALFIEKGRLETTWTVLRKFGYDNEIKLRDDFIPTSVKRAPDQTVELTNEVIDYLKGIFNMFDIDNDEALLPSELDDLFSTAPENPWTSDLYKDCAERNVLGGLSLEGFLSKWALMTLLDPANSFANLVYVGYSGDFNSAFTITRKRRVDRKKQQTQRNVFQCYVFGPKGSGKTALLQSFLXGNLLMLCQLTATGLRQILLNHLXGTRKTLVLREIPEGDVRSLLNNKESLAPCDAAVFVYDSCDEFSWQRARDLLVQVASHGENTGYEVPCLIVAAKDDLDQSPVALQESTRVSQDMGIETPIPISVKLKDLNSIFCRIVHAAQRPHLSIPETEAGKSRRQYRQLLNRSLMVVSVGAAIGVVGVAAYRVYAARRNSSS

SEQ ID NO: 107234 - protein, 251 aa, Triticum aestivum
  Clone ID: PAT_TA_1652.pep
MSDTPAAPAESVSPSSESPAVPRRDVSPETPQVTQNEFIAVDNEHNAADDDDADSALGSDTESSTASVSASILEYRRSQGRTYHSDKFTTNYFLPNDDQQLEPVDLTHHYLMILLDDQLFLPPLNTEKLKKVLDVGTGTGIWAIEFADRFPNVEIVGTDLSPCQPEWVPPNVRFEIDDAVLSWTWEPNEFDFIHIRYLFGAIKDWSALFKEACRCVIPGGWVQSAEADVEFRCDDGSIELEPNLKMYKKLF

SEQ ID NO: 107235 - protein, 353 aa, Triticum aestivum
  Clone ID: PAT_TA_1653.pep
MGKEGTRRGQDVRRRKGKEAAKDEDDEAPPTGCWIRLPRLGGGCMSSGSKVDSSTSGACANGGESKKVNHSCRDQSAPPAASGSTTSSNTGSISPSSIVGEELKLAAQLRGFTFNELKCATRNFRPESLLGEGGFGCVFKGWIEENGTAPMKPGTGLTVAVKTLNHDGLQGHKEWVAEVDFLGNLQHSHLVKLVGYCIEDDQRLLVYEFMPRGSLENHLFRRSFPLPWAIRMKIALCAAKGLAFLHEEAERPVIYRDFKTSNILLDAEYNAKLSDFGLAKDGPEGDKTHVSTRVMGTYGYAAPEYVMTGHLTSKSDVYSFGVVLLEMMSGRRSMDKNRPNGEHNLVEWARPYL

SEQ ID NO: 107236 - protein, 129 aa, Triticum aestivum
  Clone ID: PAT_TA_1654.pep
MAGAERERRKMPLPPALPLATLIGRELRAGGSERPALRYGHAGFAKRGEDYFLVKPDCLRVPGDPSTAFSVFAVFDGHNGVSAAVFSKEHLLEHVMSALPPDIGSREDWLQALPRALVAGFVKADIDFQ

SEQ ID NO: 107237 - protein, 239 aa, Triticum aestivum
  unsure (1)..(239): unsure at all Xaa locations
  Clone ID: PAT_TA_1655.pep
GRPPSPFHSPWPLWSRRAPSPPIRTPWRWTRPPCRYTRPSTWPPXPRHGHRAAAPGDHAPTVASPSAPPAHAGEEIPGPMLAAPTRIPPPPPAPTDEPGFFVFVPFPNGAGGTIQAAGPTPVAQPEDXTPARVAAPPSTRTPPPPCWTRHRHPRARSPDRASRTPQAWRDAAASSVAPSPPSTAVKAATPALPPICRTASLPASSTSPRPRKKEARRRPLCEKQQWSVGSGGAQDSFLN

SEQ ID NO: 107238 - protein, 205 aa, Triticum aestivum
  Clone ID: PAT_TA_1656.pep
LRRAVHRPRRFGRRGAGKGHHAALRGPGRGLRAPGHGHRAAARGDHAPTVAGSACVGDGNPEPRLAAPFRIPPPPPAPADEPGFFVFVPFPNGASVASQGAGPTLVAPPADEDAGPSRVAVEPPGADNTVPDEAPPPPRTVARPRLLDSASMDGRRRLFGRAITAIDRRASRRSGLASDLPNGVPAGVVYISSSEEEGGTSATTL

SEQ ID NO: 107239 - protein, 130 aa, Triticum aestivum
  Clone ID: PAT_TA_1657.pep
LSHVAALLLRRCRLAFSSALPLPLARILSATLEPKLVVLARSSRSVRNVCTAALSCSTTAATDASAPRRHRPARRSAILDAAGIPSLLRVRRHLLPGHPGSRAPHARPARCTVAKNCSTAGVDWKGCCCS

SEQ ID NO: 107240 - protein, 323 aa, Triticum aestivum
  Clone ID: PAT_TA_1658.pep
SGALPSLYSAIQQCTSLNSLSGFWDSPRWITPIIHYICKTLTCLNLSYAPMFRTVDLIGTIHQCQNLRHLWVLDHIGDAGLKVVASSCLELQELRIFPANANVLASTGVTEEGLVAVSSGCRKLNSVLYSCSRMTNSALITVAKNCSRITSFRLHICLHGSVDAVTGQPLDEGFGAIVRSCKGLRRLSMSGLLTDSVFLYIGMYAERLETLSVAFAGDSDDGMIYVLNGCKNLRKLEIRNCPFGNSALLAGTHRYEAMRSLWMSSCDITLGGCRSLAAAMPGLNVEVISQADGGANDAKVEKLYVYRTLAGPRDDAPGFVSAL

SEQ ID NO: 107241 - protein, 145 aa, Triticum aestivum
  Clone ID: PAT_TA_1659.pep
MAAANQSLAVEDGTGTGSGAGGQEYTQDGSVDLRGNPVLRSKRGGWTACTFIVVYELFERMAYYGIAANLFIYLTDKMHQGTVEASNNVTNWSGTVFLTPLLGAYVADAYLGRYWTFVVGSAIYLMVAIPSYNPPILHVHGNTDT

SEQ ID NO: 107242 - protein, 161 aa, Triticum aestivum
  Clone ID: PAT_TA_1660.pep
MTSSSTPSRKALSKIACNRLQKELAEWQVGPPAGFKYKVSDNLQRWVIEVGGAEGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDKV

SEQ ID NO: 107243 - protein, 73 aa, Triticum aestivum
  Clone ID: PAT_TA_1661.pep
FLRFRSFFFLTFRVLCSDTHCTLILLSPKYSMATYFDPNRDSKIDYTNIKKVLDDVLPGYAKSGGTFTRPVRR

SEQ ID NO: 107244 - protein, 212 aa, Triticum aestivum
  Clone ID: PAT_TA_1662.pep
DTNPQTRPPVVPAPSHGKNAATLLDMPDIPMAQDPDMHMAQDPDDDDNDDGTFTNVDKYFAEHGYGDEFCGPPSQEPNPEKDDRDLAGTAEKPNCNRRRLAFSSQEMPPAAAFTEPQIAEVRNIISPNTLKRVVSEQNSIPLHQKKKGWKRKNNKGASQPAPSTIRAQDGPPSSKDISRRVHVAGRPMLPTNLLNAATGAMRSLHDSVLFLE

SEQ ID NO: 107245 - protein, 137 aa, Triticum aestivum
  Clone ID: PAT_TA_1663.pep
STRPLLRRRTMTDAKQRTDVLLRQAATWRSEGCLLRHPSHAGDRTGPSSTSATEYTHRLGRERVGNQDADLRQEFFRIQSEFADIIHQDVLHTLGQFYLRYQPSNNEIDGTLQMQGDNDCDFMTITTDGGFIHAPVR

SEQ ID NO: 107246 - protein, 84 aa, Triticum aestivum
  Clone ID: PAT_TA_1664.pep
GCEYVTDKGKVPGVYDDWEECRRQVHRFSGNSYKGYTTRAEAESRYARYLAGEGRERWRNRMKTSFIVMMLIVMTAALFYVMVV

SEQ ID NO: 107247 - protein, 148 aa, Triticum aestivum
  Clone ID: PAT_TA_1665.pep
KTRKGKTKKGASQPAPSTIRAQDGPPSPQDISRRVHVAGRAMLPPNMLNAATGAMRSLHDSVLSLEKRRLREKDVAYPVFVAKVPEGKGFVDGDIGGTIVLRFDDVFAMFNLHPLHYIFVRLFSLSMEMRIIRDKTPDIVIVGPGFLD

SEQ ID NO: 107248 - protein, 105 aa, Triticum aestivum
  Clone ID: PAT_TA_1666.pep
ISIVVLLTFRVFCSDTHCTLILLSPKYSMATYFDPDRQSNVDYTNVKKVLDDVLPGYAKSGGTFTKPNPKYGTHMVSRHTTMRFVLRMGHVHRRISRGGCMWRVG

SEQ ID NO: 107249 - protein, 217 aa, Triticum aestivum
  Clone ID: PAT_TA_1667.pep
MAAVKRAYLAVYNWAVFFGWAQVLYFAVEALLRSGHEDVYAAVERPLQLAQTAAVLEILHGLVGLVRSPVSATLPQIGSRLFVTWGILWSFPETRTHILVSSLVISWSITEIIRYSFFGTKELFGSAPSSLLWLRYSSFLVMYPTGISSEVGLIYIALQFIKASEKYCIRMPNKWNYSFDYFYASILVLLVYVPGSPHMYTYMLGQRKKALAKSKTA

SEQ ID NO: 107250 - protein, 217 aa, Triticum aestivum
  Clone ID: PAT_TA_1668.pep
MAAVKRAYLAAYNWAVFFGWAQVLYFAVEALLRSGHEAVYAAVERPLQLAQTAAVLEVLHGLVGLVRSPVSATLPQIGSRLFVTWGILWSFPETRTHILVSSLVISWSVTEIIRYSFFGTKELFGSAPSSLLWLRYSSFLVMYPTGISSEVGLIYIALQFIKASEKYCIRMPNKWNYSFDYFYASILVLLVYVPGSPHMYTYMLGQRKKALAKSKTA

SEQ ID NO: 107251 - protein, 199 aa, Triticum aestivum
  Clone ID: PAT_TA_1669.pep
ISIVFLLTFRVFCSDTHCTLILLSPKYSMATYFDPDRQSNVDYTNVKKVLDDVLPGYVKSGGTFTRPIRKYGKHVFSHNTTFCCVKQPPGGQKGAYYAIHHMRAIVRDHHQLLLPSKLKDWAASVSAVQDADIRQEFFRIQSEFAEIIHQDVLRTSGQFCLRNQPSNSDIDTMLQMQPDNARYFMTPTIDGGFIHAPVP

SEQ ID NO: 107252 - protein, 129 aa, Triticum aestivum
  Clone ID: PAT_TA_1670.pep
VRQARVLPHMTFCCVKQPPGGQKGAYYAIHHMRAIVRDHHQLLLPSKLKDWAASVSAIQDADIRQEFFRIQSEFAEIIHQDVLRTSGQFYLRNQPSNSDIDTMLQTQADNDRYFMTPTIDGGFIHAPVP

SEQ ID NO: 107253 - protein, 204 aa, Triticum aestivum
  Clone ID: PAT_TA_1671.pep
HMNSYISIVFLLTFRVFCSDTRCTLILLSPKYSMATYFDPDRQSNVDYTNVKKVLDDVLPGYAKSGGTFTRPIRKYGKHVFSHNTTFCCVKQPPGGQKGAYYAIHHMRAIVRDHHQLLLPSKLQDWAASVSAIQDADLRQEFFRIQSEFAEIIHQDVLRTSGQFYLRNQPSNSDIDTMLQMQDDNARSFITPTIDGGFIHAPVP

SEQ ID NO: 107254 - protein, 93 aa, Triticum aestivum
  Clone ID: PAT_TA_1672.pep
PSAAFRGRHSPTRGAIACPPSPPPPPPPPSPQPPRLPLAPRSGPPSPPRPAPSARFQPRCAAPPQPRRRGRPHGPPASQLPSWLPCRRSPASS

SEQ ID NO: 107255 - protein, 87 aa, Triticum aestivum
  Clone ID: PAT_TA_1673.pep
MACWRKKVVFRARRAWAAVSGRLLRGSKSGSGGILKLHEDVQTCGYQDVQVMFDMLTSELEAAHARNRKQPASPLPAWSSRLSLSSA

SEQ ID NO: 107256 - protein, 287 aa, Triticum aestivum
  unsure (1)..(287): unsure at all Xaa locations
  Clone ID: PAT_TA_1674.pep
MAPVRAALLAFLVAALLPLALSRGQGRGPHLPGHGLVHRHGPGIGHHAQPRGGGGGWAPERATFYGGGRASGTMGGECGRGNLYITGYGSNTAPLNPALFNNGLSLGPCCVVRCDPRGTQPGAPRACLPRAPLVTATNFCPPNFGESSDARGWCHPPRAHFHISRPVLQRIAPXRAASVPVSYRRVACQKKGGIRFTINGHSYFNLVLVTNVGGPGDVHAVSVKSTRSARWQSLSRNWGQNWQSNALLPGQGLSFRVTAGNVQSVISNNAVPRGWSFGQTFSGAQFH

SEQ ID NO: 107257 - protein, 99 aa, Triticum aestivum
  Clone ID: PAT_TA_1675.pep
SVYHHQFTHQKSCEKFSCSVTYSIPFANKISTSEVHAPAVDNVSFACKAETAYASRFGNDVVQQIVGLVQSSNAAKPQTFQDWSESLVSRFILDLQCPV

SEQ ID NO: 107258 - protein, 207 aa, Triticum aestivum
  unsure (1)..(207): unsure at all Xaa locations
  Clone ID: PAT_TA_1676.pep
MNRWPGRVGGRVGAFMASADMPAFPWGAAATPPPPAAVPQQPAFNQDTLQQRLQAIIEGSRETWTYAIFWQSSTDAGASLLGWGDGYYKGCDDADKRRQQPTPASAAEQEHRKRVLRELNSLIAGGGAAAPDDAVAQVPPDPGGGPLRPTTPPSQRGRRAPKGLARLPTGQSFPNXIGXXPGEGXFSGKPTXFPXGVXXXPCEXAKK

SEQ ID NO: 107259 - protein, 191 aa, Triticum aestivum
  Clone ID: PAT_TA_1677.pep
LSFRYAKACGLSSIVDKDKSQSALEKIYTFNVMKFKDGNRGAINGMWPDGTLDMSTMQSREIWPGVTYALAASMIQEGMVEEGFKTAEGVYHAAWSSEGLGYAFQTPESWNNDDEYRSLCYMRPLAIWAIQWALSNPKLHKEPQTDITQDSFPKNQFSYARIAKLLQLPEDESSKSVPRVIYEIVRNRFTS

SEQ ID NO: 107260 - protein, 132 aa, Triticum aestivum
  Clone ID: PAT_TA_1678.pep
SSIPPTTRFAPLSSLPLTTVASPSTPTPSPLEPRTRKQTRPRDPETWDLGFVGAETTARPSRTPTAYGGGREGGRGGAQLRGVGLLREEVGGGGRRRRRTNQDGGGLPQSRLIKRQRHTKPSPAGTDSSRVR

SEQ ID NO: 107261 - protein, 218 aa, Triticum aestivum
  Clone ID: PAT_TA_1679.pep
MGAAESSSKLGGSVHDFVVKDVRGSDVELSRYKGKVLLIVNVASRCGLANSNYTELGQLYEKYREKGLEILAFPCNQFAGQEPDSDEKIVEFACNRFQAEFPIFRKVDVNGNNAALLYKFLKSERGGLFGERIKWNFTKFLVDKEGHVMNRYAPTWSPLGIENDIKKLLAGLRYLQGRSCGGVSCVCVICSFRYCMCVHTCSIKSNPSLLYATLISTR

SEQ ID NO: 107262 - protein, 56 aa, Triticum aestivum
  Clone ID: PAT_TA_1680.pep
THRNMYDFLGWAAANLEWKLLHKVAKDKEGFLQREIVRGAFDGSLFERLQESKKST

SEQ ID NO: 107263 - protein, 319 aa, Triticum aestivum
  Clone ID: PAT_TA_1681.pep
MLLHLVLTYPTQPGWMPSPLLSIHIKNIHWGKRASDSESSDGKGAMAPAELAVASRTLGKTPPNAFSHNAFLPRPCNNRYLRVTVGSAASNHPWQVMDTVPKGINGVLQLDSVLDDYDDRLFQPRAMAPGSPRIREGTKRSHAKAMSLLQLHAAFYDPHCIGVIYLWETFQSLRAIGLGSPSAFGTSILLHLVLTYPTQPGWMPSPLLSIHIKNIHRGKHGSDSETYDTEGRFEPAKFDAIFSKFGKTRPNALSEDEINAMLKYNRNMYDFLGWAAANLEWKLLHKVAKDNEGFLQREIVRGAFDGSLFERLQESKKST

SEQ ID NO: 107264 - protein, 189 aa, Triticum aestivum
  Clone ID: PAT_TA_1682.pep
MTVMSARPAWSRLNLSVMSCHLSGKRDAEKEAEMREFMASSAVASIPCSSCSASWLPASPAAANSPILPTSSAQLTRRPLPRRQFLPLHRASKKGTRSRTSGGAITSYGMRRRRGSVTTPRVRPRVRDGSTLEGKLDFKVVNGVMEAEAGPVVGPPDVGAAPARTVDAVGLWGNASVRSEDEGLGIASC

SEQ ID NO: 107265 - protein, 120 aa, Triticum aestivum
  Clone ID: PAT_TA_1683.pep
MRIQCDACEGAAATVVCCADEAALCARCDVQIHAANKLASKHQRLPLEDAAAAAGLPRCDVCQDKPAFVFCVDDRALFCRDCDDSIHVQGTLSANHQRYIATGIRVGFSSVCSAHARHPP

SEQ ID NO: 107266 - protein, 260 aa, Triticum aestivum
  Clone ID: PAT_TA_1684.pep
MKIQCDSCGVAAATVVCCADEAALCARCDVEIHSANKLASKHQRLPLDALGAKLPRCDICQEKAAFIFCVEDRALFCRDCDEPIHVPGTLSGNHQRYLATGIRVGLGPASACAAGDHGAGHDADHHAPPKGACEPYPPAQPAARAQQVPSPPQFLPQDWAVDELLQFSDYESNDKLHKDSPLAFKELEWFTADMELFHDHAPKGGRATMEVPEFFASQAADDAAYYRPSRVAATAGLRQSKKARVEIPDDEDFFIVPDLG

SEQ ID NO: 107267 - protein, 287 aa, Triticum aestivum
  unsure (1)..(287): unsure at all Xaa locations
  Clone ID: PAT_TA_1685.pep
QSLLRQAREKGSGGSKIQSDAWGVAAATGVCPADEGARIGRXGVECEAATKLAGRHEGVPPECPGAKLPRCDICQQKAPFIFCVRSRAPPPPPAARAAQVPGTLSAFVFRHGATRVALLPRTATTPSTSTGTLSAQPTKRLPPPPGIRVPPAAPYCHAPTARQSHPAAPPSPRAAAGRPTDAPSRVLRPQRAQRRCRRRRPCRRPARPSRASCRSPTTSPATSPRLARRSRTGPRRAPPRRRTTPPTTGRADPPPNPGLRPEQHGPASRSRTTRTSSSCLIWAKRCS

SEQ ID NO: 107268 - protein, 110 aa, Triticum aestivum
  Clone ID: PAT_TA_1686.pep
PTMAIGLRPSYLCLCTSFLLVVALAGTRPAAAQCEKTVAAVPDWCTKQFFNAASSGAKGDEFITHECCLLLGCVHESNCDSILRSFCPAPDADECPVPPVAPAVSTGAAS

SEQ ID NO: 107269 - protein, 288 aa, Triticum aestivum
  Clone ID: PAT_TA_1687.pep
RKNPSTQRPGCFVVLTSRTLAGEDGEFNAEHREEVRGLLRLFPIWATCIIYAVIFSQSSTFFTKQAATLDRRIGATFRVPPAALQTFISLTIITFIPVYDRLFVPAARRFTRLSSGITMLQRIGTGLVLALVAMVVAALVEARRLGVARDAGLVDDPLGALPMSLWWMVQLHVLLGLSDVFAMIGLQEFFYDQVPDALRSLGLAFFLSIFGVGHFLSSFLISAIDGATKKGGASWFSNNLNRAHLDYFYWLLAGLCAAELAAFVVVSRVYVYKKRVAHHDHGDGGAVM

SEQ ID NO: 107270 - protein, 244 aa, Triticum aestivum
  unsure (1)..(244): unsure at all Xaa locations
  Clone ID: PAT_TA_1688.pep
PTRPNLQNLECCLFVLFPYFSXEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALHSVHELPEGHGKTILTATTAIVVLTVLLIGGSTGTMLEALDVIGDENTSIETYEEINGYIXPNFVGMSVHRTGGRIEMKLXKEFHKSTTSYTALDKY

SEQ ID NO: 107271 - protein, 197 aa, Triticum aestivum
  Clone ID: PAT_TA_1689.pep
MSAVNLTNVAVLNNPTSFVNPFQFEISYECLVALEDDLEWKLIYVGSAEDENYDQQLESVLVGPVNVGTYRFVLEADPPDPSKIREEDIIGVTVLLLTCSYMGQEFIRVGYYVNNDYDDEQLREEPPAKLLIDRVQRNILTDKPRVTKFPINFHPETSGGQQQDQPQSAVPENHTSKGSKAKRRSLTGSGNLGMPKF

SEQ ID NO: 107272 - protein, 209 aa, Triticum aestivum
  Clone ID: PAT_TA_1690.pep
MEGAKKQVFTIKVEDGKPGKDGRPAVGPVFRNILAKDGFPPLDPDMRTSWDVFRTAAGKYPDNRMLGWRPFKDGVPGPYLWKSYKEVYEEVLQIGSALQQLGVQPGSRVGIYGSNCPQWVVAMQACNGYSIICVPLYDTLGAGAVDYIIDHAEIDVVFIQDKKIKEILSPNCTSATRLKALVAFTSATNEQIKAAERIGMLGYSWKKGR

SEQ ID NO: 107273 - protein, 321 aa, Triticum aestivum
  Clone ID: PAT_TA_1691.pep
GRVGGGGGGGGGGGWDDWDDEVRPDMRRNQSAGSFAGPGADSGRQPTRSKSTQDIYTKQELEASAASKEDFFARRMAENGSKPQRVPPSHSGKYVGFGSTPLPSARRKSNPRQEGEAIQVVSQEFGRVSLVAGYSAQSAATVVQVDPKEIQSKMREGGYDQKVNETVNVVPNKTAEIGSRTWGIMKGVMDFATQEVEGFSMEWGVGSGWGDDWQQREQQNNSNAPYRRYEQETSNGNGWNSPQDGSAKNQNRNSNSWDDWDDQDKKDEPAKTSQSSDSWAGWDDSKDDGFDSYSHHSPANKGGSNQNGTAGGSYWADGGFR

SEQ ID NO: 107274 - protein, 97 aa, Triticum aestivum
  Clone ID: PAT_TA_1692.pep
SSRTSLAKLVVKVRAWHTLTVVLLCCAVGSVCTPVRCVRFLAKSWYCVPRHHPTPTCVFYGVGLVSLLAMSCLWWAPYSSHLLVTLLLVRFSARFSL

SEQ ID NO: 107275 - protein, 220 aa, Triticum aestivum
  unsure (1)..(220): unsure at all Xaa locations
  Clone ID: PAT_TA_1693.pep
MQIFVKTLTGKTITLEVESSDTTDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLXEDGRTLXADYNIQXGHP

SEQ ID NO: 107276 - protein, 110 aa, Triticum aestivum
  Clone ID: PAT_TA_1694.pep
MGSMAASVEEIGAAAAPQAVERRLGELRATFESGRTRPLSWRQSQLRGLLRLLADKEEEAFRALHDDLGKHRAEAYRDEVGVLTKSANAALREIGKWAAPEKVWVPLVAF

SEQ ID NO: 107277 - protein, 323 aa, Triticum aestivum
  unsure (1)..(323): unsure at all Xaa locations
  Clone ID: PAT_TA_1695.pep
VRQNPQPDQEYQRLPYSSSKRGSPGNKYSGCLANLTKEGSHWTGTRSNPLLSLHSSKFVSKRTACLIATGPSPAATEEPEMDLPKEIFLKDYKKPDYLFDTVDLEFQLGDEKTMVTSKIAVSPGNEGNSSPLALHGCDLKLISIKINGTELKSDKYTVDPRHLTILTPPAGVFXWEIVTEIYPQLNTSLEGXLYRSTGNFCTQCEAEXGFRKITYFQDRPDVMAKYTCRIEGDKTLYPGGGGLTAILSNRGDLEGGKHYALWEDPFKKPCYLFALVAXVSLECREDSFVTCSGRKVTLRIWTPAQDLPKTXHAMYSLKEAMNG

SEQ ID NO: 107278 - protein, 739 aa, Triticum aestivum
  unsure (1)..(739): unsure at all Xaa locations
  Clone ID: PAT_TA_1696.pep
MDLPKEIFLKDYKKPDYLFDTVDLEFQLGDEKTMVTSKIAVSPGNEGTSSPLALHGCDLKLLSIKINGTELKSDKYXVDPRHLTILTPPAGVFNMEIXPEIYPQLNTSLEGXLYRSTGNFCTQCEAEGFRKITYFQDRPDVMAKYTCRIEGDKTLYPVLLSNGNLIEHGDLEGGKHYARWEDPFKKSCYLFAPVGWSVGCRVDCIVTCFGRKVTPXMWMTWSVTVYEKGAEVVRMYKTMFGASGFRKGMDLYFQRHDGQAVTCEDFYAAMCDANNAHLPNFLQWYSQAGTPTVKVTSSYDEGSQAFSLKLSQEVPPTPGQPMKEPMFIPVAVGLVDSTGKDMPLTSIYSDGRVQTLSNDGHPIFTTVLQFKKKEEEFIFNNVPERPVPSLLRGYSAPIRLDSDLTESDLYFLLANDSDEFNXRWEAGQILARKLMFSLVADFQQQKTLALNTKFVDGLRAILRSTSLDKEFIAKAITLPGQXGRFMDXMCQVADPRCSSMLSGPFIRKELAFPTPRTILLAAVNKATEDSEAYAFXKPLIAWTRRAXLKNTCLAYLAXLNEPXFTELALKEYKSATNMTEQFAALAALSQNPGQVRXDALLDXYNKWAARLVWVVSKWFALQATSDIPGNVANVQKLLAHPAFDMRNPNKVYSLIGGFCGSPVSFHAKDGSGYKFLGEVVLQLDKINPQVASRMVSAFSRWRRYDETRQALAKAQLEMIISANGLSENVYEIALKSLAA

SEQ ID NO: 107279 - protein, 309 aa, Triticum aestivum
  Clone ID: PAT_TA_1697.pep
MVSQFLRAFLFLPAPPAAMADAGGGACRAWWSRDTVAVVTGANRGIGHSLAARLAEHGLTVVLTARDGERGEAAAAPLRDRGLPVAPRRPDVSDPASVAAFAAWLRDTVGGLDILVNNAAVSFNEIDTNSVEHAETVLNTNFYGTKLLTEALLPLFRRSPATSRILNISSQLGLLNKVRNPSLRRLLLDEEALTEGKIEAMVSQFLAQVKDGTWGEHGWPKVWTDYAVSKLALNAYTRVLARRLQSGGERVRVNCFCPGFTRTDMTKGWGKRTAEEVADFGARLALLPPGELPTGTFFKWRTPQLYSKL

SEQ ID NO: 107280 - protein, 80 aa, Triticum aestivum
  unsure (1)..(80): unsure at all Xaa locations
  Clone ID: PAT_TA_1698.pep
EAQWATAHFSLHGLHXSEPASHTLFNDKSSYRELSEIAEQAKRTAEIARLRELNTLKGHVESAVKLKGLDIDTINQNYTV

SEQ ID NO: 107281 - protein, 240 aa, Triticum aestivum
  Clone ID: PAT_TA_1699.pep
EPAVRGTRYVIDAAAESGTVRRVVLTSSIGAVAMDPSRGPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPRKQPYKMSNQRLRELGLEFTPVAQCLYDTVVSFQEKGVLPAPPAPAQPATKEIN

SEQ ID NO: 107282 - protein, 326 aa, Triticum aestivum
  Clone ID: PAT_TA_1700.pep
LVDIANTSIHSPNRPEGRSLCRTAPRRTGASMTVGGEATGHGQTVCVTGAGGYIGSWIVKLLLEKGYAVRGTVRNPDDAKNAHLRGLAGAAERLVLCKADLLDGDALRAAIAGCHGVFHTASPVTDDPEEMVEPAVRGTRYVIDAAAESSTVGRVVLTSSIGAVAMDPSRAPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRSVVLVISHRSERRAS

SEQ ID NO: 107283 - protein, 369 aa, Triticum aestivum
  unsure (1)..(369): unsure at all Xaa locations
  Clone ID: PAT_TA_1701.pep
RTRGLTSRCIFQRMKNYTIYAVSITIRIVLGFMLINVIFSALDIFRFVLRVAQCGTAXAHSSASKLLSGPMTTGSTRKFATATFMVLIIAILDDGSIMTRSKDSVLTSPFPISWKLNDIFATGVVLGTYIALMTVVFFSFIHKIGFFINEFGGRSVRASDFEIMSALYLQGSIVSQALIFVTRSRRSSLVERSGFLSALAFLLAQLVATLXISVYANWDFARFKGIXGWGWAGVIWLFSIVFYFPLDIFKFFIRFXVLKWRGPRDNLLQNKTAFTTKRELPLKGRRDSTNGLLHRRTLHGLQAPEPASHTLFNXKSSYRELSEIAEQGQEKSWRLQGCRELNTLKGHVESVVKLXKGLDIDTINQNYTV

SEQ ID NO: 107284 - protein, 172 aa, Triticum aestivum
  Clone ID: PAT_TA_1702.pep
LLLICGRLTEVYWRSGAEAQLQVRHRRDMAAAAGKEVDMKKMELMKEVRAHQVAIGELNNLPPSRAAYQKTCNIFFRKDIKSAVASQQKQLDIAKGKAALRWIQASWKLPCRLKFAIATFAASSIHLVEFSLNLVSSGVLIDLEATYIGICGIMVCLIFTMCETNHFFLNMG

SEQ ID NO: 107285 - protein, 157 aa, Triticum aestivum
  Clone ID: PAT_TA_1703.pep
MAKDENGSALDGAGKEEGEIAAARSRSRSKSLEAAEEEEGRSKGRRHRGHHGKSKRRDEGEESESSDEDSGERRKRRRKEKERRRRRRRSRSESSGSESEPESESSYSGSSAESESESESEEERRRRRRRRRKEKEEEERRRRRKEKEKRKRKERER

SEQ ID NO: 107286 - protein, 337 aa, Triticum aestivum
  unsure (1)..(337): unsure at all Xaa locations
  Clone ID: PAT_TA_1704.pep
MSDSTHRYNGSAGAVAVKQIRSAGKVDEKLEREFESEAGILGGVRHKNIVRLLCCLSRDDSAGKLLVYDYMDNGSLDGWLHGHALTDGARHSVSSVARARSGPRDAGLDWPARXRVAVAAAQGLCYMHHECSPPIVHRDVKTSNILLDSEFRAKVADFGLARMLVQAGTPDTMSAVAGSFGYMAPECGYTRKVTEKVDVYSFGVVLLELTTGRAANDGGEDGSLAEWARHLYQSGGSIGEATDSRIRYAGCSEEIEVVFRLGVMCTSASPSSRTTMKDVLQILLRCCEQTHQKGKAEPGREYEAAPLLLPQRGSRRKQLSNSKGSDSEEKSDFDGIV

SEQ ID NO: 107287 - protein, 424 aa, Triticum aestivum
  Clone ID: PAT_TA_1705.pep
ERPPRTRGVKAYELLARVEELQCLAKRIARYKDPVRQYRIQSPYKKPQWSASCGWIETDDARLLLGIHWYGYGNWEKIRLDAKLGRTTKIAPATLGERETFLPRAPNLDNRASALLQKEYANLSGKSSKAKGGASQKVNNENGGARSFKGRQKDAKPQEDIKSNKDDIKKRKVVEEAEAREEGEISESEEQIKYRLEKEEKWLEWCSEALDEEQDILKRLDRLQNTSLNLPKEKVLSRIRRYLPGRPLEIGKVAAQHVESYKQSRMTTRLWNYVARFSNMSGEQLCDLYLKVCQDQMEAGVGPSHGGNFAPAPNRGSSNQPHPPRNQRSTRSFQHTPEPLNNGENTGNSEAWKRRRRADQDNQFDTQTMYQPPPFMANGNRSQESSSSAGILGWGPVEMRRYGTERSKRGVHPSRFPAGHGPLL

SEQ ID NO: 107288 - protein, 220 aa, Triticum aestivum
  unsure (1)..(220): unsure at all Xaa locations
  Clone ID: PAT_TA_1706.pep
RQFTGKEEEPSELELLCMXARKWVEDRELFLPEAGVEDDDDDFTQFSLDGEDDSDAFESPSFSRFGPMKASHRNPLSKLAECDEEEDDDKEMVKDDSDPLNGMFPKLVPPVSKLSASLKGFGFHGKAKPYRGGIPKTKSKVAAKTNYSGEGSMYQSGSRSANEMLPPSASFVKLSDMGSEEWTAFLDKFQELLPSAFRARKHAAGSGPRPLQRLGTSCQF

SEQ ID NO: 107289 - protein, 259 aa, Triticum aestivum
  Clone ID: PAT_TA_1707.pep
SWKRVFVQTDNGSVLGIELERGENAHSVKKKLQIALNVSTEESSLTFGDLVLNNDLSNVRNDSPLLLTRNQMHRSSSTPCLSPTGNGVQQRDRSGPIAILGCSSPSPQMKQLAKDIVKAIRNDVDPVAVNSGMGGAYYFKNIWGDHVAIVKPTDEEPFAPNNPKGFVGKTLGQPGLKRSVRVGETGFREVAAYLLDHGNFANVPPTMLVKITHSVFNVNATVGCNHKMFHNKSQAVSKIASLQQFIPHDFDASDHGTSS

SEQ ID NO: 107290 - protein, 340 aa, Triticum aestivum
  Clone ID: PAT_TA_1708.pep
HPNLPRRLAAGGARGGRVECCRRRRCFGFATVPFPSLCLPECLEDPYFEWIHWPQASIPFSEEELEYIANLDPLKDAEMLRMELPMIRKACLRVLVLSTIFLKEGAAFGLCLSEIGEMMSRQFTGKEEEPSELELLCMEARKWVEDRELFLPEAGVEDDDDDFTQFSLDGEDDSDAFESPSFSRFGPMKASHRNPLSKLAECDEEEDDDKEMVKDDSDPLNGMFPKLVPPVSKLSASLKGFGFHGKAKPYHGGIPKTKSKVAAKTNYSGEGSMYQSGSRSANEMLPPSASFVKLSDMGSEEWTAFLDKFQELLPSAFQARKHAAGAGPRPLQRLGTSCQF

SEQ ID NO: 107291 - protein, 251 aa, Triticum aestivum
  Clone ID: PAT_TA_1709.pep
AAQAAGGTPKTRQNGRNSSEQPAAGSETWTVEKVLSGNKLVQSSNSPISFFHLLGGLKTTKREGWKRHGIDPESVADHSYRMGMIAMFAPQGLNQVKCMKMCLVHDIAESVVGDITPFSGVSRDEKGRREAATIEYIANRWSGPYTAEIKELWDEFEAAESPEAQFSQDIDKIELLLQAVEYERNSENKKDLGEFMGVARKLRSEAGKAWADEILADREKFWEGTQHLRGEHAEKGGLTEEMTKAHDAYYG

SEQ ID NO: 107292 - protein, 240 aa, Triticum aestivum
  unsure (1)..(240): unsure at all Xaa locations
  Clone ID: PAT_TA_1710.pep
MSVRGDPAAAAAPGEDTAEELLARVRGMVQAAVGAATAAEGFPGRWKAIAAKLGALPARLSDLSSHPCFARNALCRELLHSVAATLADAAELAARCRGPPRDGKLQTQSAIDALGARLDVNLRDCALLVRTGVLSDSDASAVAAPATAQADVRELLARLQIGHADAKTRAVDGLLDALNRDEKSVVSLLGRANVSALVQLLTAPAPRXREKAAMVICXLAESGGGACEGLLVSEGALPPL

SEQ ID NO: 107293 - protein, 239 aa, Triticum aestivum
  Clone ID: PAT_TA_1711.pep
IPPHLILSSPTHLSLPVLLNQVYTPPVLARRRTISSPAPPHYSLPAPWHQPLPVPPHHLLPCTTTPPHSPCRGNTPSPRRRTIFSQAPPHHLTLRAVAPPPPRAATPSPTTSLLGPPAPASASHRICPITILHDYPMTDPVVAVLGALAMADSKDWRGYVELGGRRRPTPPPLPRSIRSGSTPASMQLTSSIWVFFWIEMQLTSPSFRNSMSVRASLPCSQATAPVQSTNEAVKLKSDR

SEQ ID NO: 107294 - protein, 141 aa, Triticum aestivum
  Clone ID: PAT_TA_1712.pep
MSAPGPIAGSAVFPAHRLQVSTSGSRRSAACFLRRQSFPSISIRSAPTKKRFLHLPCSAKQDTVDKVCGIVKKQLAVAEDTVVSGETKFADLGADSLDKVEIVMGLEEAFSITVDESSAQEIRTVEDAASLIDKLVTDKDS

SEQ ID NO: 107295 - protein, 324 aa, Triticum aestivum
  Clone ID: PAT_TA_1713.pep
MAMAWWKNGALVAAATLAVAAVVCAGVAAAASKFDDVVQPSWANDHVLYEDDLLKLRLDSSSGGGFASKNKFLYGKATADLKLVPGDSAGVVTAFYLSSAGDKHNEFDFEFLGNVTGEPYLVQTNLYIDGVGNREQRIDLWFDPTADFHTYAVLWNPSQVVFLVDDTPIRVYDNKNASATKPKGHHRHPNNATTAATQTASAFPSPQPMAVYSSIWNADDWATRGGLVKTDWSHAPFVATFRDVRVEGCAWAANASDSDAGEVARCSGSSWGKEGRYWWKEKDMQELSVHQSHQLVWARAHHLVYDYCVDTDRFPVQPPECAGR

SEQ ID NO: 107296 - protein, 171 aa, Triticum aestivum
  Clone ID: PAT_TA_1714.pep
MAAFHPQHPLATCYYSEASNFHCAACERRVTGDGYRCSKRECAFHIHEACAKLPFQTFLHQHPEHWLTLTDTEAAVSRRCYVCRQNTRRYVYRCLLCQFDVHLGCVPGPQPNPQPNWPQPWRRNPEPNRDGARRAVRIAGTIAHIGLHAAHGVHGLHGVANAIGSWFTGGN

SEQ ID NO: 107297 - protein, 322 aa, Triticum aestivum
  unsure (1)..(322): unsure at all Xaa locations
  Clone ID: PAT_TA_1715.pep
MAIISDIQEEEAPPQQPQAAPAPAAVDVDLEVLEAVLERKGGALPFLHAAIDVAHRRSDLFRDPSAVGKITAMASACRAQVEAEERKARDAKRKAAELEKAAAAEKERVVKAAAEKEKRESSVVTEERGAGSSAEKDGSTEVEKKESKANKPNAGNGLDMEKYSWTQQLPEVNVNVPVPEGTKSRFCCLLRSXEDHLKVXGLKGQPPIIDGELHKPVKXDDCFWSIEDGKALSILLTKHNQMEWWKSVIKGDPXVDTQKVEPETSKLSDLDPETRQTVEKMMFDQRQKQMGLPTSDEMQKQDMLKKFMSQHPEMDFSRAKIA

SEQ ID NO: 107298 - protein, 354 aa, Triticum aestivum
  Clone ID: PAT_TA_1716.pep
CTPQQAAAAHLFAHAVTLQPPMASACDRLRYLKAFDDTKAGVKGLIDAGITTVPAIFRHPPDTLARAHDEDRFAIPVIDLAGVTTAPSRRAELVAEVKAAAETVGFFQVLFHGAPPPVMSEMLAALRSFNEEPAEARRPYYSRDGQSRVRYHSNFDLFRSPAANWRDTLYLDMAPTGPSPGEIPAACRGIAVEFTREVQRLGGTLFELLSEAMGLHRGFLEQHEAGCLEGLSVVGHYYPASPQPHLTMGTSRHTDPSFLTVLLQDSVGGLQVLHRLRRDDQPVWVDVPAEPGAFTVNVGDFLQLLSNDRFRSVEHRVLSKSVGPRVSVACFFRPHGAAAAARVCAPILVGDGAA

SEQ ID NO: 107299 - protein, 200 aa, Triticum aestivum
  unsure (1)..(200): unsure at all Xaa locations
  Clone ID: PAT_TA_1717.pep
PRVRGDAEGGVVNKSKASCWTRRVRIGNAPEERDANPSRVPALEASMRAYADNKVGTVVNPAIGTSFDTVEEAYEFYNLYSWETGFGVRYAKSXVNVHRKKCMQEFVCACAGKPLQSNSRSSRCGCPALMRVLRSDDKGWYICEHKAEHNHSVSVNCMEKLHWKSHRHIDRYTRDLVKQLRENNISLSKVYSVVGSFFGS

SEQ ID NO: 107300 - protein, 288 aa, Triticum aestivum
  Clone ID: PAT_TA_1718.pep
AAATISAHEFSDARIACAKAIALVLVTDDFFDVGASKEEQENLIALVEKWDHHHEVEFCSEQVEIVFSAFYSTVKHIGEMASAVQKRDVTKHLNETWLHYLRSAATEAEWQRNQYVPTVEEYMIEAVNSFAEGPIMLTSLYFVQQKLEEYIIKDPEYDELLRIKGNCGRLLNDTRGFERESSEGKLNIISLLVLQSGGSMSIEAAQEAVQESIASCRRDLLRMVVREDRVVPRVCKEVFWRFCRTVHLFYCQTDGFSSPKEMLRTMNAIFREPLKLQHTSPLDAQSEQ

SEQ ID NO: 107301 - protein, 325 aa, Triticum aestivum
  Clone ID: PAT_TA_1719.pep
MMVLAAAASAPSLQGWKRQISAVTCQHPHSVPLPRTVFRVSATKNNERKRRRSRNLSKGPALIAEEASPSNGENPTTILDLNVDDNATSDEKAAGAPRSAVLQSCTLTSGLLLALGLLLREASHVASSNGLPFADPTAVSFNFETWHLELVAGLVILISSTRYILLQIWPDFRDSSEAANTQILTSLESLDYIVVACLPGISEEFLFRGALMPIFGLNWISALATGVFFGVLHLGNGRRYSFAVWATFVGLAYGLATIASSSIIVPMASHSINNIIGGLLWRFRDSSERRNVVWDTLLDTLGSFRAQYFPFEQSFHLQLLLVALA

SEQ ID NO: 107302 - protein, 272 aa, Triticum aestivum
  unsure (1)..(272): unsure at all Xaa locations
  Clone ID: PAT_TA_1720.pep
DPRVRSLFMYAGNRGGAYAKNSFGNIYTAVGVFVLGRLFREAWGREAPKMQAEFNDCLEKNRISISMELVTAVLGDHGQRPKDDYAVITAVTELGHGKPQFYSTPKLIEFCRKWRLPTNHVWLFSTRKSATSFFAAYDALCEEGTAYTCCKALDEIADISVPGSKDHVMVQGEILEGLVARIVSRESSVQMEEVLRNFPIPSLDGGDSDLGPSLRDICAANXQIKALFENVGSSMCPDHRDWFGYSGLEPQSRNADKSVVTHFFASTFHGLC

SEQ ID NO: 107303 - protein, 131 aa, Triticum aestivum
  Clone ID: PAT_TA_1721.pep
HSDSKYTQDEGVAGLALVSTNSYDIFDSPNEGIGRCFMAKGPKVTHPEYVDFNSDEDDLLGDDLLGDNSSDEYYDERSINHAKTSDNDKEKIEALTKELKTLKLAHDTIFEDHRELLRAHEKLRFEKLNLE

SEQ ID NO: 107304 - protein, 214 aa, Triticum aestivum
  unsure (1)..(214): unsure at all Xaa locations
  Clone ID: PAT_TA_1722.pep
MGATGQRRMSSLPAAAAAPLLLLLAVSSWSQAAAAPAWTTDLEKHVAFFDTDNDGIVTFSETEQGLRAIGLGVLEATASATLINGAIGPKTRPENATTSRFDIYIANIQKGIHGSDSGSYDAQGRFVPAKFNEIFTKYAMVKPNALNEDELDAMRTANRKXGDFKGWAASKAEWGMLYSLAKDKDGFLQKDTARSVYDGSLFAKLAKKAASSGN

SEQ ID NO: 107305 - protein, 118 aa, Triticum aestivum
  unsure (1)..(118): unsure at all Xaa locations
  Clone ID: PAT_TA_1723.pep
MIQEHQREREREQVREEREPAGGKEGQQSRGEIRQRAAVREEKEXKKSGEEEQLEGEGERKEXARVHRRRSSKQFGGRGEVEEQQREEETGKQQGEARRLEGEVARGTRPPRLVGRAR

SEQ ID NO: 107306 - protein, 248 aa, Triticum aestivum
  Clone ID: PAT_TA_1724.pep
MGIFSGTPPPSCPSAPHCAEWAKVYLKYCLCSTKDGVALGLGLASVLSWGIAEVPQIITNYKQKSTEGLSIAFLMTWIVGDLFNLVGCFLEPATLPTQFYMALLYTITTVILTGQTIYYSHIYHLKVKKTGVTAKSQKHQRGDASLREKLLGHRDEAFKNNIQSGPTIPIPSSPIQVNTEVFRQRHGSVSPGSDYYYASARSLSRSPVPTGTWLGNNHQTTKVPPQMSDEGEPLFGEFVPTQSAPAAI

SEQ ID NO: 107307 - protein, 243 aa, Triticum aestivum
  unsure (1)..(243): unsure at all Xaa locations
  Clone ID: PAT_TA_1725.pep
MVRITSIFAGLSLVAGSIAAPSPEGMFSTLAKRGGTPNSSGMNNGFFYSWWSDGGAEATYENGAGGSYSMSWQTGGNVVGGKGWSPGKARTISYEGEYKPNGNSYLSVYGWTRNPLIEYYIVEDFGTYDPSSGAQSKGTVEVDGSTYEIFTRTRTNAPSIDGTQTFEQYWSVRKNHRSTGSIDVGAHFKAWEQHGMKLGXHDYQILATEGYFSSGSSHMTVSEGASSAGGAATNGDSAAKPDA

SEQ ID NO: 107308 - protein, 204 aa, Triticum aestivum
  Clone ID: PAT_TA_1726.pep
REPIHRSDFACKMVGLGHHLRPDPIGKKLALRASSMSRTMAWLRLLMVADVHHQPEVVRHPRRGLQEVDKSTGRSGDPVAAGCEAGDAGSVDRADRPRLRPPDSRRGRCGSGVRGGLASLPAGLIFRRSTTPRRCVMDGRRPVEIQLLARRHGSGRHRWMSRLGLVVAAQGPGSVALRWKKLGGRRGQAGQEVDQAAVGGGGDE

SEQ ID NO: 107309 - protein, 186 aa, Triticum aestivum
  unsure (1)..(186): unsure at all Xaa locations
  Clone ID: PAT_TA_1727.pep
MAHGDRMTTFEEGERESEYGYVRKVSGPVVVADGMGGAAMYELVRVGHDSLIGEIIRLEGDSATIQVYEETAGLTVNDPVLRTKKPLSCELGPGILGNIFDGIQRPLKTIAIKSXDVYIPRGVSVPALDKDQQWEFQPNKLGVGDNITNGDLYATVFENTLMKHHIALPPGAMGKISYIAPAGQYS

SEQ ID NO: 107310 - protein, 386 aa, Triticum aestivum
  unsure (1)..(386): unsure at all Xaa locations
  Clone ID: PAT_TA_1728.pep
VRVLGGTCAIPGAFGCGKTVISQALSKYSNSDTVVYVGCGERGNEMAEVLMDFPQLTMTLPDGREESVMKRTTMXSCTTTSPTGFRNPEVQRLVXGMTNAGCYGDMGXNVSMMANFTARWAEALRLISGRLVEIHAESTFHASLASRLLSLYEQAGKVQSLGSPDRTGSVPIVGAVSLPGGDFSDPVTSATVSIVQVFWGLDKKLAQRKHFPSVNWLISYSKYSTALEGYYEKFDPGFIDMRTKAREVLQREDDLNEIVQLVGKDALGESDKITLETAKLLREDYLAQNAFTPYDKYCPFYKSVWMMRNIIHFNTLANQAVERAANADGHKITYAVIKSRMGDLFYRLVSQKFEDPAEGEDALIAKFQKLYDDLTTGFRNLEDEAR

SEQ ID NO: 107311 - protein, 101 aa, Triticum aestivum
  Clone ID: PAT_TA_1729.pep
PSPFPGGPPPRRPPRWAPPAPHRPPRADRAPPPPPIPPPSSSPPASSSRRRPRVNPHRRMATGARSTAVGASGGAAPASRGVVTSTRAPPSAMVAASILGG

SEQ ID NO: 107312 - protein, 205 aa, Triticum aestivum
  unsure (1)..(205): unsure at all Xaa locations
  Clone ID: PAT_TA_1730.pep
APVVDGDGDGDGELFDCAICMETVPGVRKFSVGSCGHAFCSGCVAQYVAAKLGENVARVKCPDPSCKNGAVEPESCFGIISSDLLDKWGFLLCESALGGKKMYCPFREWXAPLLADGEGGAAAIAEAECPHCHRLFCARCAAPWHAGVGCKEFQELGQDERGREDFLLRRLAGRQKWQRCPQGKMYVEKIEGFHYIKNAVVDATF

SEQ ID NO: 107313 - protein, 453 aa, Triticum aestivum
  unsure (1)..(453): unsure at all Xaa locations
  Clone ID: PAT_TA_1731.pep
HAARAHPTPPEERHEQPAGRREGRPPAATRTPQRPPAVGGGGRRSAGPPPPPAPPAGRRRAGPAAPAAATPARPSASAPSPSRGRLPIHARALIDHQPNIYDVVHVKYFDDEPLKLDFVVSFPAHGFHLRFXPWVGTRLRSLRSFVTVMALQVRFRDGFKVAGHLTLATFAICLCFPWEYMIQRKGHVYPGVLXLSFAFPIPSQYTNFFNNGXVADLPLEFPDGTTPVTCRVSIYDSSTDSKVGVGSLMDKAVVPALPAGSLYMEEVHAKLGEELWLTTGGQHIPFGASPQDIWTELGRPCGIHQKQVDQMVIHSASDLRPRTTLCGDYFYNYFSRGIDILFDGQTHKIKKFVLHTNFPGHSDFNSYMKCNFVIYDAEAEGAQQPGNTSKNCITHRSKWEQVKEILGXCGRAAIQTQGSMNNPFGSTFVYGYQNIAFEVMKNGYIATVTLFKS

SEQ ID NO: 107314 - protein, 260 aa, Triticum aestivum
  unsure (1)..(260): unsure at all Xaa locations
  Clone ID: PAT_TA_1732.pep
MPAAVMRCPFLLGRHPAAALRHSSSSRMRRVRRAAGSGGQGRSPAYGGLLLDAGGTLLQLAQPVAETYATLGRPYGVMKSEKYIMKGFKRAFSAPWPKTLRYHGDGRPFWKIVVAEATDCTNNNYFEEVYQYYAHGDAWCLPDGAYRTLHDLKDAGVKLAVVSNFDTRLRKLLKDLXNVSDMFDAIVVSSEVGYEKPALEIFKIALEQIGVEARNAVHVGDDETADKAGANAIGLECWLWGEDLKEFSEIQHRIVAKRLR

SEQ ID NO: 107315 - protein, 101 aa, Triticum aestivum
  Clone ID: PAT_TA_1733.pep
KLASPGPRAVSTYAGGGSSAKSLEKDIRGAMKDDWWCTGLYMLTHAMHCPHEPLGLLPAYRQAAAGSLARLSASRGGAVAAGRPLGLSCWLASYSSGGVGV

SEQ ID NO: 107316 - protein, 103 aa, Triticum aestivum
  Clone ID: PAT_TA_1734.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 107317 - protein, 62 aa, Triticum aestivum
  Clone ID: PAT_TA_1735.pep
RTRGLLCFRSTGANDSNADSQGRNWKDSVHYSTAAIIVVMSALALLLPCGGAVQRPLQNQPG

SEQ ID NO: 107318 - protein, 152 aa, Triticum aestivum
  Clone ID: PAT_TA_1736.pep
SQTPSYPPIQLIPAKRRRRNNRRTHRGANGAEPGWYNYDAADIAKVFEVLNDEQLLKEVVGDDGAAPLAVVATPSPALWSSFGRSPAPVRQLRITDSPFPVRDDAADLEGALVDREADEFIKKFYDQLRRQQNLAAATPEYGYAGPAAGVAY

SEQ ID NO: 107319 - protein, 717 aa, Triticum aestivum
  Clone ID: PAT_TA_1737.pep
MASPPPPPPKLPIPGRRNILITSALPYVNNVPHLGNIIGCVLSADVFARYCRLRGYNAIYICGTDEYGTATETKALEEKCSPKEICDKYHVIHDEVYKWFDIKFDKFGRTSAPEQTEVCQAIFHKLMENKWLTENTMQQLYCDTCERFLADRLVEGKCPTEGCNYEAARGDQCENCSKLLNPTELIDPKCKVCKNAPRIRDTDHLFLELPLLSDKLVNYINNTSVAGMWSQNAIQATNAWLKEGLKQRCITRDLKWGVPVPHEKYKDKVFYVWFDAPIGYISITASYTPDWEKWWKDPDNVELFQFMGKDNVPFHTVMFPSTLLGTGENWTMMKTISVTEYLNYEAGKFSKSHGIGVFGNDAKATNIPSEVWRYYLLMNRPEVSDTLFTWADLQAKLNSELLNNLGNFINRVLSFVAKPAGAGYDSIIPDAPNAESHPLTNALAEKTNKWVEQYLEAMEKVKLKQGRNSAMAVSRLRNAYLQESQFWRLYKEDPATSAAATKTSVGVVYLLACLLEPFMPSFSREVLHQLNMSPDEDLSFCDDKGETAKAKRPWDFVSAGHKIGKPVPLFKELKDEQVEAFRIKFAGSQAERILKEQADAEAKKVAEKLKGTKLSEGSSKKKQSGGSKSKTAEEVSVAKLDIRVGLIRKAEKHPDADSLYIEEIDVGEEAPRTVVSGLVKFIPLEEMQNRKVCVLCNLKPVAMRGIKSHAMVLAASN

SEQ ID NO: 107320 - protein, 236 aa, Triticum aestivum
  Clone ID: PAT_TA_1738.pep
GRAGVPTRRHARAKRPRLVPAPAPAPRTIADMAPEILLRLPPDDPARLMRASLVCWRWRRLLTDPAYLRRYRAFHRTPPMLGFVLNLKQHYQGMAQLVPTSSFCPAASDRPGLNVLDARHGRVLLHTAQGQRLVVWDPVTGEECKIPRVPAYALGFNAAVLCAAVGCDHLDCHGGPFRVAFVGCGERGITFACTYSSEAGAWSPRIEGEQPAFVDRRTTVLVGNMLHFTWRPYLNF

SEQ ID NO: 107321 - protein, 357 aa, Triticum aestivum
  unsure (1)..(357): unsure at all Xaa locations
  Clone ID: PAT_TA_1739.pep
RDPRWGRGQETPGGDPLLASKYAVGYVTGLQDAGAAGVVDGALKVAACCKHYTAYDVDNWKGVERYTFDAKVSQQDLDDTFQPPFKSCVLDGNVASVMCSYNKVNGKPTCADKDLLAGVIRGDWKLNGYIVSDCDSVDVLYTQQHYTKTPEEAAAITIKSGLDLNCGNFLAEHTVAAVQAGELSEEDVDRAITNNFIMLMRLGFFDGDPRELAFGSLGPKDVCTSSNQELARETARQGIVLLKNNGALPLSAKSIKSMAVIGPNANASFTMIGNYEGTPCKYTTPLQGLGANVNTVYQPGCTNVGCSGNSLQLSTAVAAAASADVTVLVVGADQXSLNARSLDRTXSLLLPGQXTQL

SEQ ID NO: 107322 - protein, 268 aa, Triticum aestivum
  unsure (1)..(268): unsure at all Xaa locations
  Clone ID: PAT_TA_1740.pep
MAAMNSDLGGLGPRPANAPPNPFESAMYGAGPGLIRTGLGAYGEKXFLGSSSEFMQSNITQYLSDPQYYFQVNSQYVRNKLKVVLFPFFHRGHWTRITEPVGGRLSYKPPIQDINAPDLYIPLMAFGTYIVIAGYALGVLGRFTPEALTLQFTRGLVGWFLQVVLIKGLLYSLGSGEAPLLDIVAYAGYGFAGTSLAMLARIFWSYLYYFIMPWFCLCTGVFLVKTMKRVLLGGPRSYERHPSRNHYFLLFLAVVQFPMLFWLGNISG

SEQ ID NO: 107323 - protein, 336 aa, Triticum aestivum
  Clone ID: PAT_TA_1741.pep
SKKDRTWRIFSLKELQLATNNFNYDNKLGESGFGSVYWGRLWDGSQIAVKRLKSWSNKAEKEFAVEVEVLARVRHKSLLSLRGYCAEGQERLIVYDYMQNLSLHSHLHGQHAAECHLGWERRMNIAIDSAEFFAYLHHHAIPHNIHRDKKTSNVLLDANFQARVADFGFAKLYAMLGKAKESCDIYSFGVLLLELASGKKPVEKINPTTKLTITEWALPLSTRAEQGCSVRACLHSGDSHAEAQVKRMVLVGLACTQTKPEQRPVMSEVVEMLKGESAEKFSILENDDLFKPQQTTSSVQGTSGPCSSDAITEEKESKEDTIEEATDSSETVPSAR

SEQ ID NO: 107324 - protein, 178 aa, Triticum aestivum
  unsure (1)..(178): unsure at all Xaa locations
  Clone ID: PAT_TA_1742.pep
MDSGSDSDGAPEELTAVQGVEKHEEISKVEKDSAVRATQEEKDRRKRWAQRKTSSKPNKKKPLKVEDKDTEVDEETHAMPGXTSPKSVIEMLAAREKQTFSSDSEEENVNQNVQKKKKRLKTATTGPETILLKDVRSTEHIKKVVEFLSRRKNQVPRSNAVLKNPNAMRLFNKHNFTS

SEQ ID NO: 107325 - protein, 150 aa, Triticum aestivum
  Clone ID: PAT_TA_1743.pep
MSSPSRRSSSPESNIDGGSGSGSAGDERKRKRMLSNRESARRSRARKQQRMEELIAEASRLQAENARVEAQIGAYTTELTKVDGENAVLRARHGELAGRLQALGGVLEIFHVAGAPVDIPEIPDPLLRPWQSPFAPQLAAAGGMPDAFQF

SEQ ID NO: 107326 - protein, 258 aa, Triticum aestivum
  unsure (1)..(258): unsure at all Xaa locations
  Clone ID: PAT_TA_1744.pep
SQPRILPTLLPLFCHTSNAIRSFFWSSDEEPDPPCRQPRGESPSRGDIVLGRSPRTPAAEARQPQADLAFLXLLEDGFSITGRGAVATGRIERGTVAVGDPVDLVGIRETRNATVTGVEMFQKTMDDAIAGDNVGLLLRGMQKEDIERGMVLAKPGSITPHTKFEAVVYVLKKEEGGRHSPFFPGYRPQFYMRTTDVTGNVTNIMNDKDEEAKMCMPGDRIKMVVELIQPVACEQGMRFAIREGGKTVGAGVINNIIQ

SEQ ID NO: 107327 - protein, 166 aa, Triticum aestivum
  Clone ID: PAT_TA_1745.pep
PHHLRARALLEKKAITPVAADAAPPSAICSSAVAPLLQLSSLVNVGARSPWSPPLFTFAASFQLRATRVAALNPTVVTKDRETPWLSSIKPVPANSMAGCSTIDARFQQKLRRTKKLPPRRSIGLRQFQQFSWLVVAPLMPASSTRRCGHHWQLRLPASSTDGFII

SEQ ID NO: 107328 - protein, 94 aa, Triticum aestivum
  unsure (1)..(94): unsure at all Xaa locations
  Clone ID: PAT_TA_1746.pep
GRREFEDEFHKSLRHDRPFTLSMARXGPNSYGSPFLFPPGATPWPGYQPSGVGWGGEGVGGGPPIGEGQAGQNGQPFPGGEVLDGSGPQALAPI

SEQ ID NO: 107329 - protein, 141 aa, Triticum aestivum
  Clone ID: PAT_TA_1747.pep
MATKAAVIATVLALNLLFFTLADDCGCKLPSPPPPAGGGGGGGGGGGGKGGGGGTGGCPIDALKLGACANVLGGLINLRPVTTPKQTCCSLLQGLADLDAAVCLCTALKANILGIHLNVPVDLNLLVNYCGKNVPSGFQCP

SEQ ID NO: 107330 - protein, 182 aa, Triticum aestivum
  Clone ID: PAT_TA_1748.pep
MAKKAAVIATLLALNLLFFTFADACGCHCGSCPSPGGGGGGGGGGGGGSGGGGGGGSGGGGSGGGGSGGGGSGGGGSGGGGSGGGGSGGGGSGGRARCPIDTLKLGVCANVLNGLINLQLGTPPKQPCCSLIQGLADLEAAVCLCTALKANILGINLNVPIDLSLLVNYCGKNVPSGFQCPR

SEQ ID NO: 107331 - protein, 302 aa, Triticum aestivum
  unsure (1)..(302): unsure at all Xaa locations
  Clone ID: PAT_TA_1749.pep
MGAQRALLASFLLAALVTQAFVSVSARTGPTDKASQDDVKKPDCVPSLDPHNFPGHGGTTVPLPSHGGSSGTPPYHGGSGTTPSHGGSGSTPSHSGSGSPVPDPGGGYGSTPDAPSHGGGAYGSSPTPSTGGAYGSSPTPSHDGGAYGSSXRPAHDGLHRSGTPAAPSHSSHGSITPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAVAGGSDSAAAAQAAAFKKANEGKKV

SEQ ID NO: 107332 - protein, 304 aa, Triticum aestivum
  unsure (1)..(304): unsure at all Xaa locations
  Clone ID: PAT_TA_1750.pep
AEGRAGFFFPEEMWRRGDPELRLEHGRCLLTRTRDMYALEGKLRGHALFTTVQGGRLPVSPAMLLAALESQCSVRSGDVKVEVTSPPADFFVRFRRNEDCTRVVVNYSHVLEVGGETIQFRRWHRGSFCEQSSLPFFTKLSFDGLPQEAWDRAFLGMLVNQLGGELIKCLKPDDRWCISVEAWMKDPNKVPKRYDVELSEPDEPMFCFCPESDDEISPPTPRERTEKRTVVHSIIIHVDWVXDNSPIIPEFPALRDYHDEDTTRLHTYATCNGTVDGTTPPVDQDGGRGFAGPSSQARAGALFY

SEQ ID NO: 107333 - protein, 64 aa, Triticum aestivum
  Clone ID: PAT_TA_1751.pep
NNNVNLCNYILCWILVFYKINSEFNWFFFLCVKNFFTICNMSNFFDIHKYIYFCIRFLYYKIHH

SEQ ID NO: 107334 - protein, 87 aa, Triticum aestivum
  unsure (1)..(87): unsure at all Xaa locations
  Clone ID: PAT_TA_1752.pep
MLNLVLSKEMKSTTVFGANILKEGSDPKIQPDSEYPDWLWHLVDKRPXLSELRRKDAKTLPYEDLKRFVKLDNRARIKENNALTAKN

SEQ ID NO: 107335 - protein, 335 aa, Triticum aestivum
  unsure (1)..(335): unsure at all Xaa locations
  Clone ID: PAT_TA_1753.pep
VYARLEERRPGTHYRVNLRCHLLNWEKCHSMVNEGIVLGHKVSERGIEVDKAKVDANEKMPCPKDIKGIRSFLGHAGFYRRFIKDFSKISRPLTNLLQKYIPFVFDDDCVEAFEILKKALVSAPIVQPPDWNLPFEIMCDASDYAVGVVLGQRVDAKLNVIQYASKTLDNAQRNYATTEKEFLAVVFACDKFRPYIVDSKVTIHTDHATIKYLMEKKDAKPRLIRWVLLLQEFDLHITDRKGVENPVVDNLSRLENVLDDPLPIDDSFPDEQLNVINGSHTAPWYANYANYIVXNLYQQKKKFFYDLRHYFWDGPHPYKEGVDGVIRRWTSSRSR

SEQ ID NO: 107336 - protein, 59 aa, Triticum aestivum
  Clone ID: PAT_TA_1754.pep
TKSSQEGTHCSWRCRRITCMFRRQIKMLLSACLGALEVSSPKPPDQGGYLRVVDLHALQ

SEQ ID NO: 107337 - protein, 166 aa, Triticum aestivum
  unsure (1)..(166): unsure at all Xaa locations
  Clone ID: PAT_TA_1755.pep
MAALHHLVLPPRLLSGHGPPPVLRFSRRPRPLLHLLPRAAAAATRASAAAATAVSAPSDAALQNFRRWLSSQGADTGSVAPAVVPEGLGLVAARDLPRGEVVAEAPKKLWLDADAVAASDLGRVCGSAGDLRPWVSASLLILREAAREGDSLWTTYXAILPRQKDS

SEQ ID NO: 107338 - protein, 176 aa, Triticum aestivum
  unsure (1)..(176): unsure at all Xaa locations
  Clone ID: PAT_TA_1756.pep
IPSVHKKDASTVTKDLDXGESSSSHTLPSTSAPSQDVGPSGAQLNNMSDFPSFGDASSSIPEDQLRMIDNINSLMSELAVEREELMRALRIESSNCSKLKELNRDLTQKLETQTHRLELLTSARTFSLAILSPRVRTHFNDATMYADEGDEVVERVLGWIMKLFPGGPKRRTSKLH

SEQ ID NO: 107339 - protein, 608 aa, Triticum aestivum
  unsure (1)..(608): unsure at all Xaa locations
  Clone ID: PAT_TA_1757.pep
RLQVSRSFPRPTPVRVRRGGLRSPILPPCLYAASGRSGKKSKKSAAPTVVAPAAVLTKGKAGKKREADDEIKKAVSAKKQKAAPAKAVPGPKEAAKKAKKQPPPKKVESSSSEEQSSESEEEEVPKKTAKPVKHESSDDSSDDSSSDEEPAKKPSAKPVTPAASNGSKKGKPESSSSSSEDESDDDEKPAALVKKTPVIESDSSESDSDDSSDEDVPAKTPAAAAKKVDSSDSSESESESEDEEKSKKAAQATKIAPAAAKRKEEPSDSSDSDESDEEPPQKKLKDAAKVTPKSAKKDSTSDDDSSDESSDDEPKKKVTTASKSQKEEPKTPASNKGQATGSKTLWMGNLSFNIEYDQVKQFFAQIGEVVDVRLATHEDGHPKGFGHVEFATAEDAQKALDSLNGGDLMGRPVRLDMAAERGATPRTRDGGSFGKPSGGPSLSVFVKGFDSSQQEDAIRSSLQEHFSKCGEITRVSVPMDYENGASKGIAYMDFTDESSFSKALELSGSDLXGCNLYVAEAKPKGQFGGXGGRSGGRDGGRSGGGRFGRSGGRDGGGRFGRSGGRDGGGRFGRSWWPWMAAEEAAEAFISDRVLAQASAGKKTRFGDD

SEQ ID NO: 107340 - protein, 192 aa, Triticum aestivum
  Clone ID: PAT_TA_1758.pep
MLPRSPPPPSVRAVATAPPPMASSAAGAGKSLIQTFRKFFKKPWEITGPCSSPEYRSAVPGALEYRQTCPATLREDSPRAIIPTSDPETVFDIKYYPRDCRRNRPPVRRTLLRKPDLERYMAAKQFDPAKDFPVPYVNSAVEEDYSAVGGGLHPVIQVLWSRCSRSCTHFISALPWKSLPLLFRRNFSGCKR

SEQ ID NO: 107341 - protein, 360 aa, Triticum aestivum
  Clone ID: PAT_TA_1759.pep
MARVLGREESQREFWDLVQEMKAGELHIDIDTYMKLSRQFQKRHMMTEAVELYELMMDGPYKPAQQDGPLLLRRIAMGPEPDLELVYRVVRKFEAVYEFKTKNVFDGIHRALTSNGRFDEAAEIVERMRGAGHQPDNITYSQLVFGLCKAAKCDEARQVLDEMEAEGCTPDLKTWTMLIQGHCAAGEVDKALQYLTEMIEKDLEADADLLDVMVKGLCKQEKIDAAYTLFVEMVDTAKLNPWQGTYKHIIAELLRVKKLEEALGLLKSMKAQKFPPFADPFPSNIAEYGTLEDARDFLKALKGSSNNYPQPPIYVQMFKAFFAEGRYSEAQDLLYKCPIHIRRHHDITELFEPKKVQATA

SEQ ID NO: 107342 - protein, 64 aa, Triticum aestivum
  Clone ID: PAT_TA_1760.pep
PRVRGHAISLGWVHPNQNLDNPEKVGDFCIFIGAKKNRCEETVAMSNSFGFGGHNSSILVASFK

SEQ ID NO: 107343 - protein, 203 aa, Triticum aestivum
  Clone ID: PAT_TA_1761.pep
MLRSPPPAKPKPSTTLRVAAFGGSLRKGSSNGGLIRADEELCEESIPELQIDHVDISGLPMSNPDLDTDDGDGFPPDVEAFRDRVRAADCFLFASPEYNYSVTATLKNALDWAPRGTHKCWADKAAAIVSAGGSCGGGRAAFHLRQIGVFLDIHFINKPELQVRAYEDPPKFDADGNLVDAETRERLKQVLLSLQAFALRLQH

SEQ ID NO: 107344 - protein, 302 aa, Triticum aestivum
  unsure (1)..(302): unsure at all Xaa locations
  Clone ID: PAT_TA_1762.pep
MLTRSTAMVGRSSATRLWRPAPTWTPSGRQASRRPRSMSTSHSSPGRTGQRKHYPGLSYPRCTHALTVAXSPNLVGITVAARRRWAELTGRAPNFSIPQEASYFGICRTLPASEFELEWPHTHPARKSNTNNVQQQPPKKTLNGSGLNLSSPSKHSRGDXMDLSPVRSKRRKEAFPHAXWMMECCLPFVDHTRVKVPXKNTPTHGMLKIFCVSTARMPYIRRHDRVFKLTDAMPEHCPPGEFIREIPLATRIPEDAKLEACFDEAAAVLEIMVPKRGNEPEEHEVRVSMRPPHLGVNDLLMT

SEQ ID NO: 107345 - protein, 186 aa, Triticum aestivum
  Clone ID: PAT_TA_1763.pep
SDAPKQRRQRSKAPPATTDRRRRADGPDEARARVDREQHRQPRKGSQETTERRQHGPEHDGALARVRGRRHDGAGVPADGGVQHAVHRRRPRRPRLRSLHQGRLLLLLMPAARLAPSFFRLQFPYSFARLIRFLHSCFHICFSSIVGSSDPHNQSGCILYSEISSLFLYSLRSEILAIKMNKRRCI

SEQ ID NO: 107346 - protein, 183 aa, Triticum aestivum
  Clone ID: PAT_TA_1764.pep
MKLAAPTLTKLTRALVQRGILKEVTDVRHRGKKVFMDARIEPSPEITGGTWYHNGQLDTDAVAAVRRRCLDQIDRLGAATPDMVHKGVEREDPRAGYAIDQIRDILQTMALDRVLEECRSTGEGEFSAVRAGRVCYRRGGAPQGGMIEGIPCGVCPRIDECSPDGVISPTTCVYYKKWLQMDF

SEQ ID NO: 107347 - protein, 88 aa, Triticum aestivum
  Clone ID: PAT_TA_1765.pep
MEPSSSITVASSSSYLSNGSSPCSGALAPLPAADGWGGAGGGGGSSSSVEAVSLSRLSSNLERLLLDSELDCSDADVDVADGGPSIPI

SEQ ID NO: 107348 - protein, 224 aa, Triticum aestivum
  Clone ID: PAT_TA_1766.pep
MEMDATERLRWRFSDGGLTDLLDARSLHGSPDIGKRMQFHSSLVQRLALEKEIEGHVGCVNAIAWNSSGSLLISGSDDTRVNIWNYANQELLHEIDTGHSANVFCTKFVPETCDEVVVSGAGDAEVRVFNLSRLSGIRPREVSMEPAAVYQCHSRRVKKLAVEGGNPNVVWSASEDGTVRQHDFRECSSCPRAGLVNQECRNVLLDLRSGGKNSLADPPRQPLS

SEQ ID NO: 107349 - protein, 267 aa, Triticum aestivum
  unsure (1)..(267): unsure at all Xaa locations
  Clone ID: PAT_TA_1767.pep
SIRKSGVLSVGGSSLKWSRSLEKRSQKVNEEATLAVADVEKKRGEKRKRQYLHYTGRNDQYSLSVAGNQLRNNNQASSDLRRSSTCNGYVRVSKGNQLVRNPKKVTRMLANEKVRWSLHTVRSRLAKKRQYCQFFTRFGECKKPKGECRYIHDPAKVTICTKFLKGLCSDTSCKLTHKVLPERMQDCSYFLKGLCTNTACPYRHVKVNSKAPACEDFLKGYCADGDECRKXHSYACPVXFEATGELPQQSTCKLPHPTKKTSNLREA

SEQ ID NO: 107350 - protein, 323 aa, Triticum aestivum
  Clone ID: PAT_TA_1768.pep
MAAASALLMAALAVFATAAAAALDTSPVPFDAGYAPLFGGDNLVRSVDGRSVTLKLDRYTGSGFISKSAYRHGFFGASIKLPADYTAGVVVAFYLSNWDEYPKNHDELDFELLGNRRGHGWRVQTNMYGNGSTARGREERYHLPVEPTVAGVHRYAIAWTPNNIVFYLDGVPIREVVGVPSMGGDFPSKPMSVYATIWDGSAWATDGGKYKVDYAYAPFAAEFSDLVLSGCDASSVADPEGCQVDLLTHDVAVMAPAKRAAMRGFREQYLTYTACRDRVRYKTTVFPECDDLADGDSSFHLWGESKKRRRRSSSPLQYSSSMQ

SEQ ID NO: 107351 - protein, 451 aa, Triticum aestivum
  unsure (1)..(451): unsure at all Xaa locations
  Clone ID: PAT_TA_1769.pep
MAAREGAMRMGTSALGRTLAEGHLRRGQCGXHVRNGRDAGGKILRRQRIRRVKIDEQIKTEIATLKLLKHPNMNLLYEVAASKTKIYMVLEYVNGGELFEKIALKGKLSEKEGRKLFQQLMDAVSYCHERGVYHRDLKPENVLVDAKGNIKVSDFGLSALPQHQRRTRXLHTTCGSPNYIAPEVLLNKGYDGSMSDVWSCGVILYVMLTGNLPFDDENMVVLYQKILKGDYRIPKWLSPGAQDILRKLLDPNPITRLGMDGLREHDWFNQSYTPAVPFDDDDDNYVGDDNSHMTKHNGIPDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKNDSIRQELYRFNSSF

SEQ ID NO: 107352 - protein, 156 aa, Triticum aestivum
  Clone ID: PAT_TA_1770.pep
HPAAAAAAPPAEPRARVPGAGEIDYSVEPEFYDPAVDDVDERWAHKQRKGRTSDAVLSCPACFTTLCLDSQRHEKYVNQYRAMFVCNCKVKTDQILREGKGKRKNRKVTAVDSTTPEVENKGPVYHPVCCEICSTEVGVFDEDEVYHFFNVIPSNS

SEQ ID NO: 107353 - protein, 588 aa, Triticum aestivum
  unsure (1)..(588): unsure at all Xaa locations
  Clone ID: PAT_TA_1771.pep
MAGAAAAAAAVASGISIRPVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGNRRPCMGALPLLCVHSLGGEKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAXGGAQEYFGITPDVTTLLVNVGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSNTAKFGRFHRGMLEEGVYLAPSQFEAGFTSLAHTTLDIEKTVEAAEKVLRRI

SEQ ID NO: 107354 - protein, 86 aa, Triticum aestivum
  Clone ID: PAT_TA_1772.pep
MAAKFLLLLVAVLATLLLVSMDVAHAQGSGGQNPQGYGAGNYNGGTGGAYKGKRCYGVHCQNGGTGGAYTGRGCYGVHCQNGGCHC

SEQ ID NO: 107355 - protein, 198 aa, Triticum aestivum
  Clone ID: PAT_TA_1773.pep
MAGRSRAPAFLLLGLFLGLAGSSPPPEPVECARGTSDCTVTNVYGSFPDRTICRAANATFPRTEKELVAAVAAAAASKRKVKVATRHSHSFTNLACPGGRDGTIISTERLNKTVSVDAAKGLMTVESGMVLKDLIQAAAAAGLALPHSPYWYGLTIGGLLATGAHGSSLWGKGSAVHEYVVGMRIVTPAPASQGFAVV

SEQ ID NO: 107356 - protein, 126 aa, Triticum aestivum
  Clone ID: PAT_TA_1774.pep
MVPLLRWEHSMHHWFEGDPASLTRLPQHCHVNLKSEKIIGFFPQNSMIELPWHLLQNATSLESLTVHASPAKYRCSGKGRKCCPLKATAIVKARKSILAVKKYIKGNVPSTVKLNVPKPCQRCHRF

SEQ ID NO: 107357 - protein, 197 aa, Triticum aestivum
  unsure (1)..(197): unsure at all Xaa locations
  Clone ID: PAT_TA_1775.pep
XVKMYLLGXIXSNPWIRSHPEVXIIIVRMEIISGYHLLYLGRRRRXLGVVDVEEHRGEDSARRFPTTEDAGREREQAEQQRGAQALAPVPAPPRLLLIRGVGVGVRRPCLRLQASAAAAQGQPLLVAAVAPPPAARLFLHDRAAPRYLSAPCSPCRAGRLEEASCLRFASGSGWSGQSCGRSAAGWALLPGLDHKGR

SEQ ID NO: 107358 - protein, 336 aa, Triticum aestivum
  unsure (1)..(336): unsure at all Xaa locations
  Clone ID: PAT_TA_1776.pep
RPRTRLIQSILDKKRRDPPPESSGNGVLRFYGGGARGVRNAAADLRRHEEAPGAGAGAAHHHEVPQGSAPLRPHRHQPRLVRQLLRAAARHRHRLRLLARLRARVPGAAAGAVRGHLVQDGAEVLRQXSKARFPALALGSHXSTGPTPSAGGSGKRDLVRLAARGGPRRAINVVLTADVVAVDGAGVGRCGSHGASPRSRAGRFAYVWVGNPATQCAGQCAWPFHQPQYGPQMAPLAPPNADVGVDGMVVSLASMVVGTVTNPFGNGFFQGPAEAPLEAATACAGVYGKGAYPGYAGSLLVDPATGASFNANGAHGRKYLVPARVDPDTSACSTLG

SEQ ID NO: 107359 - protein, 138 aa, Triticum aestivum
  Clone ID: PAT_TA_1777.pep
KSFRVRNRFQAGPFEVEPIRVTHSIPDCCGLVLRCGDGTIFHTGDWKIDESPVDGRIFDREALEELSKEGVTLMMSDSTNILSPGRSTSESVVASSLLRHVSEAKGRRVITTQFASNIHRIGSIKAAADLTGRRLVFV

SEQ ID NO: 107360 - protein, 282 aa, Triticum aestivum
  Clone ID: PAT_TA_1778.pep
MDLKDSLSRFKQQQERCQSSLASIAASQASTTKPKHRAQPINAPSAPARPAQPIKFSNDTERLQHINSIRKSPVGAQIKLVIELLYKTRQAFTAEQINDATYVDINANKAVFDSLRNNLKVQYDGRRFSYKSKHDLEGKDQLLDLIRCHQEGLAVVEVKDAYPSVLEDLQALMAAPDAPLGAILGALVVIGFPNAPFVMFHAAVHPWELFRGIELPRDMFDIEKELQKNGMKPMTDTTKRRAAAQIHGVKPKAKPKKKQREITKRTKLTNAHLPELFQHLKS

SEQ ID NO: 107361 - protein, 160 aa, Triticum aestivum
  unsure (1)..(160): unsure at all Xaa locations
  Clone ID: PAT_TA_1779.pep
MSSGRRRHGPPARSDKLQTRPDIPAGILPIRVELLKMVCTDLDVFCLFVQVAPLQVALNXIFYDFRNGLCRILVWLEIYIKGIDPQADKVVFNFDYPKTAETYLHRVGRSXGRFGHLGLXLTNLITYKYRFNLYXRIEQELGXEIKPIPPQDRPERYYCQ

SEQ ID NO: 107362 - protein, 143 aa, Triticum aestivum
  Clone ID: PAT_TA_1780.pep
MARRGTEAFPDLGAHCDREDCNQLDFLPFDCDGCGKVFCTEHRAYVEHGCPRAADQGRTVVVCEACGDSIERDGADKTDAEILETHARSRRGCDPARKLKPRCPARRCKETLTFSTTSHCKGCGQKLRLKHRFPEDHECSRVS

SEQ ID NO: 107363 - protein, 180 aa, Triticum aestivum
  Clone ID: PAT_TA_1781.pep
MARRGTEAFPDLGAHCDREDCNQLDFLPFDCNGCGKVFCTEHRAYVDHGCPLAADNGRTVVVCEACGDSIERAGSDETDAQILEKHARSRRGCDPARKLKPRCPARRCKETLTFSNTSHCKECGQKLCLKHRFPEDHGCSRMSPVGAAAAARRAGDCGRDAQKTKDGGGCALPPLIRNFN

SEQ ID NO: 107364 - protein, 202 aa, Triticum aestivum
  unsure (1)..(202): unsure at all Xaa locations
  Clone ID: PAT_TA_1782.pep
MKFSSLLFTASLVAAMPASIEPRQAQESINKLIKAKGKLYYGTITDPNLLQSQQNNAVIKADFGQVTPENSMKWDATEPQQGKFNFGGGDQVVNFASQNGLKVRGHALVWHSQLPQWVHNIKDKTQMKNAIENHIKNVAGHFKGKVYAWDVLNEIFDWDGSPRKDSPFTQVLGEEFVGIAFRAARAADPXGKLYIHDYSIDD

SEQ ID NO: 107365 - protein, 401 aa, Triticum aestivum
  Clone ID: PAT_TA_1783.pep
TAVGSLEYDEWSSHVQAWKLESAAIIEPQCNFIVPFHAQGKKRPRWALVDKAHLHNTWRCSQSSYHRYRTDANVSPSSLMVNLVKDLLDLSLHNYETVRSYAGRSRTRGLKHWPSLISDCVLTLTENLRDSKALEHVVLGSCSILASQTVLRHLTTDSASLSSFIMGILGSSHHESIKCQKAITELFVKYNIRFSGISRSFFKNSQSLADRPGFLGLFSQINALGFETNSLHWRYNLMANRVLLLLILASRSEPDIYSQILAETAGHFLRNLKSQLPHSRMLAISALNTLLEGSPHKASVEDPQQSLDHPEECNILSTGKLLNDIIQEEGFMNDTLNSLSHVHIISDSDGSSKASYGASSFQSGSDKAITYFYFDFSASWPCTPSWISLVGGGTFYSSFAK

SEQ ID NO: 107366 - protein, 76 aa, Triticum aestivum
  Clone ID: PAT_TA_1784.pep
MSYQQGYPQQGATAYPPPGQQQAYVAPPPAAYQQGQQYPPAGADTTSRGGHGHGGDGFLKGCCAALCCCCLLDACF

SEQ ID NO: 107367 - protein, 113 aa, Triticum aestivum
  Clone ID: PAT_TA_1785.pep
LKVDNSTANDIRTPDVFDNKYYVDLLNRQGLFTSDQDLHTDAGTKPVVTRFAVDQGAFFDQFVKSMVKMGQINVLTGNQGQIRSDCSLPNAARSSAGDELPWSVVEAAESFVL

SEQ ID NO: 107368 - protein, 136 aa, Triticum aestivum
  Clone ID: PAT_TA_1786.pep
ADHSGSSFAFMEDAVAPDTRAPSSKINATHSVNIVAESVASTKAGPVGRSSRRSSRDFDHAFLNEAMASETKAPSSRMNATHTVSIVSESVASQKAGPAGRSSRRSSRDFDHNGNSYASLLLEDIQSYHQQNASDT

SEQ ID NO: 107369 - protein, 138 aa, Triticum aestivum
  Clone ID: PAT_TA_1787.pep
SIHPEHGHTHTLGRISRRYTHRTRHAHTSLSFRTQAQGPRVSGIATTAVLHSTSEFTKPQSTVLRASVCARERQHTTHITYACRAPAASSELVAAHVSARPAVAEVVLVGLAAVPHDAVQLGERPAEVVVAEVQPVTD

SEQ ID NO: 107370 - protein, 238 aa, Triticum aestivum
  unsure (1)..(238): unsure at all Xaa locations
  Clone ID: PAT_TA_1788.pep
MASTASFLPLLALLLVATAHCSPLPQRCPQADRQALFRVKQALGSPLTLKTWSPASADCCAWDHLTCNEAGRVNNVFIDGADDVRGQIPSALAGLTALMSLSLFRLPGLQGSIPACLTSLSKLEFLTVSHTNVSGSIPESLARLHSLDSVDLSNNKLTGSIPNSFADMPNLRSLDLRRNQLTGRIPASLVQGQFRSLVLSYNQLTGPIPRDDAQDEINXTVDLSHNQLSGDASFLFSE

SEQ ID NO: 107371 - protein, 335 aa, Triticum aestivum
  unsure (1)..(335): unsure at all Xaa locations
  Clone ID: PAT_TA_1789.pep
MASTASFLPLLALLLVATAHCSPLPQRCPQADRQALLRVKQALGSPATLKTWSPASADCCAWDHLTCNEAGRVNNVFIDGADDVRGQIPSALAGLTALMSLSLFRLPGLXGSIPACLTSLSKLEFLTVSHTNVSGSIPXSLARLHSLDSVDLSHNKLTGSIPNSFADMPNLRSLDLRRNQLTGRIPASLVQGQFRSLVLSYNQLTGPIPRDDAXDEINTVDLSHNQLSGDASFLFLRGXRPSGKVDLSYNNLEFDLSKLKFPQELTYLDLSHNRISGTVPRSLEALSTLQTLDLSYNNLCGPLPKLHGVMRHGCKPYEHNMCHRGAPLESSCHQL

SEQ ID NO: 107372 - protein, 136 aa, Triticum aestivum; identical to SEQ ID NO: 106789
  Clone ID: PAT_TA_1790.pep

SEQ ID NO: 107373 - protein, 136 aa, Triticum aestivum; identical to SEQ ID NO: 106789
  Clone ID: PAT_TA_1791.pep

SEQ ID NO: 107374 - protein, 136 aa, Triticum aestivum; identical to SEQ ID NO: 106789
  Clone ID: PAT_TA_1792.pep

SEQ ID NO: 107375 - protein, 136 aa, Triticum aestivum; identical to SEQ ID NO: 106789
  Clone ID: PAT_TA_1793.pep

SEQ ID NO: 107376 - protein, 328 aa, Triticum aestivum
  unsure (1)..(328): unsure at all Xaa locations
  Clone ID: PAT_TA_1794.pep
AAFGTRRGQAEEVADVIEELEQTLATPTPLLRGIADAMVEEMERGLRADPHAPLKMLISYVDNLPTGDEHGLFYALDLGGTNFRVLRVQLGGKEKRAVQQYEEVPIPPHLMVGTSTELFDFIAAELGSVGETEGDDFHLPEGRHRELGFTFSFPVHQTSISSGTLVKWTKGFCINGTVGKDVVAELSSAMERQGLDMKVTALVNDTVGTLAGGIYADNDVVAAVILGTGTNAAYVEHVDAIPKWNGPLPRSGNMVINMEWGNFKSDKLPRSDYDXXLDFESLNPGXQMYEXXXPGMYLGEVVRRILLRLAHDASLFGDVVPSKLEXLF

SEQ ID NO: 107377 - protein, 60 aa, Triticum aestivum
  Clone ID: PAT_TA_1795.pep
DAWDSDGSFIPKPDYWGGYRLTPNLFEFWQGQQSRLHDRLQYSQREIGGGTEWHIQRLSP

SEQ ID NO: 107378 - protein, 442 aa, Triticum aestivum
  unsure (1)..(442): unsure at all Xaa locations
  Clone ID: PAT_TA_1796.pep
AAAXVTHLSQRDAADIDEQLMGPLGFSVDQLMELAGLSVATAVAEVYKLSEHTRVLIICGPGNNGGDGLVAARHLYHFGYKPFVCYPKRTAKPLYSGLVTQLESLAIPFVPVEDLPQDLSGQYDIVIDAMFGFSFHGAPRPPFDDLIQMLVSLSVIGDSAKRPPIVSVDIPSGWHVEEGDVSGGGIKPDMLVSLTAPKLCAKKFTGPHHFLGGRFVPPPISSKYGLELPPYPGTSMCVRIGKVPSVDISSLRERPISPELLENQVMPNPFDQFRTWFDEAVTAGLREPNAMALTTVNKAGKPSSRMVLLKGVDKQGFVWYTNYGSQKAHDLSENSNAALLFYWNEMNRQVRVEGSVQKVSEEESEKYFHSRPRGSQLGAIVSKQSTVISGREVLQQAYKELEQKYSDGSFIPKPDYWGGYRLTSNLAAFGLGQLAPRLGRLP

SEQ ID NO: 107379 - protein, 399 aa, Triticum aestivum
  unsure (1)..(399): unsure at all Xaa locations
  Clone ID: PAT_TA_1797.pep
RLFIFENMRYLRVLDLEDTLGLRDHHLDKIGQLHQLKYLSLRGCHNILCLPSGLGNLRHLQTLDVRGTRIFELPTTITNLRELQYLHADSGQNAGGNVKGDDIVQMYDADGFSEGGTCANCVFSSHVFLRPQVLDAGLNRYDIFNLYCFQERQLDGVVLPRGIDKLKVLHTFRXVNVSHSNGKTTLKPXGRLPQVRKLRVAGISSGNTKELWSAIAGHNQLGSLSVASEIFHGSLDGCLGEGLLPPSSLESLTLEGRLANVTKWIHMLQNLSKLVLRESYLSQDGDAIQALGFLPNIAVLRLWEAFTGIDLQFQSSSFPSLVELQLSRLYNLESVLFEEGTMPKLELLQVDFCVRLNGFSGLPAVLTSLKEIRLSNSKLKKDMERQVEHMKHVRVVRCV

SEQ ID NO: 107380 - protein, 552 aa, Triticum aestivum
  Clone ID: PAT_TA_1798.pep
MSLAVSALEAALQAVGRARDAAGDHRLLYCKGAGRLVTLDEARARDLPIGGGVLCGVPPDVEVEAYRGNPERSRPPPPGAAPDEPFVCSFDKMAEHFNRKASLLETVPLGSFNSLFSFTGSWKNDAAATKALAVDGYSVPLYRVKITSDELILQESVKLAIPYTWDPPALAARGENYGTHIITSVMVGGKDEVYIKQHSSSQLSEMEFRNYVREIGNERFSDVENKSNAPPINYSEKDMTVIFRRRGGCDLVQNSVEWIKTVSSAPDVIGMTFLPIVSLVDDIPGKKHIARAIDLYLTYKPPIEELQYFLDFQVPLVWAPVPLGIAGQNRKEPVCPSLQFSLMGPKLFVSTEQVSVGRRPITGLRLCLEGTKQNRLAIHLQHLGSLPKIFLPHWDSHITIGPPKWQGPEEQDSRWFEPIKWKNFAHVSTAPIEYTETNITDLSGVYIVTGAQLGVWDFGAKSVLHLKLLFSRVPGCTIRRSVWDHSPSSAMHRTDEASSSSSDNAKLVKIVDMTETLKGPQDAPAHWLVTGAKLGVEKGRIIVRAKYSLLNY

SEQ ID NO: 107381 - protein, 178 aa, Triticum aestivum
  Clone ID: PAT_TA_1799.pep
MAARRASARARPNVLVTGTPGTGKTTTCSLLADAAGVAHVNIGDLVREKGLHDGWDEDLDCHVINEDLVCDELEDRMEEGGVLVDYHGCDFFPERWFDLVVVLQTDNSILHDRLTSRGYMGAKLTNNIECEIFQVLLEEARESYKEDIVMPLRSDSVEDISRNVSTLTEWINNWRPSQ

SEQ ID NO: 107382 - protein, 178 aa, Triticum aestivum
  Clone ID: PAT_TA_1800.pep
MAGRRASARARPNVLVTGTPGTGKTTTCSLLADAAAVAHVNIGDLVREKGLHDGWDEDLDCHVINEDLVCDELEDRMEEGGVLVDYHGCDFFPERWFDLVVVLQTDNSILHDRLTSRGYMGAKLTNNIECEIFQVLLEEARESYKEDIVMPLRSDGVEDITRNVSTLTEWINNWRPSQ

SEQ ID NO: 107383 - protein, 364 aa, Triticum aestivum
  unsure (1)..(364): unsure at all Xaa locations
  Clone ID: PAT_TA_1801.pep
PTRPPTRPRTRGAMLTFESLAETAEFARRWVPFCKKFSIEPRTPEFYFSQKIDYLKDKIHPSFVKERRAMKRDYEEFKVRINALVAKAQKTPEEGWVMQDGTPWPGNNSRDHPGMIQVFLGETGARDYDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGIQGPVYVGTGCCFYRQALYGYGPPSLPALPKSSICSFCCCCCPKKKVEKTEKEIHRDLGREDLESAIFNLREIDNYDEYERHAYPQMSLEKSFGLXSSVFIESTLMENGGVPDLRPFYTDKHQYWV

SEQ ID NO: 107384 - protein, 251 aa, Triticum aestivum
  Clone ID: PAT_TA_1802.pep
GRPGRYCGGCRSSVEGPSHAQTQDRVVHRGDSNMNTADSSSGSLGRSTPSGVFHRPPPINVQPSLQGFDLNLSPIETPEEDKRAESHLSAEPVSTPTGRHATLDRRRALNRRIRILLFRPRTATNAWQNSIQQDRSAPATEQNQRNACTSTDVSPSCSRADFMQSQQSSSHFVQSASNLNQCTDEGGSNFREVANAKDQLIPIVKKSIKHICARSPLGTYSGLSKLFYRINFSSTHKLTFGCNSLILSLAY

SEQ ID NO: 107385 - protein, 213 aa, Triticum aestivum
  unsure (1)..(213): unsure at all Xaa locations
  Clone ID: PAT_TA_1803.pep
MGAGRRRTTTACVTGAGGFVASWLVKLLLSRGGGRYAVHGTVRDPGDAKNAHLAALDGAAERLRLFKADLLDYGSMAAAIAGCDAVFHVACPVLANHTPNPEADLIAPAVTGTMNVLKACSEAKVKRVVMVSSVAAVMVNPSWPEGKPMDEDCWSDVDYCRTTENWYYLSKTLAELQAFDYAKRSGLDVVTVCPSLXVIGPLLQPTVNASIRS

SEQ ID NO: 107386 - protein, 91 aa, Triticum aestivum
  Clone ID: PAT_TA_1804.pep
MERVASRCVSLLAQRRGYSAAAAMVKGARRSAPAAEEKTAVAAKSAMAARKEVGASAEKAAWVPDPVTGYYRPSGAPKEVDAADLRAKLCC

SEQ ID NO: 107387 - protein, 350 aa, Triticum aestivum
  Clone ID: PAT_TA_1805.pep
ARPAESHAAPPAAPPPCRPCPAPPCPPPSSLAATGPPSGGRGLAPAAPPPPPPPLPPPPRPGRPRRPAPPPPRRRRRPAAPQLPPRRQKRYVEELEEKVKSMNSVINDLNSKISFIVAENATLRQQLGSGGGNCAPPGMYPPGAVPGMHFPWVPGYAMRPHGSHVPLVPIPRLKPQQQVTATKATKKPENKKAVDSKSKSKTKTKKVASVSLLGLMLVMLVFGAFVPGFNHNFGLSGGSDNAMFRNFGQPHDRVVNVNNHGQAPKGGLNNSDMTGVDSGMMIGTDGSADREHQPPLNSSHAFPLGAYVCHAGSHVPCPSNPNSSAEVASDGDLDHGRTRRREQEGRGQQE

SEQ ID NO: 107388 - protein, 215 aa, Triticum aestivum
  Clone ID: PAT_TA_1806.pep
WADRPPVHVLQLNRFQGGGYAVGVSCTVLLSDPLSLARFLRAWARTHAEMKEQGKVAPTPMMQYMAYFQRPEICCKRIRSFPVDSVAADGVHAQTVLFRAAAGDPRALAAACIDRASEELGADRPSRFTLVVGPGDPARGATTVETSVTADGLKKGGAGHALEAAEWGELGLEELTIRDVKPVHVSYRIVSGGDEGLVVVMPDGHGFLITATVPK

SEQ ID NO: 107389 - protein, 379 aa, Triticum aestivum
  unsure (1)..(379): unsure at all Xaa locations
  Clone ID: PAT_TA_1807.pep
MASFASQTYTPTEEAEIQQWLTTSERLKSPEDKSTILETLNNHLSSRSTLLGSKPSKADVAIYETLAPVVAQWSPEERTGEKGHPHIVRHVDFVQNSPLFGLDVKDENKVKVNQDEVLYVKPQVDAKAEKEKKKKAAADASAAGDQASLVDRTKEKVKEVVESAKEKIATDKPNKKEKKEKAPKQKAAPAPAAPLSPALIDLRVGHILKAINHPDVDSLYVSTIAVGDKPGNEDYVEYEGQICRTVCSGLNGLVPLESMQGRKVVVVCNLKPVKMRGIKSCAMVLAASPKIKEGEVDDHKGPVELVTPPEGSKAGDRVWFEGWEGQPEGVLNPKKKVWEMFQPGFXTTGGLEVAFDAAAVEQLXKTGTGRLVTGERVSA

SEQ ID NO: 107390 - protein, 205 aa, Triticum aestivum
  Clone ID: PAT_TA_1808.pep
MSRASQLFLLADHIKLSLLERQRAKNLNLEGDSQDGHISRSFDQFRDGLTSLREEEQRLTEAGDATAASSLMESISSLQKQLDDLTAQFRGHPSSSTIETLTHPNSEELADDFDHATSTSPTSRKPKTVRFSDTPPSPSTELFGRYRDNPDDSAGYRDEAQEMDNQQLHQYHAQILEQQDEQLDRLGESIGRQRELGMQIGDELD

SEQ ID NO: 107391 - protein, 270 aa, Triticum aestivum
  unsure (1)..(270): unsure at all Xaa locations
  Clone ID: PAT_TA_1809.pep
MADPRESSSYSVVPRIRYNTVGGVNGPLVILDNVKFPRYNEIVTLTLPDGTERSGQVLEARGDRAVVQVFEGTSGIDVKKTKVKFTGESLKIGVSEDMLGRIFDGSGRAIDKGPKVLAEDYLDINGSPINPYSREYPEEMISTGISAIDTMNSIARGQKIPIFSASGLPHNEIAAQICRQAGLVQKQGITNKGVHDGHEENFSIVFGAMGVNLETARFFTRDFEENGSLERTTLFLXLANDPTIERIITPRLALTXAEYYAYXLEEHVLV

SEQ ID NO: 107392 - protein, 141 aa, Triticum aestivum
  Clone ID: PAT_TA_1810.pep
MRLVVGAGYPLTDWMLVPYSHQNLTWTQHEFNERVAKARAVAVTAFHKLKARWACLQRRTEVKVDDLSVMLGACCALHNICERSGEPFDLQLLQGLELDLDDDNHMVANDPVPSPAAGQMRDTIAHSMLHHGKVAGAGSFY

SEQ ID NO: 107393 - protein, 646 aa, Triticum aestivum
  unsure (1)..(646): unsure at all Xaa locations
  Clone ID: PAT_TA_1811.pep
RPIQTDTDNGIIPITDSEIGMTRQELVDWLGTFASSGTAKFLKTLKESQEANVDSDLIVQFGVGFHSGFHGTDKVAVXNKEPXSEKQYDWEAEAESNSYTIREXTDPERXIPRGTRPTQYLKRDDKSFAHPERLQKEMKNNPVEGWARICAXQHRGYPSEAMSSAYPGGLSTGADXTHGGGSRRRAGRPEVRIRFVGYQSMIHDKVHARVLSSNLSACSFFLMSVPVYTACMMSRASPXYTLILDRVVVDTNNSTEHFGLVXRKMLNYLLYVKRVFISDDFDGELFPRYLSFVKGVVDSNDLPLNVSREILQESRIVRIMRKRLVRKAFDMILGISCSENRDDYEAFWENYGKFLKLGCMEDKENHKRIAPLLRFFSSQSNEELISLDEYVESMKPEQKAIYYIAGDSLSSAKNAPFLEKLNEMGYEVLLLIDPMDEVSLTNLNSYKDKSFVDISKEDLDLGDKNEEREKEMKQEYSQTCDWIKKRLGERVARVDVSNRLSSSPCVLVAAKFGWSANMERLMRAQSIGDTSSLDFMRSRKVFEINPEHEIIKRLNAACRINPDDPEALKAIDILFETSMISSGFTPDNPTDLSGKIYDMMSTAMAGKWASQPQPAQPSQQPASPSSSEPEPLEAEVVEPVEAGQQK

SEQ ID NO: 107394 - protein, 311 aa, Triticum aestivum
  Clone ID: PAT_TA_1812.pep
MEVVTGAMGSLLPKLGELLVGEYKLQKGVKEDVESLQREMKSMNAALVKVAEVPRDQLDNQVIIWADELRELSYDMEDVVDNFLVCVEGIESDAVTDSNKLKQLIVKMANLFTKGKTRHQIASAIRDIKNRAQEVAGRRDRYRVDDAVANAAGKHKVDPRVLALYKDPKELIGIEDARNELTRRLTDGVGDGDVPKQQHMMKMVSIVVGPGGLGKTTLAKAVYDRLQTQFEYTAFVPVGRNPEVKKVLRDILLEVGKKQEHIGDVAILDERQLINILQRLLENARVLTAMSLLLLQSWRIASTFTRPPVAM

SEQ ID NO: 107395 - protein, 192 aa, Triticum aestivum
  Clone ID: PAT_TA_1813.pep
MDRKDKSRKSSSAASMAALAAAAAAGDVARADGMSGEEDQKLKLVNVPVVSVGGSSSSAAAVAVRRGSGAAGAVATGAAGAGGPSCQAERCGADLSEAKRYHRRHKVCEAHAKAAVVVVAGLRQRFCQQCSRFHELLEFDDQKRSCRRRLAGHNERRRKSSADANGGDGCRHADQDGRTHPGNPPLNHFQIR

SEQ ID NO: 107396 - protein, 226 aa, Triticum aestivum
  unsure (1)..(226): unsure at all Xaa locations
  Clone ID: PAT_TA_1814.pep
MSPPGPITTPLTSLLGIKHPIVLAGMARVSGGRLAAAVSNAGGLGIIGGFQYTPKQLREILAEMKANFSRPDLPFGVDLALPQIGGNARKTNHDYTGGKLDELADIIIDSGAKLFVSAVGVPPPEVIKRFHDKGILVMNMVGHPKHATKALELGVDMICAQGGEGGGHTGDVANSILIPAVADIASKYHPPLLKGLPALVLAARGISXGRSLASSLMQDASGVWVG

SEQ ID NO: 107397 - protein, 249 aa, Triticum aestivum
  Clone ID: PAT_TA_1815.pep
KWIPPKVLVFTPSIISSINPPFHAPEATVCSALSAFTEVLTAELRPLDIPVTHMQLGTFDFSSFVPTRGGPNQGLVMPAGNPESPLVWPEGARHVYARNFVAQTSSAISGGRIRGLKGSSLRRLHNSVFDVIDGDIVADTVRVGLGASVYGFVGRWAPRSLVSWMMGIRRVDELSTWKTSAFEGSESSDDEDDESEKGEDGTSSEFIAVSDDNVWHADTGGCLVSQGTRSIINDDMANYADHAMYIGSA

SEQ ID NO: 107398 - protein, 62 aa, Triticum aestivum
  Clone ID: PAT_TA_1816.pep
GRVFVTVTAVIAAEKADGKITHVYSIIKGFSVIAPEKALEIVQINHEDHQIRVEKDEVVTTD

SEQ ID NO: 107399 - protein, 196 aa, Triticum aestivum
  Clone ID: PAT_TA_1817.pep
MAMATANQDGAATQFHDHRGGTAATELHGRTISSEQEHGIIVAALRHVVSGYTTAPPEVVVAVACGRCGIDGCLGCDFFGATEPEAVAVGVPAGGVRKRRPRRKKEYIPRGGNQRWAKWAAGMIRDPRRAGRKWGGPFDTAEDAARTYDLAALEFRGPRARLNFPCSDETLRGHGSAHGADDEAGTSPQNETLTPP

SEQ ID NO: 107400 - protein, 113 aa, Triticum aestivum
  unsure (1)..(113): unsure at all Xaa locations
  Clone ID: PAT_TA_1818.pep
STSKYRPSKFQSSSRDTQHVCCFYTAERCLYSSSRRLHCTYIQLGIWVACLFAYDDTLSSRVCSVDKLLHTSRLLVXXKKKKKKKKKKKKKKKKKKKKKGKKKKKKAPKVEVT

SEQ ID NO: 107401 - protein, 331 aa, Triticum aestivum
  Clone ID: PAT_TA_1819.pep
MSDNLMEKVNALGERLKITGSEVGKQMQAGMSSMSFKMKELFQAQTPADKIVEDATAETLEGPDWAANLEICDLINTEKVNSVDLIRGIKKRIMLKEARVQFLALFLLETIVKNCEKAFSEVAAERILDEMVRLIDDPQTVVNNRNKALTLIEAWGESGDELRYLPVYEQTYKSLKSRGMRFPGRDNESLAPIFTPPRSVAEAEVAANFSQQTFEDVHVHTYTAEETKEAFDVARNSMELLSTVFSSFPQQDALQDDLTNTLVQQCYQSQHTIQRFVETAGDNEAMLFEALSVNDEIQKVLSRYEEMKKPVAPAHAEQAGGHIPIASMSGT

SEQ ID NO: 107402 - protein, 234 aa, Triticum aestivum
  Clone ID: PAT_TA_1820.pep
MTTAMMLAGVSHEYTRMSNAMKKYGQNIFFSLCEWGNENPATWARGMGGNSWRTTGDIADNWGSMTSRADQNDKWASYAGPGGWNDPDMLEVGNGGMSEAEYRSHFSIWALAKAPLLIGCDVRSMSPQTKTIISNQEVIAVNQDSLGVQGKKVQSDGGLEVWAGPLSGNRKAVVLWNRQGYQAAITAHWSNVGLPASASVTARDLWAHSSFSAQGQLSASVAPHDCKMYILTPK

SEQ ID NO: 107403 - protein, 435 aa, Triticum aestivum
  unsure (1)..(435): unsure at all Xaa locations
  Clone ID: PAT_TA_1821.pep
MPVDWSLSLLLALVGRAAVTPRGGGVGAGGRGQGIASLVELRARRGRREALENGLAWTPHMGWNSXNHFYCGISEAIIRETADALINTGLARLGYKYVTIXMCRWAXELNRDYQGNMVPYNRTCPSGINALADXVHTKGSKLGIYNDAGTQXCSTKTPGALDHEEQDVKAFAXFWGVDYLKYDNCNDAGRSVNERXTRMSNTMKKYGXKNIFFSLCEXGNENPATWGTWHGLVIAGWTTGGXLLTNWGQHDIPRGTRNDRPWASFAWYXGGFGTIARKARNSGSPEQCPGAVPAVEHHLAGHLPPAPLLLRCYARPMSARIPPILSNPXDIAVSQYRLAVLGKKVPCRGCAEVLAGVLSRSIEAVVLWNRQGSHAPIIARWSHVGLPWSAPGTAPYLWAXASVSAAGQRSASLWTGDCKKSILTPKYTRGASLAS

SEQ ID NO: 107404 - protein, 282 aa, Triticum aestivum
  Clone ID: PAT_TA_1822.pep
FTRLSAFNMAFFIDGKDCMISEWILLAVSYLFVGLRIYARLFRARQKLDASDWLLVVSAFNALALIICDTLTYQMGVLDEYETSVKLSKISFASNYFFYFGMGLPKLSMLAFYWAYFLPSNGVSSAMRKTLYGITAFVCISYLVILFDDTFFCGKDVSVQWSQEEGACSVFYAPDPFILNFTLNLACYFAVYALPLILLVQGVLKTSTGVMVTFVLGALTICTTMVRFITLKVGTGQENLVYPLSMLEMALAITVVALPGLRPLVSRPVKHETANESFYVKN

SEQ ID NO: 107405 - protein, 110 aa, Triticum aestivum
  Clone ID: PAT_TA_1823.pep
MFGAFRFTNPLSGGLLWKVPWRMSKFQKRRHRLRLRAVDDVVATVDAALAKKGQTLKALDRWKAEMPTEAEMLPRDKYTMFDRKAKRYRKGIHKLPKWTRVSQRVNPPGY

SEQ ID NO: 107406 - protein, 94 aa, Triticum aestivum
  Clone ID: PAT_TA_1824.pep
VNLLETAKAKRDACIEIISTWDEFIAALNNKKLILAPWCDEEEVEKDVKARTKGELGAAKTLCTPFDQPDLPSGTVCFASGKPAQKWSFWGRSY

SEQ ID NO: 107407 - protein, 273 aa, Triticum aestivum
  unsure (1)..(273): unsure at all Xaa locations
  Clone ID: PAT_TA_1825.pep
VEAFIPXTGRGIQGATSHCLGQNFAKMFDITFENEKGERSMVWQNSWAYTTRSIGVMIMTHGDDKGLVLPPKVAPIQVIVIPVPFKDADTTAIKGACESAVYTLNQAGIRADLDARENYSPGWKYSQWEMKGVPLRIEIGPKDLANKQVRIVRRDNGTKVDIPSTDLVEQVRVLLDGIQANLLETAKAKRDACIEIISTWDEFIAALNDKKLILAPWCDEEEVEKDVKARTKGELGAAKTLCTPFDQPDLPSGTVCFASGKPAQKWSFWGRSY

SEQ ID NO: 107408 - protein, 266 aa, Triticum aestivum
  Clone ID: PAT_TA_1826.pep
MARRRALALVSQLLQRRVLPAPRFLSSAAGGALDRLNSPPFARQAAHRNPAPPSPWDRLGGQKRTMFIQTQSTPNPQSLMFHPGKPVMEVGSSDFPNARTAMTSPLAKALFAIEGVTRVFFGSDFVTVTKSDETSWDYLKPEVFAAIMDFYSSGQPLFLDSNTAAAMDTAIHEDDSEIVAMIKELLETRIRPAVQDDGGDIEYRGFEPETGIVKLKMQGACSGCPSSSVTLKSGIENMLMHYVPEVKGVEQEFDGDEEAELAGQME

SEQ ID NO: 107409 - protein, 399 aa, Triticum aestivum
  unsure (1)..(399): unsure at all Xaa locations
  Clone ID: PAT_TA_1827.pep
MSTNKGGGGGKKKKEVKKETKLGMGYKKDDNFGEWYSEVVVNSEMIEYYDISGCYILRPWAMEIWELLKEFFDSEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADXEEVRQILELYRRIYEEFLAVPVSKGRKSEMEKFAXGGLLYNQRVEAFIPNTGXRGIQGATSHCLGQNFAXKMFDITFEXNKRVNGPMVWQNSWAYTTRXIGVMIMTHADDKGLVLPPKVAPIXFTLIPVPFKDAXQQLLKEACESXVYTLNQAGIRANXLLRENYXANWTYFHWETKGLRLRQVRVFQKRMSNNHVRKFKRKNGKQH

SEQ ID NO: 107410 - protein, 334 aa, Triticum aestivum
  unsure (1)..(334): unsure at all Xaa locations
  Clone ID: PAT_TA_1828.pep
LELFSGFTQLQELEVDIPGPLGDSAISILESLPNINLLNGVNASTIVENAKHVVDSALRPRVPEWSPEESLAERVIGXMWLYLMTYRLADEEKFDETPIWYVMDELGSAMRHSDDANFRISPFLFMPEGKLASAISYTILWPICDVHTGEECTRDFLFGIGEDKQRSARLTAWFHTPEKYFIQEFRKYQEQLQSTTICPTKEAPSTKSALPSDGRPLRVFTDIPQVEEFLTRPEFVLTTDPKDADIIWAGMQIDSELKSSLGLTDQQYMNQFPFEACLVMKHHLADTIHRAWGSPEWLQPTYNLETHLSQLIGDYSVRKRDGKDNLWIXEAWNM

SEQ ID NO: 107411 - protein, 192 aa, Triticum aestivum
  unsure (1)..(192): unsure at all Xaa locations
  Clone ID: PAT_TA_1829.pep
MREEVRSSSGAAAEPQFAVVRSSSPPPTPVASSAGASSPAMQINIVSIDWLGSRQASRVDSSSHVAPHAYGPAHSFDAAGTALDSAPSCRPWERGDLLRRLATFKPSTWDAKPKAASSLACAQRGWVNVDMDKIECESCGMHLIFSALASWSPTEVTNAGEAFAEQLDASHKNSCPWXGNSCADSLVXLHLT

SEQ ID NO: 107412 - protein, 214 aa, Triticum aestivum
  Clone ID: PAT_TA_1830.pep
REQKLELHRGGGRSRTSGSPGLQEFGTREIVTLGWYRGRDRSKLLLNCFFRTGCAAALLSNTASAAAPVKYRLVALKRTTIAADDGGYNLAVREEDDEGITGFTIGRGLGRLFRDLLRAHLPAFGASILPWHEKLRYAAALMRFHRHRRSIKNLQGGEGHVEAPKPNFLAAASHFCLPSSGMPNIRRLAEGLLGKLTFGGPPAPAPPRPGGGNG

SEQ ID NO: 107413 - protein, 251 aa, Triticum aestivum
  Clone ID: PAT_TA_1831.pep
SLLSTSALLNAFQGLRLCTSLPLRQLRAPLQQTSKTLDATRRLQNVRAFSTTSSMLGSWLEPNLNRKKKMAKGRPRVATGGSTKGTTVLFGEYGLRMTDHHRIFFAKQLKMAEDTIKVRLRGQKYRLYKRKNCNVGVYVSGNDMRMGKGKGSFDHWATRMAVSQILFEIRGKLHEQVVRDAFRLAGNKLPGQWEFVKRGDAPMVGITKLDGVTLEELKRPRRQIAPIELLEASKDTAETLVGSTSEASRNP

SEQ ID NO: 107414 - protein, 262 aa, Triticum aestivum
  Clone ID: PAT_TA_1832.pep
MSPSSVPAAAVATSTRLILVHGTGHGGWCWYKVATLLRAAGHRVDAPDLAACGADARRLSDAPTFEDYTRPLLDALRDLPDGERAVLVGHSFGGMSIALAAEEFPDKVAAAVFLTAFMPDCDAPRTRVIEEVPVSDWMDSVVDEEHAPPSVFLGPEFVRRKLYQLTSEEDYTLCQSLARVSSYYVADQQQRPPFSAARYGAVTKVYVIAKQDQAMVEEYQRQMIAGIPVAEVREMADADHMAMLSAPEGLAGHLADIANNYT

SEQ ID NO: 107415 - protein, 228 aa, Triticum aestivum
  Clone ID: PAT_TA_1833.pep
NLGRNPFQSPSITPREAEELSWRGIRRRLPDLHVRGSLESECTGAPESGRGCAPSCVTTTRSSPSPSPSYTSRNSTPDEKYGQLFVFSLRLALWMQTIGFSVRFLSSFIWIQMYRLGVSSSTPTYYEANDARNSFLSPRSNSVRRGSMADDILGGSIYDPSYYSSLFEDVRNNACNHQGDKHSGGNDGGSTSAGQSPRLKSFGSRSFLSNDVEAGLRRPLNSCSVETS

SEQ ID NO: 107416 - protein, 132 aa, Triticum aestivum
  Clone ID: PAT_TA_1834.pep
STRCQGGGGAVVLLHWRNWQHGHAAARPRRDAASVGGCVVVVGSPCHGRLRAARRRCDAAGVGNGMPSSSPGTGVARAPLTAVWIGRSAANSEISATSRPMEAGARAQIPAAALDPLSRIQEIVYARGNCPR

SEQ ID NO: 107417 - protein, 195 aa, Triticum aestivum
  unsure (1)..(195): unsure at all Xaa locations
  Clone ID: PAT_TA_1835.pep
MASPRRAYLPLLALCLVFLRHAAAQQADERQLLLEIKRAWGDPAELATWSAATGSPCAGWAHVSCDGAGRVTSLALPNVTVSGPPPDAIGRIASLATLDLSNTSVSGGFPKSFYNCTGLTHLDLSMNTLSGDLPADINRLGGNLTYLALNGNGFTGXVPPALSKLKNLTVLALGTNQLTGTIPPELGGLIGXQTL

SEQ ID NO: 107418 - protein, 133 aa, Triticum aestivum
  Clone ID: PAT_TA_1836.pep
IRHEARGLQGVPGLRKSKALIQGKLWTVVLASAALTIPFLVVDPALRAWVVQGARHGLGAGGRLLLGLVILAALCSVVMVALVVQTVVYLVCKSYHHESIDKSNISDHLEVYLGDYVPLKASDVQMQHFGDEV

SEQ ID NO: 107419 - protein, 276 aa, Triticum aestivum
  Clone ID: PAT_TA_1837.pep
SLDTQGGELQLLTVDHRLEENVEERERVTASGGEVGRLNLFGGQEVGPLRCWPGGLCLSRSIGDMDVGEYIVPVPHVKQVKLSSVGGRLIMASDGIWDALSNEAAAKSCRGLPAELAAKLVVKQALKKCGLKDDTTCVVVDIIPSDHHLTSPQLSPKRNQNKLKSLLFRRRSHSSVGKFGGKSASIGSVEELFEEGSAMLEERLGRNLSLKAASPPSRCAICQVDQEPFEGLMEENGGSHCSSPYAPWGGPYLCLECRKKKDAMEGKRPSCSTACR

SEQ ID NO: 107420 - protein, 245 aa, Triticum aestivum
  Clone ID: PAT_TA_1838.pep
MAASLRTGSAMLSRIATPSTCLARRTFTTSLAFRTGPKITTEEESSPAVNPLARSDPFVSDPSAEARSEAHDEAASETRPNPLIGSFPPAPPRNVPETAESKTSSHTYDATKPYTLDIAQIIANKASAFGNEQASDPIARPQIRAKPVTGRTVFVKEFITKTSGPTPMMALKILNRIVREDQVKNKYHSQKFHERKGLKRKRLASQRWRARFQHGFKATVSRVMELRSRDGRCSSLNIGKSIVVL

SEQ ID NO: 107421 - protein, 267 aa, Triticum aestivum
  Clone ID: PAT_TA_1839.pep
MAAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSVSEHMIESGWTRCFFHISEVGWPMYIVYVSLYLIFVEFGIYWMHRELHDIKPLYKHLHATHHIYNKENTLSPFAGLAFHPLDGILQAISHVIALFLLPMHFRTHIALLFIEAVWTANIHDCIHGKIWPVMGAGYHTIHHTTYRHNYGHYTVWMDWLFAP

SEQ ID NO: 107422 - protein, 226 aa, Triticum aestivum
  Clone ID: PAT_TA_1840.pep
VPIYFGDYPASMRAQLGDRLPTFTPEEKALVLGSNDFYGMNHYTANYVKHREGEAAPEDFVGNLELHFWNHRGDCIGEETQSTWLRPCAQGFRDLLVWISKRYGFPRMYVTENGTSIKGENDMPREKILQDDFRVQYYDDYVRAMADASRLDGVDIHGYFAWSLLDNFEWAEGYETRFGVTYVDYENDQKRYPKKSAQHLKPLFDSLIKKEENGLNGVGKVKAGQT

SEQ ID NO: 107423 - protein, 99 aa, Triticum aestivum
  Clone ID: PAT_TA_1841.pep
MASVGPTLESLVDQVISVITNDGRNIVGTLRGFDQATNIILDESHERVYSTKEGVQQLVLGLYIIRGDNIGVVGEVDEELDAALDMSKLRAQPLKPVIH

SEQ ID NO: 107424 - protein, 225 aa, Triticum aestivum
  Clone ID: PAT_TA_1842.pep
MRFSSSTVLAALPALAAAQDSPVDQYKAQFQNVIGQFASYIPNPAYHDPVAAAEAKAGSMRLSVLTLDNWKETLYEPVSADATTPEEWWLLVSGGNKTCYGRCGTVEQAFNETAAKFALLDKTPHMAYLNCDNQPILCNSWSAGPPSLYVFEMLPEPAAVEVYSKRLNLTTTTSDTLVALQASGSKEEFHRHTSAWFHPVNGKLAEHGLAIPFGYLMWAMKLVPT

SEQ ID NO: 107425 - protein, 276 aa, Triticum aestivum
  unsure (1)..(276): unsure at all Xaa locations
  Clone ID: PAT_TA_1843.pep
MQFSLLKLATYAGLIQAAAAAVPVGTPITSCTVDKNIALTFDDGPFDYTTELLDQLKKYGYKATFFLNGNNWGNINDYKSVVQRMINEGHQVGSHTYSHPDLATISSAEIRTQMTRLEADFLNIIGKYPTYMRAPYFSYGSNALPVMKTLGYHVIGADVDTLDWEYNTPAETDIALKLFKQGTTXSGSISLFHDVHVNTVRNLIPKVLDAVKRSTRIPVTVGQCLGDPAANWYKTTKRTKRDFEDDEEAEDEKTVDERSLSEYIERSRFRRHAHHA

SEQ ID NO: 107426 - protein, 195 aa, Triticum aestivum
  Clone ID: PAT_TA_1844.pep
NILGKIAPIRWVFSINFRLASASVISLEDRLTLESHARWGNRCTSTVRLKRGRMAHEDKNYWRTHMRKKAQERKRNVSPSSSSSSVTYQSIQPQTPSIVGIGEQELHGGSSCITSILKGTPADMDGYLMDQIWMEIEAPSGVNFHDGKDNSYSSPSGPLLPSPMWDYYSPEAGWKMDEIKMAPQVSYSKGIGPSY

SEQ ID NO: 107427 - protein, 244 aa, Triticum aestivum
  Clone ID: PAT_TA_1845.pep
PPPTNKQKPRRSLVSQTSEVGSTVRRLFPEMAAPAAAAAAVVVLFDFDKTIIQWDSDDWVITKLGAADAFNRLRPTMRWNSLMDRMMGELHAQGRSADDIRECLRSAPLDAHVLSAIRTASALGCDLKVVSDANSFFIETVLEHHGVLGCFSEINTNPARVDAQGRLRISPFHDPTTSPHGCSLCPDNMCKGKIIQRIQGTDGAKNKHFIYIGDGKGDYCPLLTREGIFMPKENIPLDLQRSQL

SEQ ID NO: 107428 - protein, 119 aa, Triticum aestivum
  Clone ID: PAT_TA_1846.pep
PAPPPPPPRLWPPRRARAPAARRSPPPRAWIWATAASAPGPGCAPAAPRRPARSSSGGPGAGSPPAACSSSGGPAAGPLSAVSSRPRCSSSCRPSPAHAATHQIGCGNLGGTGDLGLAG

SEQ ID NO: 107429 - protein, 63 aa, Triticum aestivum
  Clone ID: PAT_TA_1847.pep
IQQSSKRINQSSIEEENGILCTSINVRSSPVCFLHGPVKRQVTNIQTKYIGYLNIGHVPFLLQ

SEQ ID NO: 107430 - protein, 141 aa, Triticum aestivum
  Clone ID: PAT_TA_1848.pep
MAKGKFKGKPTGQRTFSSKEELEAGTSADRPKTFSKKKQEVSNRREESIEEESDEEVEKTKHKGTAGLIEIDNPNLVKPKSIKAKDVDVDRTTDLSRREREELEKQRARAHYMRLQEEGKTEQARKDLDRLTLIPRQREEA

SEQ ID NO: 107431 - protein, 419 aa, Triticum aestivum
  Clone ID: PAT_TA_1849.pep
TLTLRIADQSRTSGISVTFFANNTALLPCVRSSGDIISLHNVVVKVLHGEFFVTMEKRFSSFALFGGMVSTEFRPYQISMKHQGTKHDNQILTQMRMWLVYHPPGLKDLELQLRNIKSDSTFDLVCKVLHVCEAPSGEWIFYVWDGTDTPPTELQTRLDMEAVTPTPLHPEEAPLPREVLCTLPCVGTVLRVFSNRFSKEILHLQKDIYWARFCNITCKQEFGMWKGSLLPSSRIRLLSSEDGSVIERLKTFDGRFATQVHREPMASLHTASDITDVEFKRAGYTTLMESLTHGQVTHKFKTLVRVVAAYPCQGKELHSLLTGDYCLRLTLEDPTARIHAYVHKDNAVSFFGGFLTLAALTRKMNRLLGVPEPEDDAEEGMAGGRNPPWIWCCLKSYRLDKYDPWGSRRYRIFGTEIRD

SEQ ID NO: 107432 - protein, 161 aa, Triticum aestivum
  Clone ID: PAT_TA_1850.pep
MGLFRAASGLARVALRRSLSRAPASPFAGPAPRYFHSTLPRRYAAPEPRAVPLSRLTDSFLDGTSSVYLEELQRAWEADPTSVDESWDNFFRNFVGQAATSPGISGQTIQESMRLLLLVRAYQVSGHMKAKLDPLGLEQRAVPDVLDPAFYGFSESDLDRE

SEQ ID NO: 107433 - protein, 210 aa, Triticum aestivum
  Clone ID: PAT_TA_1851.pep
MSGSGYDAVVDVDDEGDLGHTDLQEDLEFHTSNFNDTNPNTRKPPSGGSGLPAPATASSGSGSSKRFLWSMNFYAQFFDVDTSAVLSRCWAALFPRANFLDVLEGNPDLYGPFWIATTVVLILFLGGTISQYMSDTGKGPFLYDFKLLSGAAGLIYGYTLFIPMGLFLALRYFGSESANLLECWALYGYSNLIWIPVALISSSPISILNW

SEQ ID NO: 107434 - protein, 224 aa, Triticum aestivum
  Clone ID: PAT_TA_1852.pep
PPLVVQQASAAPSPTPAMADPAEHREEEEEAAAAGEEEDTGAQIAPIVKLEEVAITTGEEDEDVLLDMKAKLYRFDKDGGQWKERGTGAVKLLKHKETAKVRLVMRQAKTLKICANHLVVATTKMQEHAGSDKSCVWHALDFADCELKEEMFAIRFGSVENCKKFKDLVDEIAEQQGKNEEKESEEVSSAAELVEKLTVAEVKKEEQTEKVETPAVDDKKDAEK

SEQ ID NO: 107435 - protein, 226 aa, Triticum aestivum
  Clone ID: PAT_TA_1853.pep
SQEIELERFPTLLVANKFESLECQSTIDGQTAATTMSDTVVITVAVDNSIVGERGAIQWPATRKGLQTGTPSAEGIESVMFTYRFMEDRPGTYHTCDDQHPTTMFTDVQETEAGSSHSEHDAVNVPHGDEEQIRYGFPHTTDREVMAYTPGGRGHAALASSEAKLMAGNSVIYRNDEGPVERLLRWVAGICRGRDHNVYACPEAQLMADCSVIHLNDKGPIGWLLR

SEQ ID NO: 107436 - protein, 162 aa, Triticum aestivum
  Clone ID: PAT_TA_1854.pep
ATMSASSSSSLPVPADFPLDLIRCPFCGADLETNVARTGSKAGQRFYKCVRYDTAYVRRMTPYQIARAQQQAGVLQVQMQANPAGIVAPPANQAQVQANQGQNHPLATPETVLVNQIFRPIAAAASGSQALGATAFILAASNIMLTLLLLLFVVAIYFGGGN

SEQ ID NO: 107437 - protein, 278 aa, Triticum aestivum
  Clone ID: PAT_TA_1855.pep
GQGGSRSKDNAHSSSPPAEASGEPIRPPQVGAPSAASPTFPLMYPMLVPGMFSQQGMDDQAQGPGIYAIQENQFMGAMGGYAPKTFIPLAYNIPSSESVGPLAGEEQGQDARQQNGPQRQVVVRRFHFAFQLDLALIIKLAAVVFLFSQEGSKQRLFLLILFASMIYLYQTGAITPFLRWLQRAGGVAARPPQAPANRAPLAAQNDGNEQPGGNLADPANPDQAAENQEPGAAAGNENQQGAEGEANRRSWLGGILKEVQLVVVGFVASLLPGFQHND

SEQ ID NO: 107438 - protein, 154 aa, Triticum aestivum
  Clone ID: PAT_TA_1856.pep
RLGRAAAAWVPRVRCPHPVHCRSAAIGVLRATLHHTPGWHHAANDDPMVMTTCSLSSLRWRSSILHPLPGTRYAAVHSSMLHPFRPISDGAALWYQPVATRPVTPPRAGSALSRPGCSSPHAAITERTCFPSTRARTTARTLCHCSLCPSRLAA

SEQ ID NO: 107439 - protein, 528 aa, Triticum aestivum
  unsure (1)..(528): unsure at all Xaa locations
  Clone ID: PAT_TA_1857.pep
VRSPANSSVASTPARGGFKRPFPPPSPAKHIRALLARRHGSVKPNEASIPEGGEPELGLDKSFGFSKHFFAKYELGEEVGRGHFGYTCAAKAKKGEHKGQDVAVKVIPKAKMTTAIAIEDVRREVRILSSLTGHSNLVQFYDAFEDEDNVYIVMELCKGGELLDKILARGGKYSEEDAKVVMLQILSVVSFCHLQGVVHRDLKPENFLFSSKEENSPLKVIDYWLXSTFVKPDQRLNDIVGSAYYVAXPEVLHRSYGTEGXCWSIGVIAYILLCGSRPFWARTESGIFRAVLKAEPSFDEAPWPTLSAEAKDFVKRLLNKDYRKRMTASQALSHPWIRDAQQVKIPLDMIIYKLIRAYISSSSLRKSALRALAKTLTANQLFYLKEQFELLGPNKSGFISLQNLKSALVKNSTDAMKDSRVIDFVNTVCTLQYRKLDFEEFAASAISVYQMEALETWEQHARRAYELFDKEGNRPIVIEELASELGLGPSVPLHVVLQDWIRHADGKLSFLGFIKLLHGVSSRSIPKA

SEQ ID NO: 107440 - protein, 153 aa, Triticum aestivum
  unsure (1)..(153): unsure at all Xaa locations
  Clone ID: PAT_TA_1858.pep
MGRMHSNGKGMSSSVMPYKREAPAWVKTSAPDVEEIIVRAAKKGQLPSQIGALLRDGYGIPLSKAVTGAKIVRLLKTRGLAPEMPEDLYFLTKKGVAIRKHLARNEVQSCDPKFRLILVEXSRVHRLTRYYRLTKKIPAAWKYESTTASTLVA

SEQ ID NO: 107441 - protein, 382 aa, Triticum aestivum
  Clone ID: PAT_TA_1859.pep
KDREDVHMNIEAALIEKVGEPAKKLHTARSRNDQIVTDLRLWCRDAIDKILIRIKQFQVSLVLLASKYVDLIVPGYTHLQRAQPVLLPHLLLSYVEQLERDAGRLIDCRERVNFCPLGACALAGTGLPIDRFKTAKDLKFTAPMKNSIDAVSDRDFVLEFLAANSIAAIHLSRIGEEWVLWASEEFGFLTPSDSVSTGSSIMPQKKNPDPMELVRGKSARVVGDLMTVLVLCKGLPQAYNRDLQEDKEPLFDSVKAILGMLEVCSEFAQNISFNSKRIQSSLPAGYLDATTLADYLVKKGVPFRTSHEIVGRCVALCVSKNCQLTELEMDDLKAVHPVFEADVYAYLGVENAVNKFISYGSTGSEQVKKQLEDWRVQLGINP

SEQ ID NO: 107442 - protein, 99 aa, Triticum aestivum
  Clone ID: PAT_TA_1860.pep
DKRSLSILFVSTSRPCSTANVIPLSSTARKDLGAEPLISQVTKKELKHVPFPLRSLARNRYHRRPEQSDPRRHPSSSHPNRCAVVDNNKRKNPKNKKLL

SEQ ID NO: 107443 - protein, 342 aa, Triticum aestivum
  unsure (1)..(342): unsure at all Xaa locations
  Clone ID: PAT_TA_1861.pep
SARARAAVGFMPPEPTLQSLHVPHGALSSLGVGGVFVPVRDVFQARGLGSRGRVASPRWSLLAPEVPSARIFXKSKHETAEFHGAARALSGGGVYVSDKPGVHDFTVLKKLVLPDGSILRARYAGRPTRDCLFNDPVMDGKSLLKIWNLNNLSAVVGVFNCQGAGNWTWLVEEISHVPTAVNITGHLSPSDVESLEEITGDEWNGETAVYAFNSCSLSRLQKHQSLELSLVTMTCEIYTISPIQVYGGAVRFAPLGLLNMFNSGGALDSITGTVDSSATTVQIKCRGPGRFGAYSSARPALCRVDAHEVEFSHSDDGLLAFDLSDGSSHSSLWNIEILYTAS

SEQ ID NO: 107444 - protein, 279 aa, Triticum aestivum
  Clone ID: PAT_TA_1862.pep
MQYRLSERASGDATHLYLTFSQMDGAVLSNNWVVSPFPSYIELTGIVLKRQLSVGGFIEIDLMNVFMRRFQQLENAWARKYGDSPWRHYLEPDFMSHVLRGGGFIHNDYVRNIFVGHHISHDVNRCPMMVLPVHHAHAWSTYIFDFPRRRTTILDPMINNGDRPADELRNEHIKIADELRGALMECIAEYFDGWTPKTKGWQNWFPKLTTGPWVCSRASSGVMALHYARQWMGTKLQRTLSPMGDEIDQSRMILFYEVLGLAGNIGQLPTKFKICQNVC

SEQ ID NO: 107445 - protein, 80 aa, Triticum aestivum
  Clone ID: PAT_TA_1863.pep
MSYQQGATATAYPPPGQQQQQAYVAPPPPAGYPQKDQQYPAAAGADTTTSRGGHGHHHGGGFWRGCCAALCCCCLLDACF

SEQ ID NO: 107446 - protein, 352 aa, Triticum aestivum
  Clone ID: PAT_TA_1864.pep
PLIRSLEARDHIPPFWRIVEVPRKHFTRSKWGFLNLAAKLPPDALQSEVGLKLLIAYGRQQQPRKSDSVTNLMVKMGDVVHMLMHRAEMRYLCSKSLQPEQPERIANGMAVHVNAHAPVQNLNLDMGEQSPEHTVSKSWSPSGRSSAELSSSSHSEQPKTNGVERSQPGALWDVFRRQDVPMLNKYLASNWEELTNNSQAMLSVKHPIYDQAVYLREHHKRVLKDQYGIEPRTFEQHIGEAVFIPAGCPYQVKNLQSTVQLALDFLSPESLRESARMAQEIRCLPNHHDAKLKMLEVGKIALYAASSAVKEIQKITLDPKFNLDIRFEDQNLTRAVSENLARVTKQRKVSCG

SEQ ID NO: 107447 - protein, 123 aa, Triticum aestivum
  Clone ID: PAT_TA_1865.pep
RLINDGYSQEHARACTYRAVQALCSQGVDIFVTLPATPVVITGPTHNLLRALFLFYLFGEDWFRYIAYGVTAFLKHAWPKVELSPPCHVLCARSYTTSPSPTVTGIGTVMIRFARAAEKCTML

SEQ ID NO: 107448 - protein, 163 aa, Triticum aestivum
  unsure (1)..(163): unsure at all Xaa locations
  Clone ID: PAT_TA_1866.pep
MHPHNKLTMLHAEQADKETRHGEGENPLNFGLREDTIIRRFVGSAVVDEPKVENACHHGLVDPTINLKEAMSDINNMFGKTTELPRMVKNQTRKTNAVSERKAXPVSGFCILADDDISKDPAAKDKSSNSCTFGSESGLFEPTITTRDVMSEINDMFGMSLDF

SEQ ID NO: 107449 - protein, 198 aa, Triticum aestivum
  Clone ID: PAT_TA_1867.pep
LSPIILCVLGLFFSNSAFTFFFSAFSTFSSCLIFLSLPFVPNGQKDNLERANGILCAVDARFFYVLAIFRVPYSILFPIKQRLGRHAPNDDELRVSFGDPARASLLVHRRHHRGVDRLEPGRLGDHKAQPPQAGTELGVVGLVRPGREPIRRQEANVLRDGVPVDVEVLQLLAAANEAAVVMHLGERRRTFDQVFVLG

SEQ ID NO: 107450 - protein, 291 aa, Triticum aestivum
  unsure (1)..(291): unsure at all Xaa locations
  Clone ID: PAT_TA_1868.pep
NKQRRKAQPPPPADSSAFSTRPRPPGPPALPLGPSLPATRPPPAGPPPRLPAPPPPARPPRSPPRSPPPGRSAGRTRPPPAAAGAAGAPLPPPSPAAPYAASATDFLTLCHGVKSTKREGWINHSFKGSESIADHMYRXSALLALIADXTYLSVKSXQRCFKIAILHDIAEAIVGDITPSDGIPKAIKSGREQAALNEMCEVLGGGSTAEEIKGLWEEYENNSSVEANLVKDFDKVEMILQALEYEKEHGKVLDEFFLSTAGKFQTEIGKSWAAEVNSRRTQWMWTELGVT

SEQ ID NO: 107451 - protein, 394 aa, Triticum aestivum
  Clone ID: PAT_TA_1869.pep
MGSFAKLAKRCVETEAPVMVKIQELLRGVTDVMSLAQGIVYWQPPEAALNKVKEIVWEPATSKYGADDGLPELREALLEKLRRENKLTKSSVMVTAGANQAFVNLVLTLCDAGDSVVMFAPYYFNSFMSFQMTGVTDILVGASNPKTLHPDVDWLEKVLKENNPIPKLVTVVNPGNPSGAFIPKPMLQRISDLCRNAGAWLVVDNTYEYFMYDKMEHYCLEDDHIVNLFSFSKAYGMMGWRVGYIAYPSEADGFHAQLLKVQDNIPICASIIGQRLALYSLEAGPEWIRERVNDLVKNRELLVEAMSPLGEDAVKGGEGAIYLWAKLPDNCSDDFEVVRWLATKHGVAVIPGSASGGPGYIRVSFGGLKEEDTRLAGERLRRGLQELVTDGMVQ

SEQ ID NO: 107452 - protein, 291 aa, Triticum aestivum
  Clone ID: PAT_TA_1870.pep
VSRVQVSYSVSFGLYYCCICVRVILVILFNFSCWSAKKKKKNASGSPLPVETPRRDEIPREDPTPQPSAPPVVAPNETPVEEDEEDEFAQLAKRKNKSVISSDEASSSVGDHALIPIDDATSEASSSVASNALVPVESASVSGTRTKEQDMIDLLSLTLYSPPEASTDSSTQSQNGSQQTAVSNGSHLPPNYQPAASNGQHYPSNHQAYPINQGYTPYNNYVAPWAQNARMNGNQRPKEAPATAAKPYYMPDNLFGDLIDVKSFGAAGKTSRSANVPGPKGGGQPMIGGKK

SEQ ID NO: 107453 - protein, 341 aa, Triticum aestivum
  unsure (1)..(341): unsure at all Xaa locations
  Clone ID: PAT_TA_1871.pep
MLSAAFAVHPAAVASQRHSVRQRQQFCAPIGTATPRRRLPVAMLSVTNAVATQSRESAPASPRKLSFPILVNSCTGKMGKSVAEAAVSAGLQLVPVSFSAIEVPDGKLNICDTDIHIHNPSESERILRSIAKDYPDMIVVDYTVPDAVNANAELYCKLGLPFVMGTTGGNRQLLNKTVQDANVYAVISPQMGKQVVAFLAAMEIMAEKXPGAFAGYKLEVMESHQATKLDVSGTAKAVISCFQKLGVSFDLNEVNLVRDPEEQLAIVGVPEEHLGGHAFHNYHLTSPDETVSFEFQHNVCGRSIYAEGTVDAAMFLHTKIRSGAGKKLYDMIDVLREGNMR

SEQ ID NO: 107454 - protein, 222 aa, Triticum aestivum
  Clone ID: PAT_TA_1872.pep
MAAFPSLTWDLACARHHEEHQVSHNFQAASRVSGISCMIPLAKLKEQSSGFLVKDSCVFGIQFIKVVAVKGNDVSETLFVQKISNICSDPQVYTWNIDDFFVLKNPSTSPEFELCGHKWLITIYPSGSDKNPNYLSLYLNMKDSLHKDSAILADVSITIKDQETGKHKKLSARLQLKNCAPTWGWGKFISLEDFKDSSQGYLVKTKCCIEAQIAVIGSSKTE

SEQ ID NO: 107455 - protein, 232 aa, Triticum aestivum
  Clone ID: PAT_TA_1873.pep
GRVIRGKATARASATLISAARRLLATALLDDPANRFFALLSQSCVPLLPFPALYRTLLTEWDAAGAGRHRRHRSFIEILDSEPTLHARYYARGDNVMLPEVPFDRFRVGSQFFVLARRHAVMVVRDRRLWNKFKAPCLVKEKDSCYPEEHYFPTLLDMQDPDGCTKYTLTRVNWTDAVGGHPHTYQPEEVSGDLIRELRKSNGTYSHMFARKFAPETLAPLMEIADSVILRD

SEQ ID NO: 107456 - protein, 203 aa, Triticum aestivum
  unsure (1)..(203): unsure at all Xaa locations
  Clone ID: PAT_TA_1874.pep
ARAQNRIFADERSTCEQLLSHPFIKRYEEARXVDLAAYVGGVVNPTERLKQIAEMLVVHYYLLFNGSDGSWHHMKTPYMEESSFRFSGNVYVGQSAIFDTLSTIRNKFKGDQPSGGIFHVVEKIHCGADGEREITVRVSGSFIVGNQFLILGEGLQAEGMPSPDELAIDIPSNRAGQFREQFIMQPGISMECYYIPRQDLSIS

SEQ ID NO: 107457 - protein, 83 aa, Triticum aestivum
  Clone ID: PAT_TA_1875.pep
MHRIAFWSLFGLGARFWQMGIEMRPFFNKSSLWVYPVYAAGGASFGYWLQGVDDRQTDTLKERKNILLEKRARKAEKDAQAEA

SEQ ID NO: 107458 - protein, 163 aa, Triticum aestivum
  Clone ID: PAT_TA_1876.pep
QGENEDVTEEAVSTTLKRALSTFSTLQAHDGYWPGDYGGPMFLMPGLLIMLHVTGPTRPVLSPEHQKEIRRYLYNHQNEDGGWGLHIEGPSTMFGSALTYVSLRLLGEGPDSGDGAMEKGRNWILDHGGATYITSWGKFWLAVLGVFDWSGNNPLPPEIWMLP

SEQ ID NO: 107459 - protein, 80 aa, Triticum aestivum
  unsure (1)..(80): unsure at all Xaa locations
  Clone ID: PAT_TA_1877.pep
MFDGAXTLLPADELSKKFEQEGILLDHPIVVTCGSGVTACILALGLYRIGKHDVPVYDGSWTEWEAQPDNDYPKVASTAP

SEQ ID NO: 107460 - protein, 113 aa, Triticum aestivum
  unsure (1)..(113): unsure at all Xaa locations
  Clone ID: PAT_TA_1878.pep
CPVKGRFDGVXPEPRKGVRSGHIPGTKCVPFPEMSDGAQTLLPADEISKKFEQAGISLADPIVLTCASGVTACILALGLYRIGKHDVPVYDGSWTEWEALPDNDYPIVTSAGS

SEQ ID NO: 107461 - protein, 307 aa, Triticum aestivum
  unsure (1)..(307): unsure at all Xaa locations
  Clone ID: PAT_TA_1879.pep
MAQDDPVVSAQWLQQHLGQPDIKILDASWYMPHESRDAWQEYQVAHIPGALYFDIDGISDRTTHLPHMLPLEEAFAAAVSALGIXNHDKVIVYDGKGFYSAPRVWWMFRILGHDKVWVLDGGFPQWQASGFNIGSSCPDDAVLKSKAANIAVETAYNGELANAATFQTEFRHQLLWTLEKVKHNVAAKAHQVVDARVKGRFDGVMPEPREGVRSGHIPGTKCVPFPEMSDGAQTLLPADELSKKFEQAGISLDGPIVLTCASGVTACILALGLYRIGKHDVPVYDGSWTEWEALPDNDYPIVTSTGS

SEQ ID NO: 107462 - protein, 129 aa, Triticum aestivum
  unsure (1)..(129): unsure at all Xaa locations
  Clone ID: PAT_TA_1880.pep
PRXNPCPRAYFRCSFAPSCQVKKKAQRSAEDNTVLVATYEGEHNHAQPPKMQGSGGRKSADAAAVRASPAPPLAQQQPRQQSTTEAGSAADRKNLAEQMAATLTRDPGFKAALVSALSGRILELSPSDS

SEQ ID NO: 107463 - protein, 122 aa, Triticum aestivum
  unsure (1)..(122): unsure at all Xaa locations
  Clone ID: PAT_TA_1881.pep
HDRRRGWRWRGRFAAAVPAMAGDPYAFFDWDVSYVTAAPLGVKQQVIGINGKFPGPVVNITTNWNXSSSNVLNDLDEPLLITWNGIQHRKNCWQDGVLGTNCPIPSGWNWTYEFQVKDQIGS

SEQ ID NO: 107464 - protein, 159 aa, Triticum aestivum
  Clone ID: PAT_TA_1882.pep
GRVGGRVGENNSSLVAARVAVDAADVKSAIAERISVILQNITSLMTSFIVGFIIEWRVAILILATFPLLVLANFAQQLSMKGFAGDTAKAHAKSSMVAGEGVSNIRTVAAFNAQNKVMSLFSHELRIPEEQILRRSQTAGLLYGLSQLCLYCSEALILW

SEQ ID NO: 107465 - protein, 147 aa, Triticum aestivum
  unsure (1)..(147): unsure at all Xaa locations
  Clone ID: PAT_TA_1883.pep
ARAGAGEASDGMAAHVLVFPCPAQGHINCMLHFAAGLLDAGLHVTFLHTDHNRRRLGLAAVKAEADSPGLRFLSVTDGLPDDNPRTACDLVALVESMMTTTRVAYRALLASLRAGAPRDDGFPPVTCVVADGILPFAIDVXEELGVP

SEQ ID NO: 107466 - protein, 164 aa, Triticum aestivum
  Clone ID: PAT_TA_1884.pep
AAAERLSQETTENLLSADLLRMRGCGETCVWQATLVVSFGVWCIRRVLDLSLVESRPELWGKYTYVLNRLQGIIEPAFSKPRKPLTGCACLQITGPGARPISGTFTTSAAILETIKDVEVAICGRKGRSGTAAGDVAFPKGKENLASVLKRYKRRLSSKPSAGQ

SEQ ID NO: 107467 - protein, 116 aa, Triticum aestivum
  Clone ID: PAT_TA_1885.pep
MAFKQDAPPPAYGPPPGAPQPTYGGYQQDPYQQGGAPPPQGYYQQAPPQMGYPQQQQGPFPAGQGPYPPQQGPYGQPPPQGYYPHDDQRGNGGGGGGLMTGLLAGLACCCCLDCLF

SEQ ID NO: 107468 - protein, 577 aa, Triticum aestivum
  unsure (1)..(577): unsure at all Xaa locations
  Clone ID: PAT_TA_1886.pep
MAMANPSAAGAPGICSDALFRELWHACAGPLITVPRPGAPGGASPRRRLPPLEASTNQQLDQYLPMFNLPSKILCSVVNVELRTEADSDEAHAPAHASAEANQGELTSLGPEPQELEKGTIHSFCKTLTASDTSTHGGFSVLRRHAEECLPPLDMSQNPPCQELVAKDLHGTDWHFRHIFRGQPRRHLLTTGWSVFVSSKRLVAGDAFIFLRGENGELRVGVRRHMRQVNNMPSSVISSHSMHLGVLATASHAISTGTLFSVFYKPRTSQSEFVVSVNKYLEAKKQNISVGMRFKMKFEGDEALERRFSGTIIGIGSTPMVSTSLWADSDWKSLKVQWDEPSSILRPDRVSPWELEPLDAANPQPPQPPLRNKRPRLPASSSVVPELAPKFGLWKSPAEPSQTLSFSEPQQARGLFTNSRFSSSSNVAFNQFYWPARESREDSYAGSTNKVTVERKLEPTAGGCRLFGIEIRSAVEETQPVLTVSGDGYDQTAASVDVDSGELSQPSNINNSGAQAASSERALLETQSRQVRSCTKVIMTGMAVGRAVDLTKLYGQDSDWKSLXVQWDEPSSILPSR

SEQ ID NO: 107469 - protein, 234 aa, Triticum aestivum
  unsure (1)..(234): unsure at all Xaa locations
  Clone ID: PAT_TA_1887.pep
RGLSSSSSSSSFFLLLTFSTKQTTLFTTAKMVKVLAVLYDGGQHAKDQPLLLGTTENELGIRKWLEDQGHTLVTTSDKDREGSKFDEELEDAEIIITTPFHPGYLTAERLAKAKKLKLAVTAGIGSDHVDLNAANKTNGGITVAEVTGSNVVSVAEHVLMTILVLIRNFVPAHEQIEAAEWDVAHAAKQEFDLEGKVVGTVAVGRIGERVLRRLKPFDCKELLYFDYQXLSPEA

SEQ ID NO: 107470 - protein, 190 aa, Triticum aestivum
  Clone ID: PAT_TA_1888.pep
TAATAHTMRKEIIIRMQPGSDKYHKRALKVAAAISGVVSITVAGRDRDLLVVIGDGVDESHLTKKLKKEVGEAEIVQLRTLHEGTSASGYLPGTSRDVGGGQSRSPYHQHPMNTPGQVAYPVYAPSPAANPGAARWSGTQRHAEAGYYPSASSPSFYHASARGRARRVRGQQLCKRGGAQPPGELLPDDR

SEQ ID NO: 107471 - protein, 265 aa, Triticum aestivum
  unsure (1)..(265): unsure at all Xaa locations
  Clone ID: PAT_TA_1889.pep
MAPTLLWIGLGNMGRGMSKNIVEKGNLEGPLLLYNRSVKRTTDFSATLPNGKTEVIESLADGVARADIIFSCIANDEAVQETYKTMLESDVKGKFFIESSTIHPETTEAIAKDVIAKGAEFVAAPVFGAPEMAEAGQLVGVLAGPAASVTKAKAWFQGVTSKGVIDLSDKPYSKALTLKVLGNTFILNMAEQLAEAHVAAEKTGLGTEAIHQFVQSVFGGPYAAYSERMLSGDYYXHDEPLFAVELARKDARHAMSXAKSAGVQL

SEQ ID NO: 107472 - protein, 315 aa, Triticum aestivum
  unsure (1)..(315): unsure at all Xaa locations
  Clone ID: PAT_TA_1890.pep
MTPPAAASPGRKSPAAVLFLCVVTISLLMFILLASYTPRLQPHGRSPHRRLKLHPKNSAAVASSYGAGAVHDSGGNRHAAPFDPAIAELERRLEDKEWEREHYRILHGDAEKDDHMKEWEEFLREEEDFINDDDRFNVSDRIRALFPKIDLTPKDGFVSLDELIRWNLDQARSDQLHRSAREMELYDRTXGGIVSFTTFRALRQQSHGDGNSLGFPWWKEEHFNASDVNGDGFLNKTEFHDFLNPSDSENPKIINLLCRQELRQRDKDGDGKLNFEEYFHGLHDHIHGYDDENAAISHIGNMTIAKERFAKLDKD

SEQ ID NO: 107473 - protein, 278 aa, Triticum aestivum
  unsure (1)..(278): unsure at all Xaa locations
  Clone ID: PAT_TA_1891.pep
MGTLGRAIYTVGKWIRGTGQAMDRLGSTIQGGLRTEEQVSRHRTXMSIFDKEPRINKDVFVAPRCICHWLMLRLVHGSSIXYDSVLRGEVNSIRGMDLHXNIQNNSLGHVAKTNISGNVLRTIIGXNVTVGHSAVLQXCTIXDEAFVGMGATXIDGVVVEKHSMVGAGSLVKQNTRIPSGEVWVGNPAKLXRKLTEEVTTFIAQSAANYINLSXVHATEEFQELRCRLSSRKKLRKKXFAHKDEEYDSMLGVVREIPPQLILPDNILPDKAPKAAVAH

SEQ ID NO: 107474 - protein, 183 aa, Triticum aestivum
  Clone ID: PAT_TA_1892.pep
ARPKRQSCSPSRGRTSNGSVPSGSSMPAVRRSHFTGGASVNPVQMGNKMVERVVNMRRLAPPKHDDQRSSLNSLSGKSLNSPDSSGFGRSLSKKSLDMALRHMDIRRSIPNNLRPLMTSIPASSVHSGRSGSTRGRPISVSDSPLATSSNASSEPSVNNNLMCFDSIDIDDELCSDRAGHYAR

SEQ ID NO: 107475 - protein, 390 aa, Triticum aestivum
  unsure (1)..(390): unsure at all Xaa locations
  Clone ID: PAT_TA_1893.pep
MDSDSEMPVASDEEMVDDEDYYYYSDEGEGDDGDASGGGASGDEDVSAGDYEGREAEGSDEAVSTREQRYIVLSEKDISERQEEDISEVSALLLIPREEASVLLHHYKWDISKVNDEWFSDEDKVRGIVGLLMNGTDFHNSRKLTCGICFEGYSSDMMSSAGCAHFYCHECWEGYISAAVSQGPGCLSLRCPDPSCSAIVLQGMINKLGKHEDKEKYARFALRAYVESRKKTKWCPAPDCTCAVEFVSDVNYDVSCNCTFRFCWNCTEEAHRPVNCETVSKWILKNSAESENMNWILANSKPCPKCQRPIEKNQGCMHMTCTPPCKFEFCWVCLGSWXKNMGERTGGFYACNRYEPAKKEGVYDEAEARRERLNXTREXYHYYERGLTNT

SEQ ID NO: 107476 - protein, 207 aa, Triticum aestivum
  Clone ID: PAT_TA_1894.pep
SGADPFPPPPGLQLARWPPLPRPPSSRGTAQDPPAPAARRSLREARQRCAGRGAGAGCDAPAPARAARPAPAPPPPGRPPSTGEVELLGACPRQKGAGAGELFPKGGRQLDHSIDEGPGREARANAREGAPSGPAVGRRAWRGRSYEATYEGYMFPLRVTDELERWPEMSGRGRTWVTVQDAMDRCPHLWMREALQRFADRVADAAL

SEQ ID NO: 107477 - protein, 170 aa, Triticum aestivum
  Clone ID: PAT_TA_1895.pep
NVVDFIDDDAVDDAWVVMSYLSEADCLLAGSPIASARWTVNESNESENMSQLIAASVAARGVLFGNAHPSPSRWHTIRSPKVWQIERTFRSTKGLILKERFDPSSTSGSRNFSDVVTDFRPFERWISPHNDMTRNNPSRHDVAGGPNSIDMLDAEGNNSEEEEEDEIEEW

SEQ ID NO: 107478 - protein, 215 aa, Triticum aestivum
  unsure (1)..(215): unsure at all Xaa locations
  Clone ID: PAT_TA_1896.pep
MAAAGAPPPRAFSAELRRAPLSAGLAPPRQGTRARASWPLPRQETVCSRGRLISTMSSSRSLACSPCRCAQVALADAEIAYQPEAEKHAGVLAYELVQGNLVQWNSFMDKSIPDPPTAVLLHGILGSGKNWGSFAKRLAQEFPMWQFLLVDLRCHGDSASIKKRGPHTVASTAFDVLKLIGQLKLSPPSVXXGHSFGGKVAXSKGNXAXNQXPXX

SEQ ID NO: 107479 - protein, 87 aa, Triticum aestivum
  unsure (1)..(87): unsure at all Xaa locations
  Clone ID: PAT_TA_1897.pep
LKKRHHAELHQCAASLDGGHRRGQGECDLRGLLEGYWREFDHLLSEPXLAIXVXXXGWXFRXKPTGXNCVXTVATXVGKLNXSCXGL

SEQ ID NO: 107480 - protein, 107 aa, Triticum aestivum
  Clone ID: PAT_TA_1898.pep
WSFFHNGDLLLICSRCHCHSLLGITFLLLMVVNTHLSHTYTIQDAEPLVYAAALPCRHLLLQVRRRPCWKLGLLHSPPQSPPRPPCWYTCISFSLFVVQLVVSTIQK

SEQ ID NO: 107481 - protein, 374 aa, Triticum aestivum
  Clone ID: PAT_TA_1899.pep
DAWDHANSADGDVSWLKADRFGGRPDEGSFQFLHKRSRNIGSKSRRLLMDNEEALELKLSWEEAQELLRPAPSAKPTIVMIEDYEFEEYDEPPVFAKRSIFTSRSTGEQDQWIQCDDCSKWRRVPLNVIIASKWRCADNTWDPKSCSCSAPEELAHKELQSILQQYEEIRRRKSNYFLKQSIPEMDASSLDALATAAVFGEVGNQGAASVATTTKHPRHRPGCTCIVCIQPPSGKGPKHNPACTCNVCMTVRRRFKTLMMRKKQRQSEREEAEASKRISWVGRDEPEGKQPVAVPPNRGPPSETGHVFMFHRGRRQAHGPTPHPSPPASPPGGQPRIARPHPPGLTPGQPSSTGRCPPPVAGLTPGPTIRLDPL

SEQ ID NO: 107482 - protein, 336 aa, Triticum aestivum
  unsure (1)..(336): unsure at all Xaa locations
  Clone ID: PAT_TA_1900.pep
GAGHSAAAGSHVAEEAKGALSGRRRAHAGRSLTHKAGGHRFESRCLRARAGCSATPSSPRLKPLPLFGPGREPTASPSSPLALTRRRCPRSASWAAGMSPXVPGGRPGFRAELDAPGGVARGVVMRLRLRXSTTSSGTSTAKFSADAVASQLLLLQAMXSESDILLFVISPGGSXSATMAIFDVMQLVRADVSTIGXGIAGSTASIILGGGAKGKRFAMPNTRIMMHQPVGGASGQALDVEVQAKEILASKRNVIRLISGFTGRTLEQVEKDIDRDRYMGPLEAVDYGIIDGVIDEDSIIPLEPVPERVKPKYNYEEMYKDPQKFLTPHVPDDEIY

SEQ ID NO: 107483 - protein, 299 aa, Triticum aestivum
  Clone ID: PAT_TA_1901.pep
MGGRSRLWPTKRHHDASSNPRPPPPYSGYSHVDNQCQVPLWEREFCSLVGGISWQRFCENKHFAYMYKEIEQWDDSGAFENFQNAKSRFWSHYHGQPSDIPYPNPDLYIDEVDHRCEVDPELVADLDKVRVPFEADNEPAVAANNRCAQNQSGNWDIYLEKPTPEVNKWEADNSASNAGWGASQEPLSSWNKISTGWGEALAEPGWGSSGNNHCPGNNWSSSHGVSSNNNTYYQDPGGAYGRKRNSGGGYSQQRNSKQRNQAESHHQRGRWQDHRDRGRHGERFLFDNRPNGQRAERGF

SEQ ID NO: 107484 - protein, 111 aa, Triticum aestivum
  Clone ID: PAT_TA_1902.pep
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGELSGDLLRSHQAAH

SEQ ID NO: 107485 - protein, 179 aa, Triticum aestivum
  unsure (1)..(179): unsure at all Xaa locations
  Clone ID: PAT_TA_1903.pep
FGLGAVGLAAMEGARMSGASRIXGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTAFDLMLKGEGLRCVIRMDE

SEQ ID NO: 107486 - protein, 187 aa, Triticum aestivum
  unsure (1)..(187): unsure at all Xaa locations
  Clone ID: PAT_TA_1904.pep
MATAGKVIKCKAAVAWEAGKPLSIEEVEVAPPQAMEVRVKILYTALCHTDVYFWEAKGQTPXFPRILGHEAGGIVESVGEGVTELVPGDHVLPVFTGECKDCXHCKSEESNLCDXLLRINVDRGVMIGDGQSRFTIGGKPIFHFVGTSTFSEYTVIHVGCLAKINPEAPLDKVCVLSCGISTGLGAT

SEQ ID NO: 107487 - protein, 192 aa, Triticum aestivum
  unsure (1)..(192): unsure at all Xaa locations
  Clone ID: PAT_TA_1905.pep
GAKPKAESTVGNFRSLRAVXLAVWKGAKMAGASRIIGVDLNPAKYEQAKKFGCTDFVNPKDHTKPVQEVLVEMTNGGVDRAVECTGHVDTMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 107488 - protein, 378 aa, Triticum aestivum
  unsure (1)..(378): unsure at all Xaa locations
  Clone ID: PAT_TA_1906.pep
MATAGKVIKCKAAVAWEAGKPLSIEEVEVAPPQAMEGQTPVFPRILGHEAGGIVESVGEGVTELVPGDHVLPVFTGECKCAHCKSKESNLCDLLRINVDRGVMIGDGESRFTIGGKPIFHFVGTSTFSEYTVIHVGCLAKINPEAPLDKVCVLSCGISTGLGATLNVAKPKKGXTQLTFLFYAMFLQAEENYVLQPRQLPCASVSHDRAMEGAKMAGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 107489 - protein, 379 aa, Triticum aestivum
  Clone ID: PAT_TA_1907.pep
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 107490 - protein, 174 aa, Triticum aestivum
  Clone ID: PAT_TA_1908.pep
RERSLLSFPVSGGQMRRERSVLDFDPGSRRIPQRGRARRGTAGKLSKCKAAVASEPGSAGVHRQEPAWCRRAAQSYGGAGQEAPALTSPLPTPMSTSGGMAEGAGPRCSLWTLPVHGTLGGISGRRCSDERSVKCRIGPVGMAPVVLRSVFELEASVKGGPHICHVVRGRGHMW

SEQ ID NO: 107491 - protein, 227 aa, Triticum aestivum
  Clone ID: PAT_TA_1909.pep
FVHRSIESPTMAVMTLCFFSFLTGVLIGVTMALKGEAFRFAGDVAAILPAPVKKTVVALARSSPARAAADALVGLFLGMVCVMFTATFFNVVASLACDGDCSLAGILSEISDYSETLSLLLLAPASALFFLRAAGYSSEVKEDFNEQPSSSLLESLKSPARLAVATAGLFFGIISWILRMCGSPQISDIPGVAALFFLHLFIVLFYISAARALWRMNRRPAIGMVAA

SEQ ID NO: 107492 - protein, 156 aa, Triticum aestivum
  Clone ID: PAT_TA_1910.pep
PPASTASSVSLQANHRRHCSASEERSGAEMEPIPLLTPYKMGQFDLSHRVVLAPMTRQRAYGGVPQPHAALYYSQRATPGGLLISEATRVAPARRDEEPTSFRDMPGIWAPEQVEAWRPVVDAVHAEGAVFFCQLWHAAAGNGDDAREKATGEPPR

SEQ ID NO: 107493 - protein, 283 aa, Triticum aestivum
  unsure (1)..(283): unsure at all Xaa locations
  Clone ID: PAT_TA_1911.pep
MEASQGVYGELRQHSGIDCLCSGTTAVTVVRQGDHLIIANLGDSRAVLCTRDSKGRPVSVQITTDLKPDLPGEAERILICKGRIFAMDDEPDVPRLWLPDQDAPGLAMARAFGDFCLKXHGLICTPEVYYRKLSEKDDFLVLATDGIWDVLSNKEVVKIVSSVSDRSKAAKQLVDRAVRAWRRKFPTSMVDDCAAVCLFLKPAAISSEEGSTTKPPQTPVLSFTGSFRKALGGGEAEEGTAVWRALEGVARVNSVIRLPRMLSRRWRSASMDENNDQESSKAD

SEQ ID NO: 107494 - protein, 395 aa, Triticum aestivum
  Clone ID: PAT_TA_1912.pep
AVVCTIHQPSIDIFEAFDELFLMKRGGEEIYAGPLGHHSADLINYYEGIHGVSKIKDGYNPATWMLEVTTIGQEQMLAIDFSDIYKKSELYQRNKALIKELSQPAPGSTDLYFPTQYSQSSSTQCIACLWKQNLSYWRNPPYNAVRFLFTTVIALLFGTIFWDLGGKMSQSQDLFNAMGSMYAAVLFIGIMNCTSVQPVVAVERTVFYRERAAGMYSAFPYAFGQVVIELPYTLAQATVYGVIVYSMIGFEWTAPKFFWYLFFMYFTLLYFTFYGMMAVGLTPNYHIASIVSSAFYAIWNLFSGFIIPRPKVPIWWRWYCWVCPVAWTLYGLVVSQFGDVTTPMEDGTPVKDFIEGYFDFKHSWLGYVATVVVAFAVLFAFLFGFAIMKLNFQKR

SEQ ID NO: 107495 - protein, 156 aa, Triticum aestivum
  unsure (1)..(156): unsure at all Xaa locations
  Clone ID: PAT_TA_1913.pep
MAGGKAALLVALLFLSLALETQQADSGGYDPAPTPLTTSHRKRRPSPPRPRPPXPTPPTPTPPPYTPSPPEPTPPPYIPSPPEPTPPPYAPAPMPXPSSSTARKPTPLAYRPPPTPPTMRSRHRRRRPTSPMSRAVTASPCQRMQGHYSHWRLSNM

SEQ ID NO: 107496 - protein, 193 aa, Triticum aestivum
  unsure (1)..(193): unsure at all Xaa locations
  Clone ID: PAT_TA_1914.pep
MAGGKAALLVALLLLSLALETQQADSGGYDPAPTPLTTSHSNRKPPRPRPHPPRPRPRPRPRPPTPPTPTPPPYTPSPPEPEPTPPPYTPSPPEPEPTPSPPEPEPEPTPTPPPCTPSPPSPPEPTPPPYAPAPMPSPFLXTARKPTPLAYRLPPTRPTTRSRHRRLPTSPMSRAVAMSPCQRMQGHSHRRSK

SEQ ID NO: 107497 - protein, 164 aa, Triticum aestivum
  unsure (1)..(164): unsure at all Xaa locations
  Clone ID: PAT_TA_1915.pep
MGSVTASTTAKPILRVAAISGSLRSNSWHVGLIRAAEEMCEESIPGLRIDHIDISGLPMANPDLETDGGXASRGTHKCWADKAAAIVXRGGDFGGGRASLHLREIGIYLDLHFINKPELHIRAYEDPPKLDGEGNLIDAKARERLKKVLLSLQAFALRLQRREN

SEQ ID NO: 107498 - protein, 101 aa, Triticum aestivum
  Clone ID: PAT_TA_1916.pep
NIAVFIEQRGGPGGTKWAQPTKARMGLLAHPGGLCSPRRTPRRVIVTHWVSSAPNKSRYSFVAIGLHLVLIFFDVKNMEKSTTVTWHYVNRLVPKNDIKWL

SEQ ID NO: 107499 - protein, 109 aa, Triticum aestivum
  Clone ID: PAT_TA_1917.pep
MAASARQGERATSFAMACSLLSRYVRQNGAAAAELGLGINKGEAEAHMAADTKSTLPGAEGEEAGRKKETMELFPQSAGLHDAAAPDATREEDKSQLTIFYGGKVLVFN

SEQ ID NO: 107500 - protein, 56 aa, Triticum aestivum
  Clone ID: PAT_TA_1918.pep
IARKASLHRFLEKRKDRLHAKAPYQAPPSDATPVKKEFENQPWLGLGPNAALKPNQ

SEQ ID NO: 107501 - protein, 228 aa, Triticum aestivum
  unsure (1)..(228): unsure at all Xaa locations
  Clone ID: PAT_TA_1919.pep
GETATSSAVACSLLSRYVRQNGAAAAELGLGIXSGEAEAHMAADTKSPLPGAEGEXAGRKKETMELFPQTAPACTDATAASSTRSRKTRGHLSNDFQWWEGYGRVQVNFPAETAKAVMHWAGKGSPVGQNVSATTTAADTGLGPDVRVVPGQVGXLVVPVQAHSDYTGRLPLILPIARKALLHKXLEKRMVRLHAKASYQSSRTDATPVKEQIENQPSLRYWGPNAAP

SEQ ID NO: 107502 - protein, 269 aa, Triticum aestivum
  Clone ID: PAT_TA_1920.pep
MAVSNNITACVTLMALICAVPVIASGVWFASAQGEECARLARWPVAILGGLILLAALAGFVGAYWNRRRLLAFYLFAMAALIALLIALLVFAFAVTRGSGAYPVLGREYDEYRLDGFSMWLRGYVSDDPARWEGIRSCLAVSDTCKKLARQAGYVTADQFYQSRLTPLQSGCCKPLSVCGFGYVSPTVWTNPARPASDPDCGLWSNDPAQLCYECESCRAGLLAALRSQWHKANIALVVATVSLVFLYLIGCSAYKNAHAEAIYHRYKW

SEQ ID NO: 107503 - protein, 103 aa, Triticum aestivum
  Clone ID: PAT_TA_1921.pep
YSHSVMDDAEIRDCGSNESLYDDTQSVNRFRDHDSQPSVGQYSGVPVSARVRRRLLSNGSDRQHQMSSDEFPRTIVSDYRDGVGVLAQYGSAGLLDKSVRRYS

SEQ ID NO: 107504 - protein, 80 aa, Triticum aestivum
  Clone ID: PAT_TA_1922.pep
MAGGADADGERRIGVAMDYSASSKRALEWAVRNLLRRGDTVVVLHVQRHGGEDAKHAVWAKSGSPLIPLSEYREPEVMKN

SEQ ID NO: 107505 - protein, 111 aa, Triticum aestivum
  unsure (1)..(111): unsure at all Xaa locations
  Clone ID: PAT_TA_1923.pep
MAGGADADGERRIGVAMDYSASSKRALEWAVRNLLRRGDTVVVLHVQRHGGDEAKHAVWARSGSPLIPLSEYREPEVMNNYGVTCDAVVLDMLDTAARQLELKVVXKVYWG

SEQ ID NO: 107506 - protein, 166 aa, Triticum aestivum
  Clone ID: PAT_TA_1924.pep
MAGGADADGERRIGVAMDYSASSKRALEWAVRNLLRRGDTVVVLHVQRHGGEEAKHAVWAKSGSPLIPLSEYREPEVMKNYGVTCDAEVLDMLDTAARQLELKVVAKVYWGDAREKLCDAVEEQKIDTIVMGSRGLGTIQRILLGSVTNYVLSNASCPVTVVKGDR

SEQ ID NO: 107507 - protein, 166 aa, Triticum aestivum; identical to SEQ ID NO: 107506
  Clone ID: PAT_TA_1925.pep

SEQ ID NO: 107508 - protein, 453 aa, Triticum aestivum
  unsure (1)..(453): unsure at all Xaa locations
  Clone ID: PAT_TA_1926.pep
GAHESSWSEGYNKEVTSSGTSTPRSDVLRGGLTDPQNRPSFSSTSKDAQSTAKKVCHPVLGSKAWVLWNKERITWRWKERKNEVHELSKQVSWPQWHCEQENGQHHPKLAATQIVEFNQRNKKEASGSWSSFNNNGSSSAGSTGRTNTYVLYTNMDXKQTVLDDEILWEDLVIGGRVGQGSCGTVYQALWCGSAVGVKVFSRQEYSEEVIQAFRQEVSLMKKLRHPNILLFMGAVTSPHRLCIVTESLPRGRPSRLLLRGTPRVLPSGRVHMALDVARGMNYLHHYSPPIIHRDLKSSNLLVDKNWTVKVADFGLSRLKRETYLTTKTGKGTPQWMAPEVLRNEPSDEKSDVYSYGVILWXLSLIKIPWGKXLSSMQVIGAVGFMNQRLEIPSETDPYWTSLILSCWETDPQSRPSFQELLEKLRXELQRKYAVQNQVQRNPPAAAKNSIIEE

SEQ ID NO: 107509 - protein, 238 aa, Triticum aestivum
  unsure (1)..(238): unsure at all Xaa locations
  Clone ID: PAT_TA_1927.pep
FMVRYAIXETERAXGATAVILNSFGDXXGEAVEAMEPLLGDGNGKPKVYTVGPLTLLAPSSTSSTISNLSLWKEQEECLQWLQGKEPASVVYVNFGSIVVMTNEQLVEFAWGLANSGRHFMWVIRRDLVRGDAAVLPPEFLAETAERGLMASWCPQQEVLNHPAVGAFLTHSGWNSTXSRACAAACPLSVGPSSPISRPTVGTSATSGASAWRLTVTSSARLSRASSRSSWTERRASR

SEQ ID NO: 107510 - protein, 130 aa, Triticum aestivum
  unsure (1)..(130): unsure at all Xaa locations
  Clone ID: PAT_TA_1928.pep
MKEKKKAPKGNGSNKSEWTGQDPYKDQNDRRSGVLALMQSVARMGWVLGPXILIVCAYITYYIVVLISDYYRSPEPIHGKRNYTXLYMDAVRSWLGPTDVAVCGNAQYTVVYXITVGTGIMSVVPSNCRH

SEQ ID NO: 107511 - protein, 195 aa, Triticum aestivum
  unsure (1)..(195): unsure at all Xaa locations
  Clone ID: PAT_TA_1929.pep
GQDPYKDQNDRRSGVLALMQSVAQMGWVLGPXVLIVCARSSLGPGVLAAGGYPPPAPVHASRXLRLHVAAARPRLGPRDVAVCGNAQYTVVYXITVGTGIMSVVPSNCRHXKGPRRELQQDGAMYLVMFRLVELVLSXSRAWRSATFVSIIAVIMSFTYSFIAFFLSVRPARKDRPVAVYSHLHRSAAKRRSGGW

SEQ ID NO: 107512 - protein, 386 aa, Triticum aestivum
  unsure (1)..(386): unsure at all Xaa locations
  Clone ID: PAT_TA_1930.pep
MAAAASSSSPPAVITCRAAVAWGPGQALVMEDVEVAPPGPLEIRVKVVSTSICRSDVTQWQSTAQPDLFPRIFGHEASGVVESVGEGVTEFQVGDHALTVFIGECMSCKHCVSGKSNMCQTLGLERKGVMHSDQTTRXFSIGGKPVYHYCAVSSFSEYAVVHSXGCAVKVSPTMPMDRICLLSCGASAGLGAAWNVADVSKGSSVVIFGLGTVGLSVAQGAKLRGASKIIGVDTNPDKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKTDIPLLVEKYANKEIQVDGLVTHDMPFSDINKALELMLQNRCLRCVIHMPK

SEQ ID NO: 107513 - protein, 115 aa, Triticum aestivum
  Clone ID: PAT_TA_1931.pep
RRTGREGSAVLSPLFPWVCPFSAPTPRCWQRGGRHWSRTIAGSSGILKLDGLTKGLELRAQPAVYVAPLRPVKFAVMRAEGGEMGFLFLYGFIAQLWSLKPYRDGVMIWDAREKY

SEQ ID NO: 107514 - protein, 151 aa, Triticum aestivum
  Clone ID: PAT_TA_1932.pep
MVAEAVAQASSVFAAFDKDGDGKVSAAELRGSMTAALGEEVSEEEAAAILATVDADGDGLLDQEEFSRIGLAAAGDDGGAAGGDDEEVRRRCLREAFAMYATGGGEEQGARITPASLRRMLGKLLGAENMALEECTATLCRFDLIRRPPPL

SEQ ID NO: 107515 - protein, 123 aa, Triticum aestivum
  unsure (1)..(123): unsure at all Xaa locations
  Clone ID: PAT_TA_1933.pep
MAARRRLLLLLLALAPALSQTVLGVSGGGQARKTYIFRVDHRAKPSVFPTHAHWYSSAAFASAAASADGPLEPLHVYDTVFHGFSASLSASRAEELRRHPAVLAAFEDRVXQLHTTRSPQFMG

SEQ ID NO: 107516 - protein, 188 aa, Triticum aestivum
  Clone ID: PAT_TA_1934.pep
MGGEMPGTDGKGHPAPASASASPYPQQPPPQYEQQHHQYGTFGAPSASGQVPQPWSGFPQPALPLGFYAYPPPPPPPSAAVYGPLQAYSPTAPSYAHGYQAVQGYIPVVEGRPVRMRRLPCCGLGMGWFLFIIGFFFAAIPWYVGAFVLICVRVHDYREKPGYVACTIAASLAAIAMLLGATKGAEVW

SEQ ID NO: 107517 - protein, 257 aa, Triticum aestivum
  Clone ID: PAT_TA_1935.pep
TEQQRAPLLRVEREKHVPARSPIFPGGDAGWRREGRGARRSYVYIKSKLSLTPVASGAMPRWSVPPPRSSSGRWLAVAAVLAALVCQLLVRSGLPVTPRISSFGPLIWRRSLFSSAFKVTMVVKEEERKDGDPVRVRAHHRRRSWMAYGSRCCGRCRPSPPNPLTEWLSFFFLPAKSQMGGNAASSWSSWRGAMEGSPHQVVPSPVKTSQVSGWSCQGPDCFFHQFSGVLFVIVRDRLVFSFFVQGPDVKSLCTAPF

SEQ ID NO: 107518 - protein, 304 aa, Triticum aestivum
  unsure (1)..(304): unsure at all Xaa locations
  Clone ID: PAT_TA_1936.pep
FDLNPQAQQRAQQAMSRFPSXLDAHLRPLGPHRFQQPAPSQLQTPPQPHSQGQPHPQPSPQQAAQARVRSPEVEMALQDAMRVCSPDIKTPFHSLADAVSRLLPYHVVADYEAEEDDRILDSDATGQIPSRLQQWDHNILGKIAEFTTTFEKQVLAYNIMTKKRAIGEFRSEERLMLEQALLQEEKQASMELRAEIESREKAGREAAEAKMRMAMAEHARVEAQAHAEVIGHGPLRANAAASQGDDGPSHDMAQEQVEDGWENTQRDDDDPSEDFLNDENEPENGNSDMQEEWRRSGEFDLNSR

SEQ ID NO: 107519 - protein, 148 aa, Triticum aestivum
  unsure (1)..(148): unsure at all Xaa locations
  Clone ID: PAT_TA_1937.pep
MKLHLLLKVLFGPVPVYFSALAILILLTNAQYFGLGGVGVPRATKLASSTQVVSVMKYCDIFRGEWVPDAEAPYYNHKTCGMIQEHQNCLKYGRPDLGFLKWRWRPSGCELPRFDPVQFLQFVRHKSLXFVWDSLARNHIHSLPCLRS

SEQ ID NO: 107520 - protein, 141 aa, Triticum aestivum
  Clone ID: PAT_TA_1938.pep
ALRIVLLRVRTSAATLRLQTPALGLSPLTGGRANFHSAAAASRRLSPPAGGRPCLISTRNLRTRINLESASLEELLREATFLEEQIKECLNRTLKEKERSDLIMKDTWGTLKRMACCAAVVKVIAFFISPSELAEEDEVMN

SEQ ID NO: 107521 - protein, 116 aa, Triticum aestivum
  unsure (1)..(116): unsure at all Xaa locations
  Clone ID: PAT_TA_1939.pep
PRVRPDDISGFKQTLEARMKESNRNSSVQRFVKSVELLQKQTIMHYQPNKSQSFLKIVGALPTMVASWRGILERGITIGSLGSKSFVTYERHILFXALRFMIDCNIVGGNWIELPG

SEQ ID NO: 107522 - protein, 356 aa, Triticum aestivum
  unsure (1)..(356): unsure at all Xaa locations
  Clone ID: PAT_TA_1940.pep
MPREEPAAAEVSEVAEMGEEKEDGQPEEQEERWARLLPELLAEVVRRVEASGGERWPARKDVVSCACVCRRWRDAAVAVVRPPAVSGKITFPSSLKQPGPREFPMQCFIKRNKKNSTFYLYLGLTTATVDKGKFLMAARRFRRGPHTEYIISLDADDLSQGSNAYMGKLRSDFWGTNSKVYDSKPPHDGAKASSSRSSRRFGSRRISPQVSAGNYEXGQLSYKYNLLKSRGPRXMYCALECPSPQETWENSLKTKFRKPMGTTVLRNNAPRWHEHLQCWCLNFHGRVTVASVKNGQLSVAADPNDPTGSRDEETVLLQFGXKVDDDIFTMDYRQLCRHFKAFAISLXSSFGTKLAW

SEQ ID NO: 107523 - protein, 374 aa, Triticum aestivum
  Clone ID: PAT_TA_1941.pep
MAIPLVLVLLPLGLLFLLSGLVVNTVQAVLFLTIRPFSKRLYRQINVFLAELLWLQLIWLVDWWAGIKVQVYADPETWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGTFDEEIIPIGRPVKSLMVVLSWSCLLLYGAHRFLQWTQLLSTWKGVILFASGLAMVTAVMHVFIMFSQAERSSSAKAARDRVKKD

SEQ ID NO: 107524 - protein, 236 aa, Triticum aestivum
  Clone ID: PAT_TA_1942.pep
MSWRIPLFGSQQQQQQQQPEPNFQNISTQSWYPPSVGGSSSHPSTPSSSGASPHQRASDHPQPSSRGQPSPAEAAGIIARLRDKSVDELQRLLKDKESYNAFFNSLDQVKTQNNLRDELRKETLQLARENLEKEQRISELRNQCTIIRTTELAAAEDRLAELERQKDEIMKSYSPAALLDKLQSTMAKLDEESEELHQKFLEKDIDLPTFVQKYKKLRAAHHKCALLHLSGKASLR

SEQ ID NO: 107525 - protein, 83 aa, Triticum aestivum
  Clone ID: PAT_TA_1943.pep
SICFRRVNWVKICSYGLDAWIIFFQICLARRGRFCCANSFIFVSIKGCTIFFNIFTTRLTCSYVLFLLMFTGFAFCITHTQME

SEQ ID NO: 107526 - protein, 336 aa, Triticum aestivum
  unsure (1)..(336): unsure at all Xaa locations
  Clone ID: PAT_TA_1944.pep
MKAALRSRQEPRRVSNGVIIAAMLLSLCVLSIVKARYCSTPFGKPDDQLKEQMNSSIRMETDDEPTPAATTVGVSEEDSEEDVREWKVKPYCRKQDAYALSHVKEWTLRPLSGGGPHCTVNSSATAFVLSTGGFTGNLFHDYTDVLVPAFITAHRFRGEVQFLVSTFKSWWTNRYLEIFQRLSKYEVIDIDNDDEVRCYGSVVVGPTFHKELGVDXVLPKGPTGASMVDFRAMLRGAFGLSRAAAEPSGDRWDIRRRPRLLIISRKNSRAFLNERAMADMAMSLGYHVRVGEPDTNTEVXRFARLVNXADVMVGVHGAGLTNMLXLPTGAVLIPVI

SEQ ID NO: 107527 - protein, 409 aa, Triticum aestivum
  unsure (1)..(409): unsure at all Xaa locations
  Clone ID: PAT_TA_1945.pep
APRPPPPVAEGASGGRCATSRARRRTRPGPPDTYACRAATRPSRSGRWTGSGGRCEAAGDIRVVGNASTIYIDSLDREWRTKPYARYHDPVAMTHVREFLLRPFPADAPPPACTKNHSVPGFVFSNRGFSGNLYHDYTDVLVPLFLSTRRFNGEVQFLLSDLKPWWVAKFRPRFRQLLGFDVADVHTDLSVLCLPGIVVGSFFHXDMATVPSNARGGVSSVDCQRTLRDAFGRERAAASRGAATGAGIPRLLIISRKNSRRFLNKFARLVNSADVMVGVHGAGLTNMVFLPAGAVLIQVVPFGGLEWLAGVTFKEPSTDMDVXYMGYKMQLEESSLREQSPTDQPGAQWSPLSIHKQGWEALKAAYLEKQNVGQGPLRRALAGLGPPQRRPPGRPARATGPARQRPGPI

SEQ ID NO: 107528 - protein, 465 aa, Triticum aestivum
  Clone ID: PAT_TA_1946.pep
MDQSRRAVESYWRSRMVDGVTAEDDKVAPVYKLEEICELLRASDAGIVKEVADFVLKRLDNKSPLVKQKALRLIKYAVGKSGTDFKREMQRHSAAMRQLVHYKGHPDPLKGDALNKAVRETANEAIAAIFSTEDPKAVVVTEGLGKRIQGFGNTNYEPSRDDKKSFLSELSEVVGIGGASIKQGLSNFAATHSMMPNDNGGMYKNPIRRSLTTETDRYGRYDPSEIQGESRATSGASKNVSSGSWGPSPSSSASAGDTESSQPGIKTREERLLETIVTASGVRLQPTRDALQIFLTEASKLDAVALSRALESKLNSPLWQVCMKAICVLEAVVRKQDTDPYSIVASYFSENSACVVRCCELPPASRCDTAAAVSLRLAAGWSRPLTSQALLSPCFDPTRHLGSGACCPTSASCSLPAGWPPSHNGEFSLLSRARLKATASSLEASVKNICRAFARGLQHICLHCV

SEQ ID NO: 107529 - protein, 85 aa, Triticum aestivum
  Clone ID: PAT_TA_1947.pep
YRSRFYMHYRRSASLPIRSNTFTTKEALSSLLSLSPLHGEYHRSQQVRLTRRRALSSEARANCLIIFKKHSRCSSSQIDHVQNFT

SEQ ID NO: 107530 - protein, 106 aa, Triticum aestivum
  unsure (1)..(106): unsure at all Xaa locations
  Clone ID: PAT_TA_1948.pep
GRTETVHFDKITVWFKKLSYGLSQEHRDPVLXVCVRVYMGVTTIQLDELAAETAAALTASQPDYASLAAETAAALTASQPDYASLAARIVVSNLPPSGNSLCGARK

SEQ ID NO: 107531 - protein, 289 aa, Triticum aestivum
  Clone ID: PAT_TA_1949.pep
LQIRHEETNDCPHNAVAGAKRKHGAFEVDEELNSTIAENEVLWRVNFEKFIFCLKKKFCADRKKPKLKVGTHPIWESFFEANLPDKDTNSVTSSINGILEKLGQKEGTAAMSIGDIKPVLLDLQCTTSDGEEFTFDLRKMVEACRNEEIESLVKKKYGQEAFTIFRLLVTQGCAVETDQIIDTTILDKQIVHSTLYKLWNDGYIDTEKIASAAGTGYAQFFVWRAKNTFREQFIDNLYHAALNLRQMVNYIAELLLEGSKDETKLRNRKNILILALTRHDDSLMLFHDF

SEQ ID NO: 107532 - protein, 400 aa, Triticum aestivum
  Clone ID: PAT_TA_1950.pep
VRDKVSSERTPQHHLKEEAESVMQKLVTCVQYTAELYHEMHALDRFEQDYQRKQQEEDGSSVAQRGESLHILKQEVKSQQKHVKSLKKKSLWSKNFGGVGEKLVDIVHFLHLEIHNTFGCSDNEESQEPTKRRNRLGPAGLALHYANIISQIDALVSRSTSVPPNTRDSLYQSLPPTIKSALRSKLHSSGVKEELTVPQIKAEMEKTLRWLVPVANNTTKAHHGFGWVGEWANTGSEVNCKPTGHMDLTRIETLHHADRDKTEAHILELVVLLQHLISQSRAANGERSPIKSPVRSPTQRGSSITLSPNKASSSSPVLTQQEQEMLRDVKYRKFVPGISKSQEFDTKARHMQSRLIKSNSHSPSSSNRKEFLSIRSMLPVINFEIDRTKALDMIDNLKVQ

SEQ ID NO: 107533 - protein, 439 aa, Triticum aestivum
  unsure (1)..(439): unsure at all Xaa locations
  Clone ID: PAT_TA_1951.pep
MGSDADMEDYGFEYSDDEPEEQDVDIENQYYNSKGMVETDPEGALAGFDAVVRMEPEKAEWGFKALKQTVKLYYKLGKYKEMMDAYREMLTYIKSAVTRNYSEKCINNIMDFVSGSASQHFNLLQEFYQTTLKALEEAKNERLWFKTNLKLCKIWFDMGEYGRMSKILKELHKSCQKEDGSDDQKKGTQLLEVYAIEIQMYTETKNNKKLKELYQXALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRVQGHIDQVNKLLECGDRSKGMRKYQAIDKWNTQLKSIYQTVSNRVG

SEQ ID NO: 107534 - protein, 90 aa, Triticum aestivum
  Clone ID: PAT_TA_1952.pep
AKPPSRHCRRHPLKPYSAAHCCPGAAPSTSTSTTSPDWTRTPLQSTHRPPIHPRGAGPLTLDPSSPVRSRPPRAHLRHRDPRHGELQGVC

SEQ ID NO: 107535 - protein, 92 aa, Triticum aestivum
  Clone ID: PAT_TA_1953.pep
MDGGYKKAAARDVPGVLLLLLLLVVSLATVTRSAWVGDYASDHGCGKTFVEALCDPADAAQNRACSDACHYNGCGGGRCVYVATARGCYCKP

SEQ ID NO: 107536 - protein, 218 aa, Triticum aestivum
  Clone ID: PAT_TA_1954.pep
VINDENIYLFPKNGGLGPDPKSSVKIGGGEGSNSIVFASGEDVDRPAPQVYVGHRNCETVKGVTFIGPNHEYVASGSDCGRLFIWRKRDGKFLRAMEGDECIVNCIEPHPHAMTIASSGIDNDVKLWTPSAVERAQVVNVEELKPRKRKAKLWQFALPEELVWHVLASRRRQPAAEEDSSEDLEDNTELLNLVLRATNRDNLSDESDEDEETSDGSGE

SEQ ID NO: 107537 - protein, 165 aa, Triticum aestivum
  Clone ID: PAT_TA_1955.pep
GKKSEEHGSQRRIQKLTTKSEKTAPPKDNRDELSNLNKILDRICQIHSTPGKPANHTHRDCWVFKQSGRLNAEHKGLDTLREGEDEPQKQSTRKQKNFPQEVKTVNLLHITKRAAPIKVCNTRSIPKGSRHWLSKPIIFDQLDYSRNIKNAGWTALILDPIIGGL

SEQ ID NO: 107538 - protein, 149 aa, Triticum aestivum
  unsure (1)..(149): unsure at all Xaa locations
  Clone ID: PAT_TA_1956.pep
MPPPLGLLPVSSAAAPPPPAPPSAAHNNHWAALVRTSRFCFNYSHLATTPSFYRAGSRFRLPDARAVLMLADDMACNPRNNYPAQVFNNENHQLNLYGDNVEVDYRGYEVTVENFLRVLTGRHESAVPRSKRLFYDXTCHIHLYMTGDC

SEQ ID NO: 107539 - protein, 361 aa, Triticum aestivum
  unsure (1)..(361): unsure at all Xaa locations
  Clone ID: PAT_TA_1957.pep
MWRLPGLLSQAAAAGRAAARTSSSHVSGSKGFSSGGGGSPLPRGWLRRLWIEELKREKEAARRLGGGVCKAEGVGEDPLGYLANAARAFVNSGSAAAGIDKLRAGGAARGEVAPSKGGQYDPKDLPYLEAKLEPLLSRANLLIARDVEWANIMFAFEQESRYIIMDPLFSQSPVGYIREKSNVIFRQLLRTRXDLLHNXTHALGNEIFTVRRPFWFINSSIYAEVDGKEVGVVHRRWHLWRRIYDLYLGNKQFAVVXENPGFWNWTFTLIDEDENVLAQIDRNWRGIGFELFTDSGHYGIRFGDDGQRSRLGLGSDIEELNVVRPLSLPERAVALALAVSLDSDYFSRRGGWALPFLTATE

SEQ ID NO: 107540 - protein, 111 aa, Triticum aestivum
  Clone ID: PAT_TA_1958.pep
APPCRVANLNASVTVIYFPMSHLSFSLQHYSHTQKIHSWVNKWERTTRHNNAKTKANGVETNRCPTKRCAFQALHADAATFMSLPLRARCFLVSLHTNYLVLPENPLYKEV

SEQ ID NO: 107541 - protein, 80 aa, Triticum aestivum
  Clone ID: PAT_TA_1959.pep
MEAWRRNALRCALLVLLLAISSGVARAQGGGECWSTDMGYGICVKPGGCRAACHALGKNDGQCNGGYFWPVCECLSPHCH

SEQ ID NO: 107542 - protein, 278 aa, Triticum aestivum
  Clone ID: PAT_TA_1960.pep
PLPLPPPSPASFVSASSTTTALLRSVPPASRGGLVVAWAAPARRALAAPLRAAAAQGSANSAPVMMESKVKKRNKKGAGAGGLPAAIDVEIREAEQYLATDGQEPTPEDFPFEMVDEDGMSVVILKRDYKDEKIEVIVSMPNVEGDPEFDEDDEGDDEDAAKDDDDEDEDGQESSLSMKVIVSKESGPNLEFTCTAFHEEITIDDMMIAEKTESDAEKFPFEGPEFTELPPNVQKGLFKFLEVRGVTLTTTNFMHDYMITKQTKEYVRWMTKLKGLVQ

SEQ ID NO: 107543 - protein, 256 aa, Triticum aestivum
  Clone ID: PAT_TA_1961.pep
MADGHDNDKNIEIWKVKKLIKGLDAARGNGTSMISLIMPPRDQVSRVTKMLGDEYGTASNIKSRVNRQSVLAAITSAQQRLKLYNRVPPNGLVLYTGTIVTDEGKEKKVTFDFEPFRPINASLYLCDNKFHTEALNELLESDDKFGFIVMDGNGTLFGTLSGNTREVLHKFSVDLPKKHGRGGQSALRFARLRMEKRHNYVRKTAELATQFFINPATSQPNVSGLILAGSADFKTELSQSDMFDQRLATKILKGVD

SEQ ID NO: 107544 - protein, 416 aa, Triticum aestivum
  Clone ID: PAT_TA_1962.pep
MMEAGKFPGIIGAVSGQDGGVNFCDMAYYQKLGEGSTMSIDSLNSMQTSMHGGSIMSVDNSSVGSTDSRTGMLNHPSHRGPVAVVSYSVGNSIFRPGRVSHALSDDALAQALMDTRFPTETLKDYEEWTIDLGKLHMGLPFAQGAFGKLYRGTYNGMDVAIKLLERPEADPAQAQLLEQQFVQEVMMLAELRHPNIVKFVGACRKPIVWCIVTGYAKGGSVRNFLNRRQNRSVPLKLAVKQALDVARGMAYVHGLGFIHRDLKSDNLLISGDKSIKIADFGVARIEVKTEGMTPETGTYRWMAPEMIQHRPYNQKVDVYSFGIVLWELITGTLPFPNMTAVQAAFAVVNKGVRPAIPHDCLPALGEIMTRCWDANPDVRPPFTDVVRMLERVEMEVLNNVRKARFRCCISQPMTLD

SEQ ID NO: 107545 - protein, 297 aa, Triticum aestivum
  unsure (1)..(297): unsure at all Xaa locations
  Clone ID: PAT_TA_1963.pep
MFSDMRPICCGNLDYHAPQSEIERLLGKYGGVERGDMQTGIALVYXGDERDAGDAFHRLDRADFGRKARRLRVEWTKEDRSGGRKGNGKRSPSSVKPTKTLFVINFDPINTRTRDLEKHFDLYGKIANIRIRRNFAFIANIRIRRNFAFVQYETQEDATKALDGTNGSTVMDRVISVEYALRDDDEKRNGYSPDRRGGRDRSPDRRDNRGRSASPYGRGRERGSPDYGRGRERGSPDYGKGGARDSPDYVRGGSPYGGKGDDRASPKYDRERREASPAYDRRRSRSPARSPAREDRD

SEQ ID NO: 107546 - protein, 132 aa, Triticum aestivum
  Clone ID: PAT_TA_1964.pep
RHGVSYVGPGTRFSPLVPGATSFPQPILTAASFNASLFRAIGEVVSTEARAMHNVGLAGLTFWSPNINIFRDPRWGRGQETPGEDPLLASKYAVGYVKGLQDAGAAGVTDGALKVAACCKHYTVYDVDNWKG

SEQ ID NO: 107547 - protein, 395 aa, Triticum aestivum
  unsure (1)..(395): unsure at all Xaa locations
  Clone ID: PAT_TA_1965.pep
MATAARPPFLAVLLLLVATVMLSCGGNVEVAEAQTPVFACDASNATLASYGFCNRKASASARAKDLVSRLTLAEKVGFLVNKQPALGRLGIPAYEWWSEALHGVSYVGPGTRFSPLVPGATSLPAAHPHNFNLRVTAHDIADTFNPPFKSCVEEGRASCVMCAYTNINGVPACASGDLLSRTFKGDWGLNGYVSSDCDAVALMHDAQFYRPSPEDTVAVALKAGLDLNCGNYTQVHGMAAVRQGRMTEQDVDRALRNLFAVRMRLGHFDGDPRGSALYGGLGAKDVCSPTHKNLALQAATSGIVLLKNDAGILPLRRGAVASAAVIGHNANDPRALNGNYFGPPCEDHDARXQGLQGYRARTSGSWPGCDSAACGFAXTGQGGGAKRPSGLRCFL

SEQ ID NO: 107548 - protein, 213 aa, Triticum aestivum
  Clone ID: PAT_TA_1966.pep
DAWVAHASGGGGQGLWSEARTYGDIQLMPFVDYYSLILWKTIAICIYGTNVLSAKYVMKTEEDAFVRVDEILSSLHQVNISHGLLYGRVNSDSQPHRDPYSKWYITSEEWPEESYPPWAHGPGYIVSEDIAKEVYRKHKRGELKMFKLEDVAMGIWINEMRKEGIDVTYQNDGRILVEGCEDGYVVAHYQEPRQMMCLWDKFQKTKRGNCCNE

SEQ ID NO: 107549 - protein, 185 aa, Triticum aestivum
  Clone ID: PAT_TA_1967.pep
MPADAKIRWGELEEDDGGDLDFLLPPRVVIGPDENGFKKTIEYRFDDDGNKVKVTTTTRVRKLARARLSKAAVERRNWAKFGDAASGDDASARLTVVSTEEILLERPRAPGSKADEPSASGDPLAMASKGGAVLMVCRTCGKKGDHWTSKCPYVHLAPPTDASDMPPTPDALPALSGPAKGSLRC

SEQ ID NO: 107550 - protein, 226 aa, Triticum aestivum
  unsure (1)..(226): unsure at all Xaa locations
  Clone ID: PAT_TA_1968.pep
MPADAKIRWGELEEDDGGDLDFLXPPRVVIGPDENGFKKTIEYRFDDDGNKVKVTTTTRVRKLARARLSKAAVERRNWSKFGDAASGDDASARLTVVSTEEILLERPRAPGSKADEPSASGDPLAMASKGGAVLMVCRTCGKKGDHWTSKCPYKDLAPPTDASDMPPTSDGPAALSGPAKGSYVAPRLRAGAVHTDAGHDMRRRNDENSVRVTNLSEDTREPDLLE

SEQ ID NO: 107551 - protein, 299 aa, Triticum aestivum
  unsure (1)..(299): unsure at all Xaa locations
  Clone ID: PAT_TA_1969.pep
MPADAKIRWGELEEDDGGDLDFLLPPRVVIGPDENGFKKTIEYRFDDDGNKVKVTTTTLRPASSAAAARLSKAAXSERRNWANVPARTPAMPRDPTASARLTARLHRREDPPLXSPRRPMRSKADEPSASGDPLAMASKGGAVLMVCRTCGKKGDHWTSKCPYKDLAPPTDASDMPPTSDGPAALSGPAKGSYVAPRLRAGAVHTDAGHDMRRRNDENSVRVTNLSEDTREPDLLELFRTFGPVSRVYVAVDQKTGMSRGFGFVNFVHREDAEKAISKLNGYGYDNLILHVEMAAPRPT

SEQ ID NO: 107552 - protein, 133 aa, Triticum aestivum
  Clone ID: PAT_TA_1970.pep
MAITNLGFAAMLVILLQVSTLCAVAQHHGVMTLNGFEKGQDGGGPSECDGKYHSNKEMIVALSTRWYGGGRRCQKMIRITSEHNGRTAQAKVVDECDSSNGCKDSIVDASAAVWKALGLNTDIGEAPVTWTDA

SEQ ID NO: 107553 - protein, 71 aa, Triticum aestivum
  Clone ID: PAT_TA_1971.pep
AYAPSIYFSAYYIVKYHINFFLLIILFYLFVQTYWLQSTSRHPGRHLVLRSNEHPLLLITTCCHCPYIEVS

SEQ ID NO: 107554 - protein, 287 aa, Triticum aestivum
  Clone ID: PAT_TA_1972.pep
SPSRGGSDLHPHHAPQPSNGGRDLLLRHARHRPPGAGAVGGAERDPLLGHARLRPPGGLGARRAPGALRLEGALVAPLRPRQRRRVPGPLRLPAEKRALLWHPPAQNRRHLSCRAKLQSQGGTFDISIRNPVGKNVGRIVIGLYGDDVPQTVENFRALCAGEKGFGYKGSSFHRVIKDFMIQGGDFDKGNGTGGKSIYGRTFKDENFQLVHTGPGVLSMANAGPNTNGSQFFICTVKTPWLDGRHVVFGQVLEGMDIVRTIESSETDRGDRPKKKVVISECGELPVV

SEQ ID NO: 107555 - protein, 193 aa, Triticum aestivum
  unsure (1)..(193): unsure at all Xaa locations
  Clone ID: PAT_TA_1973.pep
PFKXXLVNEIVQIYACIAHINCRSAARISLARPIRAAAQQSTSYLHVLDDVPRQVFTCFALFSYYPLDDFLRFNHSQSPRSMLHGAPTVRRRPPRRSGRTGVGREELVAAGVPGETEVGRGRRGRRGRLLVEEEVGEGDLPLLPVLRHGPVDERDEALRHFFCFRSREPKKRVERSSGYWTTLEGRGLNALLG

SEQ ID NO: 107556 - protein, 249 aa, Triticum aestivum
  Clone ID: PAT_TA_1974.pep
GKTSGGSSGKTSGGSSEKKNEPNESVELNSSNFDELVVKSKDLWIVEFFAPWCGHCKKLAPEWKRAAKNLKGQVKLGHVDCDSDKSLMSKYKVEGFPTILVFGADKESPFPYQGARAASAIEPFALEQLEANAAPPEVSELTSADVMEEKCASAAICFVSFLPDILDSKAEGRNKYLELLLSVAEKFKKSPYSFVWAGAGKQADLEKQVGVGGYGYPAMVALNVKKGAYAPLRSAFELAEITKFVKEAG

SEQ ID NO: 107557 - protein, 440 aa, Triticum aestivum
  unsure (1)..(440): unsure at all Xaa locations
  Clone ID: PAT_TA_1975.pep
MRPAILAALLLLLAAAASPAAALYSAGSPVLQLNPNNFKKVLNANGVVLVEFFAPWCGHCKQLTPIWEKAAGVLKGVATVAALDADAHKELAQQYGIRGFPTIKVFLPGKPPVDYEGARDVKPIVNFALSQVKGLLRDRLDGKTSGGSSGKTSGGSSEKKHEPNESVELNSSNFDELVVKSKDLWIVEFFAPWCGHCKKLAPEWKCAGGVGTARNWLLNVDWDSDTSXSSETRPXGFATILVFGSDKESPFPYQGARAASAIESFALEQLEANAAPPEVSELTSADVMEEKCASAAICFVSFLPDILDSKAEGRNKYLELLLSVAEKFKKSPYSFVWAGAGKQADLEKQVGVGGYGYPAMVALNVKKGAYAPLRSAFELAEITEFVKEAGRGGKGNLPLEGAPTVVQSEPWDGKDGEVIEEDEFSLEELMADSSPPNDEL

SEQ ID NO: 107558 - protein, 57 aa, Triticum aestivum
  Clone ID: PAT_TA_1976.pep
WFLLLKSHVLLAEFVCFGLQKVHIVFHVRNIYMDKMSLLFFAFSMLQDTGNMVLFLL

SEQ ID NO: 107559 - protein, 117 aa, Triticum aestivum
  unsure (1)..(117): unsure at all Xaa locations
  Clone ID: PAT_TA_1977.pep
MAGDGELLPRIAVVGAGIFARTQYIPRLREISHLVVLKAIWSRTQESAEAAAELARDFAPGIECKWGDAGLEEIMGDPSILGVAVVLASQXQVELFLKMLKAGKHVIQEKPASGSTT

SEQ ID NO: 107560 - protein, 361 aa, Triticum aestivum
  Clone ID: PAT_TA_1978.pep
MAGDSELLPRIAVVGAGIFARTQYIPRLREISHLVVLKAIWSRTQESAEAAAELARDFAPGIECKWGDAGLEEIMGDPSILGVAVVLAGQVQVELSLKMLKAGKHVIQEKPASGSTTEAETALSVYNSFPNKFPYKPIWALGENYRFEPAFVESSKLMNDIGDMMNIQVIVEGSMNSSNPYFNSSWRRNFVGGFILDMGVHFIAGLRMLVGSEVATVSSISRHVDTDLPPPDNICSLFQLENGCAGVLVFAVNSRSPKILWRVDGTKGTVKIERGDDGGKHGYQVLFSSESGECQKTFYPFCGVHEELKAFVHDMVQASKDGDHKAEPRSSYVEGARDVAVLEAMLESSAKQGAMVQVKKF

SEQ ID NO: 107561 - protein, 99 aa, Triticum aestivum
  Clone ID: PAT_TA_1979.pep
VFSPSTSSPLPSSPPLPSTNPRRRRMEATGSPMHPRRIPTPGTLRSSVPHAATSSPIGTPRGLNPTCPTRCPRSKFVHHPSSFRYKRMLPFLMENGGQA

SEQ ID NO: 107562 - protein, 49 aa, Triticum aestivum
  Clone ID: PAT_TA_1980.pep
PRVRGDSGANVKRLEQETNVKIEQLKQQAANISPEVIQMLLRHVTTVKN

SEQ ID NO: 107563 - protein, 162 aa, Triticum aestivum
  Clone ID: PAT_TA_1981.pep
DSHNSMVNLQEEVRLQGRASARHAITSTITALDPDPLLHRMMPAVAEAACSLFLLRGCSTQNRLQNLMERGDSNHVEDEKDPWGKVILCCSSRRRGPDQTVPAMVRSDLDGEGRGSNDKLHLRSTGKATPTARHRLNRRTASNRGGRASATAAAKGDERQRE

SEQ ID NO: 107564 - protein, 194 aa, Triticum aestivum
  Clone ID: PAT_TA_1982.pep
MRTDVRRGAAAAGRDQFPVGMRVLAVDDDPVCLKVLETLLRRCQYHVTATNQAVIALRMLRENRDMFDLVISDVHMPDMDGFKLLELVGLEMDLPVIMLSVNGETKTVMKGITHGACDYLLKPVRIEELRNIWQHVVRRKFSTRDSVNLDTYEECNKPPSADSDYVYGQVTCGSPDQSGRPSKERKEYQYEEED

SEQ ID NO: 107565 - protein, 76 aa, Triticum aestivum
  Clone ID: PAT_TA_1983.pep
PSKEISYKAKKTHILQSSPTFSLVHNPKNAAVTDRIGESFRTNKRKQKEMSAQWIRLITEDGYKHWSINKLPNGPK

SEQ ID NO: 107566 - protein, 175 aa, Triticum aestivum
  unsure (1)..(175): unsure at all Xaa locations
  Clone ID: PAT_TA_1984.pep
RAPTRPLVYIEQSFDKHDWEHSEXTTLELCEDARDDLLMXDPERIKRAVNEYTCDALTLKASEVGTVTEAIXAVKHAKDAHWGVMVSHRSGDTDDSFIADLAVGAAAGQIKAGHFPAHACEWEQRIAFPHGSLSRLPCHSSRLAFPRHPTHQLKAGAPEWNPAIACCRARSSARL

SEQ ID NO: 107567 - protein, 282 aa, Triticum aestivum
  unsure (1)..(282): unsure at all Xaa locations
  Clone ID: PAT_TA_1985.pep
NESPNSSEERENKKQPDLSPISPTEDEMAQTSIPSFGKGYKTRKWLSDVDSPDXSPENLDRKSHMKDGKRGKKRRLPSPIPFVTSGTQETIMSDKEPVQCPDDYLTRAFDQLLVVLGRFQTKIKSETRNKSSEILAGTGEIIRQHLEGVEVQMQDDVHKLPPTRQSKRKRLESTFEELXVELRVLHEKFKEEVNQQLLGCKNSLEEFEAYHAELKGVADKQKASHKKLLQHAERTVASQLNDAEIKISEVQKRARKKMNGLKHVLKELITETADWSSSPLHK

SEQ ID NO: 107568 - protein, 415 aa, Triticum aestivum
  Clone ID: PAT_TA_1986.pep
MPPPLLVFVCLVLFVLLGAPWPSEAGARPQLFALRARQMPARALPRQPSKLRFHHNVSLTVSLAVGTPPQNVTMVLDTGSELSWLLCAPAGGARNRYNATSFRPRASATFAAVPCASAQCRSRDLPSPPACDGASSRCSVSLSYADGSSSDGALATDVFAVGGGPPLRAAFGCMASAFDSSPDGVASAGLLGMNRGALSFVSQASTRRFSYCISDRDDAGVLLLGHSDLPTFLPLNYTPLYQPALPLPYFDRVAYSVQLLGIRVGAKHLPIPASVLAPDHTGAGQTMVDSGTQFTFLLGDAYSALKAEFTRQARPLLPALDDPSFAFQEAFDTCFRVPQGRTPPAARLPSVTLLFNGAEMAVAGERLLYKVPGERRGGDGVWCLTFGNADMVPIMAYVIGHHHQMNVWVEYDLER

SEQ ID NO: 107569 - protein, 172 aa, Triticum aestivum
  Clone ID: PAT_TA_1987.pep
DIGAWSLFNDTYTVRVNGVVTQVNKKDIAWKSDKNNKFGKNIYPSNFQKGRLIGGATLNESIPLSEQEDLIVWMRTAALPTFRKLYGRIEKDINANDNVTVVIQNNYNTYSFGGSKALVLSTASWIGGKNNFIGIAYLTIGGLCLSLAMGFLVLYMVKRRNFADPSNLSWNR

SEQ ID NO: 107570 - protein, 58 aa, Triticum aestivum
  Clone ID: PAT_TA_1988.pep
KQTRDPPQVRNPRRDRFALGPTNPTQPSRGRPSRPIPSLPASSSPPPPPTPPPPPPSP

SEQ ID NO: 107571 - protein, 99 aa, Triticum aestivum
  Clone ID: PAT_TA_1989.pep
QLAVQQDSYMQSRAEALQNVESTIHELSNIFTQPARMATQQGELAIRIDENMEETVANVEGAQGQLLKYLNSISSNRWLMMKIFFVLMVFLMIFIFFVA

SEQ ID NO: 107572 - protein, 339 aa, Triticum aestivum
  unsure (1)..(339): unsure at all Xaa locations
  Clone ID: PAT_TA_1990.pep
MNPSRSAPASFRDRTNEFRSAVESARRHVAPSPAAASASGSAGPLDDSRSAASAHSEFNRRASKIGLGIHQTSQKLARLAKLAKKTSVFDDPTLEIQELTAVVKKDIGALNNAVMDLQVLCNSQNESGNLSKDTTNHSTTVVDNLKNRLMSATKEFKEVLTMRTENLKVHENRRQMFSSSAAKDASNPFIRQRPLVPREASDTAPPAPWASDSATTPLFQXRKRSDGDRAAPLSPPSAPPRMHPPQFPQQHLVKQVLDDEDILRADGVPHDLHIPRGMIPTPCNACCAQVYSLIFTELHTPCTQFSLGMMMISGRQPSSLLWSCKLGGASRMDLPNWGR

SEQ ID NO: 107573 - protein, 185 aa, Triticum aestivum
  unsure (1)..(185): unsure at all Xaa locations
  Clone ID: PAT_TA_1991.pep
MASDGKSKILVIGATGYIGRHVVAASARLGHPTLALVRDAAPSDPAKAQLLKTFQDSGVTLLTGDLYDHGSLLSAVKAADVVISTLGSMQIADQTKLIAAIKEAGNVKRFFPSEFGLDVDRTGAVEPAKSIFALKAGIRRAVEAEGISYTYVVANYFAGYSLPXIGQVLSPAPPTDSXVILGDGE

SEQ ID NO: 107574 - protein, 302 aa, Triticum aestivum
  Clone ID: PAT_TA_1992.pep
PRPPTLRPRVRPRVRAASARLGHPTLALVRDAAPSDPAKAQLLKTFQDSGVTLLTGDLYDHGSLLSAVKAADVVISTLGSMQIADQTKLIAAIKEAGNVKRFFPSEFGLDVDRTGAVEPAKSIFALKAGIRRAVEAEGISYTYVVANYFAGYSLPTIGQVLSPAPPTDSVVILGDGETKVVFVDEADIGTYTVLAADDPRAENKVLYIKPPANTLSHNELVSLWEKKTGKTFQRVYVPEDAVLKQIQEAPIPMNIIFSIGHASYIKGDQTNIEIAPSFGVEASELYPDVKYTTVDDLLNRFL

SEQ ID NO: 107575 - protein, 310 aa, Triticum aestivum
  Clone ID: PAT_TA_1993.pep
MASDGKSKILVIGATGYIGRHVVAASARLGHPTLALVRDAAPSDPAKAQLLKTFQDSGVTLLTGDLYDHGSLVSAVKAADVVISTLGSMQIADQTKLIAAIKEAGNVKRFFPSEFGLDVDRTGAVEPAKSIFALKAGIRRAVEAEGIPYTYVVANYFAGYSLPTIGQVLSPAPPTDSVVILGDGETKVVFVDEADIGTYTVLAADDPRAENKVLYIKPPANTLSHNELASLWEKKTGKTFQRVYVPEDAVLKQIQEAPIPMNIIFSIGHASYIKGDQTNIEIAPSFGVEASELYPDVKYTTVDDLLNRLL

SEQ ID NO: 107576 - protein, 183 aa, Triticum aestivum
  Clone ID: PAT_TA_1994.pep
LDWSEGHNWTVEKDLPANRLIEFKFLLQDSLGKFHWQNGPNRTLQTGETTKTLVVYEDWGNAKNQKVAEEGPPERRWFSFFSPKPPPTHQTGSCLVAGADPRINYEAAPRSPGSSSSPRATHLSYVLLVGWIGSAWRRKRRRRGRCARRRRWRCSTAPPRTPTTATSASPSSTRSGSASPKRK

SEQ ID NO: 107577 - protein, 254 aa, Triticum aestivum
  Clone ID: PAT_TA_1995.pep
MAPSPSPPPAASGAQYAHQFLNTALSQRGPSALPYAEDVKWLIRNHLVALADAFPSLHPKAALFTHNDGRAAHLLQADGTVPIHHAGATYNLPAVIWLPETYPRSPPLVFLSPTRDMLIKAHHPLVDRAGLVANAPYLRSWVFPSSNLLDPVRSLSHLFGLDPPLFTRSVAAPPPTPPPAHPAPPPAAAPPAPPPVPVAPPGPRPCPPPAPPPPAARLPALGGPTGGLPAHRHLPPCRLRPPKIGNWEFWGVKR

SEQ ID NO: 107578 - protein, 110 aa, Triticum aestivum
  Clone ID: PAT_TA_1996.pep
TVMMNPVFHVAERLLYGKRYAWWLRWILVVFVGLMAMLVPNFADFLSLVGSSVCVLLGFVLPAAFHMKVLGAEIGWPALIADVAVIVVGLALSASGTWTSLAHMFGASNA

SEQ ID NO: 107579 - protein, 163 aa, Triticum aestivum
  unsure (1)..(163): unsure at all Xaa locations
  Clone ID: PAT_TA_1997.pep
MAVTATTAAAAAAMLAAVMAIFLSFVLCFYIFLCAKRSRGGAPPPPGSGVMAHLRFLFCGGDGRAGAGDGVAPWFYDGGLDDASMASLPRREVAKGEAMDCVVCITELAAGETARVLPRCGHGFHVDCVDMWLKSHSTCPLXRWPGVDAPPLPPAPVQAPEAD

SEQ ID NO: 107580 - protein, 174 aa, Triticum aestivum
  Clone ID: PAT_TA_1998.pep
MGNTTSAVLDNLVQGSNFDREEVDRLRKRFMKLDKDNSGTIERDEFLSLPQISSNPLATRMIAIFDEDGGGDVDFQEFVTGLSAFSSKGNKEQKLQFAFKVYDIDRDGYISNGELFIVLKMMVGSNLKDQQLQQIVDKTIMEADLDKDGKISFEEFTKMVENTDISMSMTVDQF

SEQ ID NO: 107581 - protein, 271 aa, Triticum aestivum
  Clone ID: PAT_TA_1999.pep
CRFGTRQEHKHYCSSYGGYVGAFRGYHREASRYTSRFGGRYRGGLGGAYGRDAVPYGGGLGGAYGRDAVPYGTSSYGPSYDSSGASADPSVRSGVGGLYGARGGYGSSSGGGATGRYHPYAGRSPYADGYDGFASRYNNGGRLAPYKSPGFGARPGSYSSAYVPGSYSSAYVPGDYSSGYGGYDGAFGGYHGESSLYSSRFGGSYGGGLGGAYGRDAVPYGTSSYGPSYDSSGASADPSVRSGMVGLYGARGGYGSSSGGGATGRYHPYAG

SEQ ID NO: 107582 - protein, 128 aa, Triticum aestivum
  Clone ID: PAT_TA_2000.pep
MKQQDGASPAKMFIGGLSRQTSMGTFKEYFGKYGEIIDAVIMKDRHTQKPRGFGFITYSDPAIVDRVIEDNHVIDGKQVHSVVPITAGIISVHMGVHRFSLHFLVHKSHVMKFKILDYATAKKKQFYL

SEQ ID NO: 107583 - protein, 191 aa, Triticum aestivum
  Clone ID: PAT_TA_2001.pep
LPDAWGLLLLLPPVRVRLRPAGGLARVLHGDPALSQGHGAGGDGSGAGSPDLAGFQFYKLMAAGMSWEKLVLPDKFVRELNGRELRGVKLRVEGGGARAWDVEVVANEYGDMHLGRGWKEFVRANGVELGQLLVFCYDGAALLTVTVFDDSECGRHCCQREEENDSAEEDESPPPALPGSESSSNDDVHGG

SEQ ID NO: 107584 - protein, 361 aa, Triticum aestivum
  Clone ID: PAT_TA_2002.pep
SLDDGAVRLAHLDAEHRVVAAGVLQQLEEADVADAEAVVDAELVPPVPQRRAGPGAALPPVAVLEADAPLLPAHPQHHPALLREPVRLAELHRHVQVLLLLGAQVALPQRHGEPTRRGAASAAMDDAVAAAASTPWQRRWRRLLLFGAVVFLLALAAVSPALGVVEHLDGEQGGAVVAEDEELPQLYAVGADELLPAPAEVHVAVLVGDDLHVPRARPSAVDPQLHAPELKAAELAHELVRQHQLLPGHSGGQQLGEAEPSQVRGALGHLRRLRVPVGAPVDLRPGAGRRAEQLPGPPGGGGVVELETSQARAVPQLLRHLRRLRVPVRAQNHHGAHGRGPRLVSVSLSLMGGGGGCPRAE

SEQ ID NO: 107585 - protein, 262 aa, Triticum aestivum
  Clone ID: PAT_TA_2003.pep
MLSKILISALLSGALAAKQETLPYADEPNRCDTTCQLAYRQALTGESNLWVNQNVSTDPFYSNPANMSDYAAGDLVKWEEIPSVQTTRRWTIPGSVTLNRYFYMTEDINGKPIPATGFVMIPYANPLGNDKPFRTLVWTHGTAGGTRQCAPTNHRGLYYEWQAPFELVLQGYVVIAPDYAGQGSDIPEGFMYESGALHAGDVSFGLQAAPKALGNKITKEWVVIGHSEGGMTAWRTDEREGMKQATGGSLGAVAMAPALSPS

SEQ ID NO: 107586 - protein, 120 aa, Triticum aestivum
  Clone ID: PAT_TA_2004.pep
MDPSKLGELRSFVEACKKDPALLADPALAFFRDYLASLGATLPAAAAAGAKPAPKARSMDDIDDDDEDEEEEGEDDQDMRDPTPEPDELDEDIVESDLELDNDGVVHPDHDDAPQKMGRL

SEQ ID NO: 107587 - protein, 405 aa, Triticum aestivum
  unsure (1)..(405): unsure at all Xaa locations
  Clone ID: PAT_TA_2005.pep
MDPSKLGELRSFVEACKKDPALLADPALAFFRDYLTSLGATLPASAAAAGKPAPKARSMDDIDDDDDEEDEGEGEDDQDMRDPTPEPDELDEEIVESDLELDDDGVVHPDHDDAPQKMGDSSVEVTEESRDASQETKGQAMEAMSEGKLEEAVEHLTKAILLNPTSAIMXGTRASVLIKMKKPAAASSYAYPAXRINPVSGCCYDSRGLGDGILGKWEEAARDLHAASNIDYDDEINAVLKKVEPNAHKIVEHRRKYDRLRKERAEKKAERDRLRRRAEAQAAYEKAKRKEQSSSRSSGGMPGGMPGGFPFPGGMGGMPGGFPGGXGGGMPGMGGGMPGAGGAPGNVDMGDILNDPDLMAAFGDPEVMAALQDVMSNPANLAKHQANPKVGPIIAKMMAKMNGNR

SEQ ID NO: 107588 - protein, 282 aa, Triticum aestivum
  unsure (1)..(282): unsure at all Xaa locations
  Clone ID: PAT_TA_2006.pep
MYVGNITYYHRPLRSGKWAVTYEEWEEEVYPPYANGPGYVISSDIAEYIVSEFDNQALRLFKMEDVSMGMWVQKFSKTRQPVEYLHDVKFFQAGCFDGYYTAHYQSPLLGIRPAANLLAGRAPGRNAWWLATRXSSNSVARFFVALNGKKEVNEELKKEAEFFGDIVLVPFMDSYDLVVLKTIAIAECGGRVVQAKYVMKCDDDTFVRIDAVLDQVKKVKNGGSMYVGNINYYHRPLRSGKWAVTYEEWEEEVYPPYANGPGYVISSDIAEYIVSEFDKQQG

SEQ ID NO: 107589 - protein, 142 aa, Triticum aestivum
  Clone ID: PAT_TA_2007.pep
MECGLKSLSSSSTPVASPSVMTPSRPRPLPPRRPAPPHLNPPPPPVPRPPPGPPRPHQAPKTPAGGAASAPIVVAAPPMPAWTSMDSMYSVSPPPSSVPMPTSLLLAAGAGRKKMPTPCAVQVAGGGVDVGATDELRRLLRL

SEQ ID NO: 107590 - protein, 258 aa, Triticum aestivum
  Clone ID: PAT_TA_2008.pep
PTRPSNSLGGGGRDDAAKGRTRPPLLPKSPSTSSAGAGASGRTAKASASGSRRLLRTPSLPAPRIGMDPSWPKDNELIVEEDAGGGDQQEAEVEDDDMNWSKIYEGVLRTRIAEEGRGSSALNRAPSMPVTSSATMGDGNGRRPAGVTESTPSMPRLRHSHSTLERHYRSRTPTKPDRTPRMTGGGSRAERGPPRRDLRSFSANQQPALVRDKSGLQDKMWKSSSALESIEVQGFKDLGFVFDQEELRESLADVLPGL

SEQ ID NO: 107591 - protein, 265 aa, Triticum aestivum
  unsure (1)..(265): unsure at all Xaa locations
  Clone ID: PAT_TA_2009.pep
MKFSPLLLSTLLANTVVAQTPDKTQEKHPKIETYRCTKAKGCKKATNYIVADAELHGISQANGQSCGNWGEAANSTACPDEATCAKNCKLFGMNEAAYKAKGISTSGNALRLEMLRNGQSVSPRVYLLEENKNKYEMLKLTGAEFSFDVETQKLPCGMNGALYLSEMPADGGKSTSKYSKVGAAQGGGYCDAQCYVTPFINGVGNIKGKGVCCNEMDIWEANSRATHIAPSPCSVPGLYGCTGAGWQXDGICDKAGCGWNITRTS

SEQ ID NO: 107592 - protein, 155 aa, Triticum aestivum
  Clone ID: PAT_TA_2010.pep
TASSAAGMLTVVNINPSIYLNLLATGPGAGAIGAAAGSAAADDVAVAQALARPSDQHSVSRLSRRACVPGATRGAEDHGLSPSRTPARSSATLRSSSDESSASASDRRRLRPAAAVLEYPVHIQRMYIQRTECGVHRVTSMSSAVARCFSWRAGG

SEQ ID NO: 107593 - protein, 246 aa, Triticum aestivum
  unsure (1)..(246): unsure at all Xaa locations
  Clone ID: PAT_TA_2011.pep
CAASCDTQDRDRWRPDLEAAPSSGFVGAHVDVGAAPAVPRLLRRPQRPAAITPLNRWCVYYFKKLFGVSPLDGAAALCFVAQKXGLKLLVVHVSVVGGSAGITSPTVLSKPLQSVALTDEQSEQLTKWIQNAATEVVEAKAGAGSATLSTAYAAARFVESSLRALAGDPDVYECTYVQSXELTELPFFASRVKIGKNGVESIISLDLEGITEYEANALEALKPELKASIEKGIEFAHKQQGAAASV

SEQ ID NO: 107594 - protein, 271 aa, Triticum aestivum
  unsure (1)..(271): unsure at all Xaa locations
  Clone ID: PAT_TA_2012.pep
GKFMVHRNVIRKAINNTFYQFIYETEKHNGIAELLEILGSIINGFALPLKEEHKLCLIRALIPLHKPTCIAMYHQQLSYCITQFVEKDCKLSDTVIRGXLLKYWPITNSSKEVMFLGELEEILEATQPAEFQKCMVPLFRQIARCLNSSLFLVAVRSLSVPPMDRFVGVANRRSLAVVPPLVPALERGPSALRNPAGLCLTRHGRKLCSQRVAGLYTECLRKYEEAKAKEKENKLKQEATWKRLEEIASSRATSGEAVLVHRTLPRQSSAV

SEQ ID NO: 107595 - protein, 70 aa, Triticum aestivum
  Clone ID: PAT_TA_2013.pep
MTLACRGRAMELVKCLSGTDSVKVQKKPYKVSAGEKAPNITCDCFGLRETYFTCKRYVVDMRDRIRGNEG

SEQ ID NO: 107596 - protein, 132 aa, Triticum aestivum
  Clone ID: PAT_TA_2014.pep
GASPPSETQALTMAEPSSVRRKSGWNSLPTEVIKLIVSRVDNLSTMPLAACSSGLYRLLKALRPELFKPAPCLLMPPDLQKWRVTQHNDRRVASINPLDCDPIPVSLNYINGMYWVGMNTSWMVLVDPRYLT

SEQ ID NO: 107597 - protein, 91 aa, Triticum aestivum
  unsure (1)..(91): unsure at all Xaa locations
  Clone ID: PAT_TA_2015.pep
LQTSMPDRGTTTNHAQRPCLCGVWTYMQKNSKMPVHCTTHHHHQLGFFSTPTPIKHSVGDDGGEEACSAGRAADGAALFDLLQXSTCRDRY

SEQ ID NO: 107598 - protein, 136 aa, Triticum aestivum
  Clone ID: PAT_TA_2016.pep
HSPTPRSPALKSLKSSTFPPSPGSPPAMAAKVAGGAASLPAAQEASLARQYTAMDISGGEMGEEAEVSSFTTRFASLRVREDRLAKIAASLRLIKEKRGSRPPTYIELAAAVLLKDSVAAALQRRATIVVGRSLLE

SEQ ID NO: 107599 - protein, 138 aa, Triticum aestivum
  Clone ID: PAT_TA_2017.pep
STCEKTTEREYQLEDLEIVSADYMLRVAVSNFRNAWENMDPESERVDEYGLGARESLAEAVNAVTSILGMQPCEGTEVVPSNARSHVCLLSGVYMGGVKVLVRLSFGLSGPKEVAMKLAVRSDDPEVSDKIHEIVASG

SEQ ID NO: 107600 - protein, 618 aa, Triticum aestivum
  unsure (1)..(618): unsure at all Xaa locations
  Clone ID: PAT_TA_2018.pep
MVILEAARKITEMDVTSRELAPAITVLQLFLSSSKPVLRFAAVRTLNKVAITRPLAVTNCNVDLESLMSDQNRSIATLAITTLLKTGNESSVDRLMKQITSFMSDISDEFKIVVIEAIRSLCLKFPLKYRSMMIFLSNSLREEGGFEYKKAIVDSIVTLIGAIPDAKEIGLLHLCEFIEDCEFTYLSSQILHFWGNEGPRTXSDPSRYIRYIYNRVIWENPTVRASAVSTLAKFGALVEELKPRIFVPGRRRVNWGAGPARDRATLYLQTLNGEVAVGNSEKDVKEVLFGSFDVPLANLGASLRSYEPPEEPLDTSLVSRDVRSHPLQDKKAPGKKPPAGAPAPXAPVSAVDAYQKMLSSIAEFSGFGRLFKSSEPVELTEAETEYAVNVVKHIYENHVVLQYNCTNTIPEQLLEDVTVYVDATDAEEFSEVCSKPLKSLPYDSPGQIFVAFEKPEHVPAIGKFSNVLKFTVKEVDTSSGEADEDGVEDEYQLEDLEIVSADYMLRVAVSNFRNAWENMDPESERVDEYGLGARESLAEAVSAVTSILGMQPCEGTEVVPSNARSHVCLLSGVYIGGVKVLVRLSFGLSGPKEVAMKLAVRSDDPEVSDKIHEIVASG

SEQ ID NO: 107601 - protein, 260 aa, Triticum aestivum
  Clone ID: PAT_TA_2019.pep
MATYQNGVAPARAMDDDSDVEEEALVAEYKEQVQYEDGDDLSRTTSLNLAQQTDDIQSRLVQAAQPLDFQAPLEAKFQSYDAYCSLFHFILNSEGPVDLEPPSYYWAWDVIDEFIYQFNSFSSYRMRIARQTTNEEERQALRENPNTWGCYSVLNVLYSLIQRSQITEQLGAMKRGEDPAAVAGEYGNKNLYKMLGYFSIIGLLRVHCLLGDFSLALKTLDDIELNKKAMFARVMAAHFTTYYYVGFSYMMQHRYADAIR

SEQ ID NO: 107602 - protein, 429 aa, Triticum aestivum
  Clone ID: PAT_TA_2020.pep
MSKAQLNQLCQQRRWPAPDYTHRSEGPAHSLRFRATVTVNGEVYHSPDDGDGFSTAKEAQNLAAKAAFERLSALPPPPPPQSETQLPYKSQLQVYAQKRHKDLPSYDTIRSGPSHAPRFKSIVTIDGQTFESPQYCHTIKEAEYAAANLALVSLAQEVSSEEQLPVRGMQYTIPPRVRAEKDRSSLPVCNTSSDNLKNSSISKSTVHTLGESFQEGPGNTKKQKQMMVAPFQPSKDIGSQMQQGTETLTEQEVKTVESDSSFPQVSMGTSDGQNDSNATEHDSCSVGSRIDLPVADKTQSLDEPIKSGSMENVKPAAPEPSIKAEVIDLTQECRSPPLVSVPPTDMLNLVATTKHTSLPFGSMPPTNTSNLAAKATAVPVDSARCSYSMSTNRIQIYPCRPDLKMKLPEGATVLPFSDDKWVAVSLPFP

SEQ ID NO: 107603 - protein, 321 aa, Triticum aestivum
  Clone ID: PAT_TA_2021.pep
MAAAPAAGGQGGGMDAALLDDIIRRLLEVRTARPGKQVQLSESEIRQLCTASRDIFLTQPNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTDCFNCLPVAALIDDKILCMHGGLSPDLGHLDEIKNLPRPTDVPDTGLLCDLLWSDPGKDVQGWGMNDRGVSYTFGHDKVTEFLLKHDLDLICRAHQVVEDGYEFFADRQLVTIFSAPNYCGEFDNAGAMMSVDETLMCSFQILKPAERKIKFMASNKM

SEQ ID NO: 107604 - protein, 212 aa, Triticum aestivum
  unsure (1)..(212): unsure at all Xaa locations
  Clone ID: PAT_TA_2022.pep
SCRSQCSASATYDYRLPSLTYIHLSISAKQTLQLLASSFHPHPDANAASSISIPFYSSSSSSSSSSSSSSSSSSSSSESXSSSSSSSXPSSSESSSSSSSPSSSESSSSSSSESSSSSSSSSSSSSSSAPSPPAASPDPDAARLASAPPPAGGAGAGAGASGGASPPAASSSEASSTSTSTSSVAGGGGCGGEGGMGRRGRPRFGFRFGGRE

SEQ ID NO: 107605 - protein, 114 aa, Triticum aestivum
  Clone ID: PAT_TA_2023.pep
RPRVRPRVRGRVGCPPRPYPRCYLPVRILVHGRISQVVRTLTRHGGRACQGGHGLPQQPQGAQIVGAGGDGPSRGVCIHAGPGFLVRNVIARPVRLGLQGVGDSAGLGALTFRA

SEQ ID NO: 107606 - protein, 211 aa, Triticum aestivum
  Clone ID: PAT_TA_2024.pep
MGRAPCCDKASVKRGPWSPEEDELLRSYVRSHGAVSNWIALPQKAGLNRCGKSCRLRWLNYLRPDIKHGGYTEQEDMVICSLYNSIGSRWSIIASKLPGRTDNDVKNYWNTKLKKKAMAMHHQQQHYHHHGTAGRGHARAATIATPPPAPQSQCASYMQPSPASASSAVTTASGDAGSFGAMYSPSHQAAPLGHYNVNTAAPLAEFSAMPT

SEQ ID NO: 107607 - protein, 177 aa, Triticum aestivum
  unsure (1)..(177): unsure at all Xaa locations
  Clone ID: PAT_TA_2025.pep
RTRGRTRGAQSFPSPYHAVPLALGHVAVHGRGRVVAPRPPTPHTRATRGLGARLHRRRLPTHSSAAAAGVPAELQLPPSGRGPAVQPGGVRVLRPPLQALHRRDRRLHAAHLPQSPGSGRRLRAALHLLRQXEKXWLRIQGAXEGLLTXCXTAGNPKSPARRQVYRRLSCLPKRRGT

SEQ ID NO: 107608 - protein, 260 aa, Triticum aestivum
  unsure (1)..(260): unsure at all Xaa locations
  Clone ID: PAT_TA_2026.pep
MECVRSGALDLGRSGNFLGKSGSTTSCGKVRCSTNLAGSTKCEQNLHGKVKPLLLSASGKARGTSGLVHRSAVLKHQHHLSVRSTSTDVCTTFDEDVKGVSSHAVEEKIGVLLLNLGGPETLNDVQPFLFNLFADPDIIRLPRLFRFLQRPLAKLISTFRAPKSKEGYASIGGGSPXLRKITDEQANALKVALKSKNLEADIYVGMRYWYPFTEEAIDQIKKDKISRLVVLPLYPQYSISTSGSSIRVLQNIVKEDPYFA

SEQ ID NO: 107609 - protein, 217 aa, Triticum aestivum
  unsure (1)..(217): unsure at all Xaa locations
  Clone ID: PAT_TA_2027.pep
MASVRSCVSVKPAAGPARYRSARVGAASLEPTSLRISASSSSSLGPGADGCGRGVGCAASISGRGVAAARLVGDGWRARRRGAREVVAECSASLEGVRHGAAAAAMPSVPALPERAKVVALVAAVMLLCNADRVVMSVAVVPLAAQHGWSSSFVGIVQSSFLWXYVFSSMVGGALADRYGGKKVMAGAAALWSLATFLTPWAASQSATMLLAVRVLF

SEQ ID NO: 107610 - protein, 146 aa, Triticum aestivum
  Clone ID: PAT_TA_2028.pep
MPVPLAPYPTPPVPFTPPAPNAGAQSQLVCSGCRNLLMYPAGATSVCCAVCSTVTAVPAPGTEMAQLVCGGCHTLLMYIRGATSVQCSCCHTVNLAMEANQVAHVNCGSCRMLLMYQYGARSVKCAVCSFVTSAGASSGSEQKPSN

SEQ ID NO: 107611 - protein, 411 aa, Triticum aestivum
  unsure (1)..(411): unsure at all Xaa locations
  Clone ID: PAT_TA_2029.pep
MPPLEALLGAAELWRPAARGASGWATAAALLLLLVAHLSVLLVRRRRRGRARLARQQEDAPAAPASPSPSSGSGSSSGSGVEGLVTEDDLRQLVGSLXVGARQPELEGWDPVIAKGNDAVSYKAWCERTADGTPRYLSVTTYEGCSTELLRDFYMDNEYRMEWDDTVIKPEQLQCDEDSGIEIGRTVKKFPLLTPREYILAWRVWASDENSFYCLVKECEHSLAPIQRKFVRVRLLRSGWCIRKVPGRDACEITVLHHEDNGMNIEMAKLAFSKGIWNYICKMNNALRRYPQHRGPSISILTMRRLTKKFPQDLQINVDESNRSPVNTAAAVAPPTPSSGTSPCKQLGKKSSRETIASGLLLIGSIVCLSKGRSNLGAQLAMAFFLKKAFKQDKESGSSPRGRTDATVPMQ

SEQ ID NO: 107612 - protein, 141 aa, Triticum aestivum
  Clone ID: PAT_TA_2030.pep
ISYSLFDGTCYSDNRSNSRANTCNKPRLLGGAHLLDKRLTRALLADPMIHDNSTDRTAFVPATHHSNFCPTSSGRRSRARQSPHPRPPSLPPLRPFLFLQLRIFVCCRCLFGCAVAYCQLKTASVFSTPVLYGVVYKDVLL

SEQ ID NO: 107613 - protein, 240 aa, Triticum aestivum
  Clone ID: PAT_TA_2031.pep
EKQKAGRLRAVRSNAKDGGAVQKGKKQKGVRQASALDKALSIESAEDSAEGLRDKTPKQASAVRDKKSGKKALSGTSVAKKEGSSKRSGRTNLKEHSDAAEDSTSQLHVSSASENAAEAGDMTSVNRSQHKTGLTVEGTHRKIKAMVRDILLGDVIDRQLAAEMAYVGEVIFGICEATEAKATAATTTETEGGLSTKRAASGLEADSSRAAKKKPRKGKAAKPETKDPNSSPGRGGIGAA

SEQ ID NO: 107614 - protein, 373 aa, Triticum aestivum
  unsure (1)..(373): unsure at all Xaa locations
  Clone ID: PAT_TA_2032.pep
GRNRGRPAPRRDGGAYFYTDTARAARAAGGAPARLEMAPMAANAAWHMGEWDQMSEYVSRLDDGDENKLRSLGNTTASGDGSSNGAFFRAVLSVRCKKYEEARVYVERARRCLATELAPLVLESYERAYNNMVRVQQLSELEEVIDYPPLRMESPTADGRRELIRADAWERIKGTKRNVEVWQALLAVRELVLPPNEDRDTWIKFAKLCWKSGRISQAKSTLVKLLQFDPESSPELTLYHGHPQVVLAYLKYQYAVGDELKRKDAFSRLQDLSVQIATATNSYSGMLVSHGAISSAGVPLTARVYLTLASWKRALSPGLDDDAIQEILVSYKNATLSAKDWGKAWHSWALXXTEVMSRYTLRXRPXIXXXYVX

SEQ ID NO: 107615 - protein, 205 aa, Triticum aestivum
  Clone ID: PAT_TA_2033.pep
FFHDSMGANMQLDIQTSAYEASLIQGFLYLDSEGSPIGWEVINPEPPNQMICGPSSEPNSKVSGHCGELNMQNEARTSEQREISESDPSKNGKKRSEKVAGIKDDALRKKQKVNSVHASHCAIGKNMDITTEVPASCVVHNGKEQIGATSSEHASSNQKRSQEAADIQDEVREKKQKVNDGLISDSIIGQCMDGSTAEIPTRCVT

SEQ ID NO: 107616 - protein, 314 aa, Triticum aestivum
  unsure (1)..(314): unsure at all Xaa locations
  Clone ID: PAT_TA_2034.pep
MSMLMSFPHGLAMPAQAHPSWCRSRVATRAGRWACKPTATAHFDNTVTGTLPTYMCVGNRVVGCSDDTGCSDLPWARWIRGWTAEENRHGDLLNRYLYLSGRVDMRQVERTVHHLLRNGMQMLRPSSPYHNAVYGSFQERATFISHAHTAKHAARHGDRCLAKXCGVVAADEKRHETAYTKVAAKVFELDPDGMVQALAAVLRDKITMPGQLMTDGRDADLFEHFSAVAQRTGVYTARDYGDMVEHFVRRWKVADLGGGQLSGEGRRAQEYVCGLPRKIRRVEELAHDRVIKAAKEPEFARFSWVFDRPVCIRA

SEQ ID NO: 107617 - protein, 161 aa, Triticum aestivum
  Clone ID: PAT_TA_2035.pep
MASLLSLVLLLALLDASRATNFEVGGDAEWVVPQAGDSQTYNHWASKNHFHVGDIVHFKYNQDSVMVVTEQGYNKCESSHPIFFSNSGNTEVRLDRPGPFYFISGVTGHCQGGQKLVIKVTDKARPPPGPPSGAAPAGFGSAGAIVVLMAVLWPLLVMHDI

SEQ ID NO: 107618 - protein, 162 aa, Triticum aestivum
  Clone ID: PAT_TA_2036.pep
NATRLITVQSPLGGDNFGQFGVVDNELRDGPDPLRSSLCGRFQAQFALAGLVSPPGMQSAVNFLFTEGKFRGSTVSVLGPILDFETTCERSIVGGTGVFRMARGYSFMRLVPEMSVPDKYSVYRLDLFVQLSSDRPPLPPVDSVGAYGHFNLKYQVCASCSV

SEQ ID NO: 107619 - protein, 117 aa, Triticum aestivum
  unsure (1)..(117): unsure at all Xaa locations
  Clone ID: PAT_TA_2037.pep
QTSSATGSVPVCFPKNNSLVPACEYDPGDGVAGRQRXSAVVFLPAGVNAQYIIEGLSXSGVMFLLRGVGVILLDLAVDRTRPRSLRVSFGGAGVAAIVIAYAMAMLFLRIKIPGYLW

SEQ ID NO: 107620 - protein, 198 aa, Triticum aestivum
  unsure (1)..(198): unsure at all Xaa locations
  Clone ID: PAT_TA_2038.pep
MKPKVAAAAAGGEKGRGVDPSLPRFKCQECHRALVVVGVESFPDRLPAHANSGIHASSVQGSIMGASRMDSSYVVLSKQNRSQGPRIPPRPPSAAARHVEPNQSTRAIEGSYIMLPPAAASIYKTSTSERGGAHLSPPNVNSTSXFPGNNSGFNSSVTXLKRAFEIASSQTQVEQPLCLECWRVLSDXMDKRWKDVIL

SEQ ID NO: 107621 - protein, 234 aa, Triticum aestivum
  unsure (1)..(234): unsure at all Xaa locations
  Clone ID: PAT_TA_2039.pep
RYWHEXNSFQFQLTSHQEERDAVLAKIEVXQVHLELLKRTNVLNDAFYISHDGVIGTINNFRLGRLPNVQVEWDEINAAWGQAALLLHTMAQYFPKFQYRIKIHPMGSYPRVTDINNNTYELFGPVNLFWSTRFDKAMTWFLTCLQEFSEFAISLDKENNVPSDKSLKLPYKIDGDKVGSYTIFLSFNKLENWTKALKYMLCNLKWVLYWFIGNTSFAPPSASLYLAQSPNKKG

SEQ ID NO: 107622 - protein, 484 aa, Triticum aestivum
  unsure (1)..(484): unsure at all Xaa locations
  Clone ID: PAT_TA_2040.pep
FPDRLSAHANSGIDASSVQGSFTAASRMATCYVVLSGQNRPPSRRTPPRPPSTTARHVETAEESXTLEASESRHPAAAPSIYKTSTSEGGRAHLSPPNVNSTSPSTGNNPGFHSSVTALKRAFEIASSLPQVEQPLCLACMRALSDKRDKEIEDVDTDIKAYDAXLQRLEQESYNILSEPDFLKGKEKIEEEEKKLKAAIEEAEKQYSEVSSEMKDLEMKSKQCEQMXERHWLEFKTIQFQLTSHQEERDAVLAKIEVSQVHLELLKRTNVLNDAFYISHDGVIGTINNFRLGRLPNVQVEWDEINAAWGQAALLLHTMAQYFPKFQYRIKIHPMGSYPRVTDINNNTYELFGPVNLFWSQTSTNNTYELFGPVNLFWSTRFDKAMTWLLTCLQEFSEFAISLDKENNVPTDKSLKLPYKIDGDKVGSYTIFLSFNKLENWTKALKYMLCNLKWVLYWFIGNTSLAPPSASLYVPRGSILDCMM

SEQ ID NO: 107623 - protein, 244 aa, Triticum aestivum
  unsure (1)..(244): unsure at all Xaa locations
  Clone ID: PAT_TA_2041.pep
MQSHGLIGEGPDASYLWIACHPLDVYGHALKRGQLSRSGIWVGHSGDGRKSSFNAISVGWHIAPEKYGDSHPHLFTYWTRDGYQSTGCYNMDCPGFIAASSATVTPRXGALINPSSKVTLRVLKDXPPWTLVGVLWLQTASQTACGLLPQXSLFTNMAKKANQFSFGGFVFAERALPTPPLGSGVLPGGKGRAASFTDLRLIERDGRSSPIMKDLPTVISNNKCYSITPIVNSGCFYGGPGGCV

SEQ ID NO: 107624 - protein, 103 aa, Triticum aestivum
  unsure (1)..(103): unsure at all Xaa locations
  Clone ID: PAT_TA_2042.pep
WRAPCYVGVHFPPTGLPFGAPERIANRSITLVDWSXRAAPHPATFGAADVTEDFLGMLVGKKGNAERCMYNGQPVEVCFLFARKFAPAALPQLLSLSSKILGY

SEQ ID NO: 107625 - protein, 183 aa, Triticum aestivum
  unsure (1)..(183): unsure at all Xaa locations
  Clone ID: PAT_TA_2043.pep
WIXQAIRKSVLEQTQIIRLPAHMAEASSRLKECRRRLRRQLNRLPTNEEIALDTGMTARRVEAAMCLPRYSVSLTGKVGCTDVTYQEITADKSTETAEETLHRLFMKKDVDKALDSLTPREREVIRYRFGMDDGKARTLHDIGQLLGVSRERIRQIEMAAFRKLRSKKKVTSLQHYLEPAESW

SEQ ID NO: 107626 - protein, 76 aa, Triticum aestivum
  Clone ID: PAT_TA_2044.pep
MAAAAPADAKAEAAKMDLLEDDDEFEEFEIDQEWDDKEDGNEAVQQWEDDWDDDDVNDDFSLQLRKELEGGNTQKS

SEQ ID NO: 107627 - protein, 76 aa, Triticum aestivum; identical to SEQ ID NO: 107626
  Clone ID: PAT_TA_2045.pep

SEQ ID NO: 107628 - protein, 78 aa, Triticum aestivum
  unsure (1)..(78): unsure at all Xaa locations
  Clone ID: PAT_TA_2046.pep
MAAAAPADAKAEAAKMDLLEDDDEFEXEFEIDQEWDDKEDGNEAVQQWEDDWXDDDVNDDFSLQXRKELEGGQHSRRS

SEQ ID NO: 107629 - protein, 409 aa, Triticum aestivum
  unsure (1)..(409): unsure at all Xaa locations
  Clone ID: PAT_TA_2047.pep
MDVDSEPSAESKPTQMDLEDQADAKGKGKADAAEEEKGNGKGKGDELADSIGSLSIGPGRANFKKKPVIILVIGMAGTGKTTFMHRLVCHMQASANMRGYVLNLDPAVMTLPFGANIDIRDTVRYKEVMKEYGLGPNGGILTSLNLFSTKFDEVISVIEKRADQLDYVLVDTPGQIEIFTWSASGAIITEAFASTFPTVVAYVXDTPRSTSPVTFMSNMMYACSILYKTRLPLVLTFNNVDVAKHEFALEWMHDFEAFQTALDSDSSYSSSFTRSLSLVLDEFYNNLRSVGVSAVSGTGIDAFFEAIEASANEYMETYRADLDKRIAEKERLEAERRNENMERLRRDMEKSKGQTVVLSTGLKDKTPASEMMGDADEEEEEEALEDFRISEDDDDEDEGEDDEVTHFGF

SEQ ID NO: 107630 - protein, 162 aa, Triticum aestivum
  Clone ID: PAT_TA_2048.pep
MSHFAAMKSPVPVAAAAATDAKSPLFCPKPRRPVAPLRCHQSSHSDAGAGMDLLDLLLSKGDESNLSAASPQPPLFCGSPPRRASNPVVHDSRFGMDCPSSPLPVTPAPVVVRPTPRPAGPPMSPRSSAGCARVFQPAVRVEGFDCLDGGRSGRGHGIAAMV

SEQ ID NO: 107631 - protein, 122 aa, Triticum aestivum
  Clone ID: PAT_TA_2049.pep
HTQQQRSVRSIYTSSWRAGSRFVWPTTMYERTYTSGGRRTVIVVIVVVAVRLGLPMPPAAPGVTRRGVNGVGGNAAVLDDVAHDLGRRRHEKLSLSMQANHKLEVWSASSCCKLKLASWYCQ

SEQ ID NO: 107632 - protein, 143 aa, Triticum aestivum
  Clone ID: PAT_TA_2050.pep
MALADVADDVHRWVREAATDEHFRGLIDWVEALRPKPAAARAYLGGTGGTKATACIVSSGMGFPVREINFGTGLPAFASYHFPWPAGAAYVMPMPSARDDGEWVVYVHAAPELVKVMEEEPTVFKVLREQLRVRMKDIVVPVI

SEQ ID NO: 107633 - protein, 107 aa, Triticum aestivum
  Clone ID: PAT_TA_2051.pep
RKNADTILKKYSSTVATIFTGLASAAFLGHTLAFNRLLGLSVVATPGLLCAPPLAFLFDRRPAELLLVPASLLPRSPHSAFVFVTAPPAEDACLPLGPGAPRPPAPR

SEQ ID NO: 107634 - protein, 181 aa, Triticum aestivum
  unsure (1)..(181): unsure at all Xaa locations
  Clone ID: PAT_TA_2052.pep
ILINRWLSCSASSSYYSSLLPCPRCPPARGSASARRSRGACRPSSAAPSAAAGPPPCSSSSTSPGPPASSSSPSARWTSSPTTTPSGRRSPPRPPSATGPRPAPQAPPAPPAPRPPPXPAPLPAPAPPAPPRPAPPAIAPGPAPGEPVMDSGTAVVASSHGRALMLVVSSTTLALMGTIRA

SEQ ID NO: 107635 - protein, 297 aa, Triticum aestivum
  Clone ID: PAT_TA_2053.pep
RTRGPMTSRVVTLWYRPPELLLGATDYGVGVDLWSAGCILAELLAGKPIMPGRTEVEQLHKIFKLCGSPAEEYWKKSKLPHATIFKPQQPYKRRIAETFKDFPQSALRLIETLLSIDPADRLTATAALNSDFFKTEPLACDPSSLPQYPPSKEMDAKRRDEEARRLRAAGSRPNGDGARKTRTRDRPRAVPAPEANAELQANIDKRRLITHANAKSKSEKFPPPHQDGALGYPLGCSNHMEPTFEPPDPSSFSTVFPYDKTAVPTWSGPLVDPPGGNQKRKHKSGRSSKQPSTARAR

SEQ ID NO: 107636 - protein, 428 aa, Triticum aestivum
  unsure (1)..(428): unsure at all Xaa locations
  Clone ID: PAT_TA_2054.pep
MDPTSRPAVVIDNGTGYTKMGFAGNVEPCFITPTAVAVNESFSDQTRATAKGNWLAQHSAGVMADLDFLIGEEALARSRSSSTYSLSYPIRNGQVDNWDTMEKFWQQCIFNYLRCDPEDHYFLLTESPLTPPETREYTXGEIMFETFNVPGLYIAVQPVLALAAGYTTTKCEMTGVVVDVGDGATHIVPVADGYVIGNSISSIPLTGKGGTQSTRRLLWGSGERVPPVLPFVVARWAGVMYCYTCSDIVKEFNKHDREPSKYIKRLTGIKPKTGAPYTCDIGYERFLGPEIFFHPEIYNNDFTTPLQDVIDKCIQSSPIDTRRALYKNIVLSGGSTMFKDFHRRLQRDLKKIVDVRVRASNARLGGDAKAQPVEVNVVSHPIQRYAVWFGGSVLASTAEFYEACHTKAEYEEYGASICRSNPVFKGMY

SEQ ID NO: 107637 - protein, 65 aa, Triticum aestivum
  Clone ID: PAT_TA_2055.pep
PLVRALEADKEFIKQCVWSLNKGGKGFVLLQGESCSIFGDLRRIEQRARTNSGEVSPHYVHPYTD

SEQ ID NO: 107638 - protein, 63 aa, Triticum aestivum
  Clone ID: PAT_TA_2056.pep
QPQQPKKKLSSTKRGREVELGVVGFGKEVVLKQRRRMRRRPRLGEEEKAAILLMALSSGVIYG

SEQ ID NO: 107639 - protein, 137 aa, Triticum aestivum
  unsure (1)..(137): unsure at all Xaa locations
  Clone ID: PAT_TA_2057.pep
IHTIFFALAAETALSSRDVRPVIKRVRQEVLQGCKLVFSRVFPSDCRPQHQIMWKMAEQLGAACCSEVDPSVTHVVAVHAGTEKARWXAVKHKKFLLHPRWFEACNYRWHRQREEDFPVPGPKEGKGKENVPENAHL

SEQ ID NO: 107640 - protein, 153 aa, Triticum aestivum
  unsure (1)..(153): unsure at all Xaa locations
  Clone ID: PAT_TA_2058.pep
ERTMYPGKYAVEMSSAIYGDWRFTEQSLPNDLLKRGVASSSDEPGGLTLHIEDYPYAVDGLEVWHAIDXWVRSYCAHFYHSDKEVDGDAELQAWWXDVRTVGHGDRQGDQACWLALDTVAPPAPSPSAPRRIASARHPAGFRRRHPAPVCAPG

SEQ ID NO: 107641 - protein, 207 aa, Triticum aestivum
  Clone ID: PAT_TA_2059.pep
YQQVGQIDHNAILFMNEFNTLEQPMDPNGTPTKFVAKMKLIQGYPGNAGLKLGVGLESHFSTPNLPYVRGALDTLAQLKLPMWMTEVDVVKGPNQVKFLEQVLREAYAHPGVQGIVMWAAWHANGCYVMCLTDNSFKNLPVGALVDKLIAEWKTHATSATTDANGLVELDLAHGDYKLTVNHPSSLAASHTITVDAASSEHTISLKV

SEQ ID NO: 107642 - protein, 190 aa, Triticum aestivum
  Clone ID: PAT_TA_2060.pep
GRVRPPRPVSPPSPKSKREIPQKATPFPSPSRGTGAAAVPAPARCRTRSRPSSAPRRPRRRAPAPGRGPASPPPSTRPASAWRRSPGRAPRSASASGPCSASGRSPPPPRPPTTAATTTARSSTRRPPSRCASAPGSSGGAAGPSASMCTTAGSTSPTSPARGSPPPARPSRRTATSPSWSTARWRSWTW

SEQ ID NO: 107643 - protein, 238 aa, Triticum aestivum
  unsure (1)..(238): unsure at all Xaa locations
  Clone ID: PAT_TA_2061.pep
WDTRYKXIAVEAAKGLCYLHHDCSPPILHRDVKSNNILLDSDFEAHVADFGLAKFLQDSGTSECMSAIAGSYGYIAPEYAYTLKVDEKSDVYSFGVVLLELITGKKPVGEFGDGVDIVHWIKMMTGSKREQVIKIMDPRLSTVPVHEVMHVFYVALLCVEEQSVQRPTMREVVQILSELPKPTTKHGEEQLTGSGDGDESGPVGPPETVEPATDEAKEQHQQQQPSSPSSLPPNLISI

SEQ ID NO: 107644 - protein, 131 aa, Triticum aestivum
  unsure (1)..(131): unsure at all Xaa locations
  Clone ID: PAT_TA_2062.pep
MATGSRAPRRRRPRSPPTLMDDLVREIFLRVPVDDPMTLVRVAAGCKTWRSMLSAPDFAREYRKARAAPVLGFLHNTTSEPEDRFDSSHFVSTGALRFRPPAHQDLLSRWDDLDSRHXLALXHAPKSKRNK

SEQ ID NO: 107645 - protein, 67 aa, Triticum aestivum
  Clone ID: PAT_TA_2063.pep
RVQPPSFSNPDRKAKSDGVSSTIWETSLKKIMAEEAQDSQLNTLFFSNMTKLISLMFDFSIALKNRS

SEQ ID NO: 107646 - protein, 265 aa, Triticum aestivum
  Clone ID: PAT_TA_2064.pep
MASITLLSLAPAATFLHLPASTASSSPHFAAIPRSLAGRRALLLRARAPRRVTVVCSAAAAAEASEAEPAEKFRLDNLSPQKGARRKPKRKGRGISAGQGASCGFGMRGQKSRSGPGVRRGFEGGQMPLYRRLPKLRGIAGGMHIGLPKYVPFNLRDIVQGGFKDGDEISLESLKSRGLINPSGRERKLPLKILGDGDLSVKLNIKAGAFSSAAKEKLKAAGCTLTVLPKRKKWLPAAYVKNQARAEEYFSKKKGGAVESDEATT

SEQ ID NO: 107647 - protein, 86 aa, Triticum aestivum
  unsure (1)..(86): unsure at all Xaa locations
  Clone ID: PAT_TA_2065.pep
LRMVKHAERPRGRARGSLRCLVGRDGRIDFHRVRXDSTRDVENFWNPXDCSHLLXHPTHAXXHRHSRLLTIKXSVXTGXAQMXKER

SEQ ID NO: 107648 - protein, 88 aa, Triticum aestivum
  Clone ID: PAT_TA_2066.pep
MSSGSSSRSTSPSSDSEWSKKENKMFEEALAYYGVSAPNLWEKVASAMGGTKSADEVRRHFQILVDDVNSIEHGRIPFPNYKTQGFWT

SEQ ID NO: 107649 - protein, 247 aa, Triticum aestivum
  unsure (1)..(247): unsure at all Xaa locations
  Clone ID: PAT_TA_2067.pep
MGHDHITHIEKLTADGSVADRKCCQEPGCDEIVSGRVMYCNSHTRGHSSQQLGYLQSSQKTSDLYMPPVKGRQCTEPSASAEQDVSIKYEGNDQGKLNDRSGDTQGNTGQLILGGPDTLCKHDNCKKQAQSNALYCKLHSGGSKGCLVRGCVKAAHGGTPLCIGHGGGKRCIVAGCPNAACGQGRSEHCVRHGGGKRCKFEGCVKGAQGNTDFCIRHGGGRRCKSEGCTKSAQGPTDFLNXHGGGTR

SEQ ID NO: 107650 - protein, 127 aa, Triticum aestivum
  Clone ID: PAT_TA_2068.pep
GRVGGRVGGRVGANYGYSPNYVTDLSYNAQKLGQAAAAAPGAGGSYMQPQGHFSYPAAAAHGGMLAPNGMMPVYPYYHYHYHGSQGLGVPAAHFFPPVSAAVPTVPAIISKPTVMVPPKVEQVAGCS

SEQ ID NO: 107651 - protein, 359 aa, Triticum aestivum
  Clone ID: PAT_TA_2069.pep
MSVVRGAAMEGAWPHPAPMEPTTAADGPQVSEVNSFRRQVDDLLSKTDVLEKRVNEVVGFYNSKKHSSGGRKAGGRYAENGARDSHGNGMPDLMRQFAGIIRQITSHEWAQPFLQPVDVVGLQLDDYHQIITKPMDFSTIRNKMEGKESTTYNSVREIYSDVRLVFTNAMKYNVEGHPVNIMAKFLLERFEEKWLHLLPKVENEEREREEPNDAPTISISPEAAIAKLAEDTGNELNEINKQLEELQKMVVQRCRKMTTDEKRKLGAGLCQLSPEDLNKALELVAQDNPSFQTTAEEVDLDMDAQSETTLWRLKFFVREALEQQANVGVVACGKTDENTKRSRDMYNALAKTVSKRIKR

SEQ ID NO: 107652 - protein, 118 aa, Triticum aestivum
  unsure (1)..(118): unsure at all Xaa locations
  Clone ID: PAT_TA_2070.pep
MKEYWTMLASLMGALAFLQGVLHAVFPAELRAALARLLGRLTRAFSPYCYFDVTETDGMSNNEIYDAVQLYLSSTAAPASGARLSLTRPHNATXFTFGLAASDRVVDAFRGAAVTWEH

SEQ ID NO: 107653 - protein, 181 aa, Triticum aestivum
  Clone ID: PAT_TA_2071.pep
MTSYFRGQRQEPSSDDPRPGYRRDRGGRKRLTAQKRKEIKEAFDLFDTDGSGTIDARELNVAMRALGFEMTPEQIQQMIAEVDKDGSGTIDLDEFIHMMTDKMGERDARDELHKAFRIIDQDANGKISDMDIQRLAIEAGEHFTLDEVREMIQAADENGDGEVDMEEFMKMMKRTGFGAGF

SEQ ID NO: 107654 - protein, 604 aa, Triticum aestivum
  unsure (1)..(604): unsure at all Xaa locations
  Clone ID: PAT_TA_2072.pep
EGLSSPTRXGDALYNLRQSLKDSNNVLQSWDPTLVNPCTWFHVTCNNDNSVIRVDLGNAQLSGVLVSQLGQLKNLQYLELYSNNISGPIPAELGNLTSLVSLDLYLNKFTGVIPDSLGNLLKLRFLRLNNNSMSGQIPKSLTDITTLQVLDLSNNNLSGAVPSTGSFSLFTPISFANNPLLCGPGTTKPCPGDPPFSPPPPYNPPTPPTQSAGASSTGAIAGGVAAGAALVFAVPAIAFAMWRRRKPEEHFFDVPAEEDPEVHLGQLKKFSLRELQVASDNFNNKNILGRGGFGKVYKGRLADGTLVAVKRLKEERTPGGELQFQTEVEMISMAVHRNLLRLRGFCMTPTERLLVYPYMANGSGASRLRERQPSEPPLDWDTRRRIALGSARGLSYLHDHCDPKIIHRDVKAANILLDEDFEAVVGDFGLAKLMDYKDTHVTTAVRGTIGHIAPEYLSTGKSSEKTDVFGYGITLLELITGQRAFDLARLANDDDVMLLDWVKGLLKEKKVEMLVDPDLQSNYEETEVESLIQVALLCTQGSPVERPKMSEVVRMLEGDGLAERWEEWQKVEVVRQEAELAPLRNDWIVDSTYNLRAVELSGPR

SEQ ID NO: 107655 - protein, 90 aa, Triticum aestivum
  Clone ID: PAT_TA_2073.pep
STMVILKRNTRVVCLAVLVVMATTLLPFSTTQGACLVAPECSGPYPNVICGELCARYGYSKNGYCKDSRNCCCSGKNLKESVQVDPTANP

SEQ ID NO: 107656 - protein, 65 aa, Triticum aestivum
  Clone ID: PAT_TA_2074.pep
QTKRGGTMRRRAHGEVPPQVDLAVGGKKATPPLHPVRSPSSGSNALFPLLRDQIKLHRYAMPEPI

SEQ ID NO: 107657 - protein, 119 aa, Triticum aestivum
  Clone ID: PAT_TA_2075.pep
MSMADEQNDAGPPGAPHLLLLAVVVGLLVAWPLFLGGSREAVIDTIAKAIAELLGPVGLLLLPLGLLLLIHLLSCDGGSPDAVYHVGGSPIGVALMLVLILALLYYRSALFGSGGGDDK

SEQ ID NO: 107658 - protein, 110 aa, Triticum aestivum
  Clone ID: PAT_TA_2076.pep
FFFFNHTVLDRDFLEARRMIDDMAQMIQRVQRVSTTSMLQFTMPRPPSHKKLQRMLQHYSAANSMLQFAMPKPPSRKILQKDIYRRMFRRSDQSSMPPQQNLMKRQLISY

SEQ ID NO: 107659 - protein, 296 aa, Triticum aestivum
  unsure (1)..(296): unsure at all Xaa locations
  Clone ID: PAT_TA_2077.pep
MGRPPCCDKEGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQAGGDAAAKPAAQRPASSSKGQWERRLQTDINMARRALREALTTLDDIKPQQPDAADGVNGPAAAGADSGSPAASSSSAASLSQCSPSAAGPYVLTTANISRMLDGWASKGRSAGAAADSPSGSSASXGFXTAAXAAARALGSAFEYDRKPAVLAPDQTQLNAIETWLFADDNSNNDHHG

SEQ ID NO: 107660 - protein, 86 aa, Triticum aestivum
  Clone ID: PAT_TA_2078.pep
MAFRGAASRSFLAAVRGRTASTAPRVRAAPIPAAPPRRIPASAPSSPLAAARPLAALMGSPALVAARLTGHCAASARACCELSQGT

SEQ ID NO: 107661 - protein, 138 aa, Triticum aestivum
  Clone ID: PAT_TA_2079.pep
NHFPRTGRLDHLLTGQQLSLASSCFRPRARHGYNTAYLMEANYACGLRQHRFSPVVPGALGFVRVVGDSLHRNVRPSAVSRALVRRAALAFPVSTLVVRFDRLGMYSSTFIWTFSQAVVQSFFLQGLLLARVQGATHN

SEQ ID NO: 107662 - protein, 249 aa, Triticum aestivum
  unsure (1)..(249): unsure at all Xaa locations
  Clone ID: PAT_TA_2080.pep
RPGARGTRRPAGRQVVPGFPPVYAVCPLKSTATEQEAAHGGASSPIAWLGEQPARSVXYVAFGNRNAAAXDQIREIGAGLEASGCRFLXVVKTTVVDRDDTAELKDVLGDGFLERVQGRGLVTKEWVDQEAVLRHPAVGLYLSHCGWNSVTESAAYGVPMLAWPTLGDQRLIAKVIKSGGFGLWVEHWSWDGGEDSLVRGAEIAEKVKEVMGDEAISARAKEISQEATKAVAEGGSSHRSMQEFLATLS

SEQ ID NO: 107663 - protein, 294 aa, Triticum aestivum
  unsure (1)..(294): unsure at all Xaa locations
  Clone ID: PAT_TA_2081.pep
CNTASVYRILACCRHSWIGLKLPIGVAKPAAAPLADLLDLSSDDAPVTSAASDYYSTXDFLQDLLGIGGTILSTAGAPSPASTDILMDLLSMGSSPSQNGLPSPGLSSPPLEKKPVSAVLHVGAHVPEPMDRLGRLTSTPPXRDQTPPWLHLKLSICSTVCPQVHPFLDLNAAYPSITAFQEANLESSSVICKQAAWPPATTLHATLALQICTSVTLTNFMFQAAVPKFIQLRLDPASSSTLPASGNGSITQSLSVTNNQHGQKPLAMRIRIXYKVNGEDXWEQGQISNFPAGL

SEQ ID NO: 107664 - protein, 212 aa, Triticum aestivum
  Clone ID: PAT_TA_2082.pep
MYVGESEKNVRDIFEKARSARPCVIFFDELDSLAPARGSSADSGGVMDRVVSQLLVEIDGLSDNSQDLFIIGATNRPDLLDSALLRPGRFDKLLYIGVNTEASYRERILKAQTRKYKLHENVSLLSIAQHCPPNFTGADIYALCADAWFHAAKRSVKTLEADPSRNNDAGAEEVIVETEDFMTVLGDISPSLSMEELQNYEQLRQKIEGPSR

SEQ ID NO: 107665 - protein, 167 aa, Triticum aestivum
  Clone ID: PAT_TA_2083.pep
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLL

SEQ ID NO: 107666 - protein, 571 aa, Triticum aestivum
  unsure (1)..(571): unsure at all Xaa locations
  Clone ID: PAT_TA_2084.pep
MLVLFETPAGFALFNLLDEGKLSSVEDLWKDFASSDKARKVVELXKAFNKFESTSDALFSXGTLLIDSKPSKGLRKFLQKHCDGEVLAVADSKLGNGIKXKLKFECLYNSAVMXELMRGLRSQLTELMSGLAEHDLWSNEPELVXSLSRYKXKFSPEKVDTMIIQAIGLLDDLDKELNTYAMRGGXRYGWDGPWLTKLALSKIHYTKAMKXYEAQSVKFTGTCLSXVHLDCNEIWTGQVEAALEAAAVISVGTEVNDLGLPVLALPGDRVLPLAELRARLYTFPPSWTAPVAPLVAARLISHGGARLVSRGAGWLHHAKQAGRTGHIQGSEKALCRALKTKHATPKYGLIYHASLIGQAAPKHKGKISRSLAAKSALAIRYDALADGDDNSMGLESRIKLETRLRVLEGNELGRSAGSTKGKPKIEAYEKDRKGGGALITPAKTYNSAADLVLGQTTEETPKKSEVASKKRKHQEEEPTAEAAEKEGEQEKEKSKKKKKKSKDIEETPAAVTDASEKKKKKKSKEAEETPAANTDGEKKKKKKKSDAEDAPMEVDVSAKKEKKKKKKHADE

SEQ ID NO: 107667 - protein, 333 aa, Triticum aestivum
  Clone ID: PAT_TA_2085.pep
ASDNNLQQEEDAAFNIKYLTSSKLMGLELKDASFRRHILVQCLIFFDYLKAPGKSDKEGPSESMKEEIKSCEERVKNLLEMIPPKGKEFLQSIEHILEREKNWVWWKRDGCPAFEKQPFEKKSGQAGARKRKPRWRLGNKELAQLWKWAELNPRPVADSDRIRMPSVTEYWKPLAEDMDTSAGIEEEYHHKNNRVYCWKGLRFQARQDLEGFSRFCDYGIEGVVPPELLPPDVRAKFNSKPGEKAKRPKREDTKGTSAHPREPQVAAATPETDGGGSGGDQEEGAVPMDSDNGAGEDGQKRSPGEVSGPESGQCEAEDDGEDNTKSAHSRDRP

SEQ ID NO: 107668 - protein, 123 aa, Triticum aestivum
  Clone ID: PAT_TA_2086.pep
WYIMHDAFILCHEVSHELSREGLGGLHVHVAAGGAAATAVGAVAAAAAHEERRLVAGAVGEAERERDAAVLPGPGERERLVGAELPVRPRREQRVPAAGPVLVVLVVVVVARARRAHASAHAS

SEQ ID NO: 107669 - protein, 264 aa, Triticum aestivum
  Clone ID: PAT_TA_2087.pep
ADEDREEDDIQYSVAEMTRPGQRLIVAQGGEGGLGNASIGRDVRLSKGNRQEEVARLSTGQPGTESFLVLELKSIADVGLVGLPNAGKSTLLSALSRARPEIADYAFTTLRPNIGSLTYDDYLSVKVADIPGLIKGAHENRGLGHAFLRHIERTKVLSYVLDLAATLNGRKGIPPWEQLRDLVVELEHYQEGMTKRPSLIVANKIDEVGADEMYEELKRRVQGVPIFPVCAILQEGVPDLRVGLRDLMDASDPQGVDLSKVIVG

SEQ ID NO: 107670 - protein, 152 aa, Triticum aestivum
  Clone ID: PAT_TA_2088.pep
AEKIGNSKSSDKGGKSGICVKAGEKGNSNAAAAENLQDGKSEVDDTRKKEFSKDCEAEKIVQNANGDGGMEMLRDGEAETGNNCNGNTIGGSGEKDDTTDGRCEEGRAEKDAENAGDCEPEESETNEPEAEVKDVKSKEASGNEITLSHGAN

SEQ ID NO: 107671 - protein, 165 aa, Triticum aestivum
  unsure (1)..(165): unsure at all Xaa locations
  Clone ID: PAT_TA_2089.pep
GLRGPGRQSFPTSRGRKRRPVWTIGALPAAATRPFRLRSFLIRHPTRAPLVLAGPPGRGTLAMGPEQLREFXENQLSASACSNRTQVPACNMKLKYAPYLELPGGIALQGATLVAIKPSTEGSNGGHISRKETDAFISGAFDGPFKFALKALMKRRTYLLEMNGF

SEQ ID NO: 107672 - protein, 140 aa, Triticum aestivum
  Clone ID: PAT_TA_2090.pep
FARCSPPVGALCLPPFHREIAPQAARVMQPTRFLLLFVLRPGGTLAAPLLMVPLRPLPFSTLRRRGGFCWVHLLGAVWCASEGCCRRPYWLLRLCRPCLSVHRHRDLQSAVAGVHLRRTPLLCAAGDAAPEPAARRGGGG

SEQ ID NO: 107673 - protein, 194 aa, Triticum aestivum
  Clone ID: PAT_TA_2091.pep
MEDRDHGPAENLPESPHRIVDADEEGDEDGGGFTFPVLPFAADALIVPVYPIFGRPPSPPPAASVDEQETATVRVPLGQLLLEERDFRARQRDEESFGDGELEGVAPESYCLWAPGQSTPASPRRCRKSGSTGSVLRWRRISERLVGRSHSDGKEKFVFLNATSGPPKQGDVEEGSSKSDGGGAADAHGWSYYS

SEQ ID NO: 107674 - protein, 170 aa, Triticum aestivum
  unsure (1)..(170): unsure at all Xaa locations
  Clone ID: PAT_TA_2092.pep
MGCCGGGAMSSSSSSRPRGGIREETLLRVPGAAVHLVAGSEGPLELGRGELSVVRIFKDDVAVTTVVRVGRDLGWPLARDEPVVKLDRLHYLFTLPDKDGGLLNYGVSFADAALLPSFDSLLKSNSCFSXPSAPSRGRGRRRRVVAQAYGTLPSSGNYTPKASGGHSRTQ

SEQ ID NO: 107675 - protein, 429 aa, Triticum aestivum
  unsure (1)..(429): unsure at all Xaa locations
  Clone ID: PAT_TA_2093.pep
MGANCCISAXQSPQPCIIPVEVSAYRNVRHSPSWSFRWDNRTHIEDIMEIPTFLSNHSSGSIRPETKSGSIAPTEGFSNGXGSPSELFHKVKWQKSEKKMETSKVAQSDPRDRPTASNSSPEAKLCRKSLDMVSVASDTKASTSVPSTPPVVSRADPSSSRGHSLGMDTDSMRKARRSPGYQLYRQVSDSKIPSLRSLNESNSPEGRPSSSMLSVCSNDLSVAGSHGESSDGWSMRTFSEMVASSQRERWSIDSELLGSVSSKMTRSNASNHTTVSPDQEVCKLCLKLLKERPAWNAQDLGVVAVLLCGHVYHADCLDSLTAEAEKYDPPCPVCTHGEQCTVKLFGKLESKIKNKMPTNVILDGDLDGSSKHQKKSKRVPRLGTSISMKDSFSRPFLRRHFSIGSRSPRLVSESESTRKKGFWARHWRE

SEQ ID NO: 107676 - protein, 153 aa, Triticum aestivum
  Clone ID: PAT_TA_2094.pep
MRQRGNNPGRRKMVISATARRTESSIRLSEALARMRFSEVVGGRDVIEAFRLLEVAMQQSATDHATGTIDMDLIMTGVSASERQRRDNLVAAIRDLVMEKMQLGGPLMRMAELLEEMRKQSSMEVHQHDLRVALGTLQSEGSVFVHGDSFKRT

SEQ ID NO: 107677 - protein, 155 aa, Triticum aestivum
  unsure (1)..(155): unsure at all Xaa locations
  Clone ID: PAT_TA_2095.pep
AKRRSRSRRFHPTPPRMLAHHPIPNPQPTPSQSAAPTPVIPKIKTIPGPASPRRRPLLARRRCTCGRRSGSGTRSSTPTWRSWSSTSPTRSARRGRGKGGRARTGTXKQAPLLEGRSSSMVATAXELACDAAMLLSCCLLLLLLXXFXWXGRPFX

SEQ ID NO: 107678 - protein, 71 aa, Triticum aestivum
  Clone ID: PAT_TA_2096.pep
VAGAVEQGDGCDSPSAGGGMVAAACPRCFLYVLIARSDPRCPRCESHVPPPPAPAPKKKPRIDLNVGFLGT

SEQ ID NO: 107679 - protein, 161 aa, Triticum aestivum
  unsure (1)..(161): unsure at all Xaa locations
  Clone ID: PAT_TA_2097.pep
MRGAEPGPPRGDHENGEGGGEAGGGGEASGYRGGGGVGGGPAGRSAISSSSGYGYGADYRSAAAAYYGSAGYGAYGRGYGAYGGNPAYGSGFGSAYGGSIYGGPYGAYGAFGGAYGGGAYGAPGGYGAGAGGYGGLRGSLKXGGGGSASGLGSGRYHPYGK

SEQ ID NO: 107680 - protein, 402 aa, Triticum aestivum
  unsure (1)..(402): unsure at all Xaa locations
  Clone ID: PAT_TA_2098.pep
MMKNMKTDNLKKLKNIGTRGTVSEVIDEDERKSDKDAFRTTSEVMDDKSDTWGQNVNLPGFEEDQSSAAKNHITEIAVSEDEGLSDDEGYSVNGILAKSRHRDGSIYRDMDLYDWKKHYRIADRIETRLEAMTLSDPAANCNVHDGICTRHFARSMLQIYSLELAKIPVDGLVELYGYVAVRDDLDPLLNYVVNISRDDPVIVEQGSLINMIGPQARDRYGRSCSYXEYDMKIKSGEQEKNDLQLIDGASFIGPLGPWDQPCTFHIAGDCGSVDITLSPLLKAVEATVEVLILEVKSSFSLSVGCLASGFNEEIQLFDGTIADSQGLKRSVVAVMKNSSIDLKFKVGALSSSSDQHCCSFKAKMHGHDIEEIKTDFALILVKVIWSTLPRGFSAMCDGLARD

SEQ ID NO: 107681 - protein, 153 aa, Triticum aestivum
  Clone ID: PAT_TA_2099.pep
QRFASRCMVYGPITAHSLYYLYAPVSPDLNPNISSSGGGGGGGGERRRVPWRSAVWVLGSLESRRGVFSPAPMLPRAALTSPSPASALTCPTPLVSCVPRASATTLRKGSPTPSRHPHWSWWWCMKTQISRVSMRRACLRLPGTKSLFCTRCT

SEQ ID NO: 107682 - protein, 96 aa, Triticum aestivum
  Clone ID: PAT_TA_2100.pep
LTEILAGAGDEPTGATQGAYKVRKVGSSKVHGVLNLSYKLGGVIHPPAGQYQQAGATGYLAAAAAPYASAPPPQQLSYPYPCPPPTMVRPLRVSSR

SEQ ID NO: 107683 - protein, 102 aa, Triticum aestivum
  Clone ID: PAT_TA_2101.pep
PTRPLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLIK

SEQ ID NO: 107684 - protein, 156 aa, Triticum aestivum
  Clone ID: PAT_TA_2102.pep
QVIQGTRASSYHLICAVPTLCVYSSSLPTVLAAVAYGAPAAGQMMRKKVLRPNSNLTRLGCAEGVVGLVGGRSRLRRDGLGVVEEGGGAEHGGDDGEQAEREHQRHPGHRQIQHQLRAVEHRPQRHPLPFPSLPRPLASPATRSCRRKPVAVPRPR

SEQ ID NO: 107685 - protein, 222 aa, Triticum aestivum
  unsure (1)..(222): unsure at all Xaa locations
  Clone ID: PAT_TA_2103.pep
RSSPPATRGPTQDPALPPCSPVLGACFVWYALLLSFGRHGAATVDHPRRLGARPASGRPPLQRPRAPPPRSVRPIALSAPEQPDPLPSPPTKSRLLPRPIDPPPGPXAARRASGLPFSASCAILRQPPYASTPLIPHEPAGPISSVNIHTSSSYSKRTQPHSFLSPPSLIPPICHSSSPAPITPPAPRAELQLHHGTTPPPDPPPRPPTKHRPFPFLRSWVE

SEQ ID NO: 107686 - protein, 138 aa, Triticum aestivum
  Clone ID: PAT_TA_2104.pep
RTGLDHDLFRFLHKSKWTHKSEFASFVIHHLPLQWHCYFLRLIDAAAPRSGIGIAVGLFRVVAKTFADAFARFPVSRRNRVLANRLRRAPAGWVDICVTGQEGGRHDQKSYNQEQNMCVVPWTCHGEWVLAIPLLLGS

SEQ ID NO: 107687 - protein, 141 aa, Triticum aestivum
  unsure (1)..(141): unsure at all Xaa locations
  Clone ID: PAT_TA_2105.pep
KVRQQSLERTTRTLIKAVRGWSSFPTNDTNLLEVATLFPAKIAADQYKAXILKYQVVTRPRSVYKTVPNCEPCRPLQRSPIEGFYLAXGDYTKQKYLAXSMEGAVLSGKFCAQSIXVQDSKMLSRRSQESLQSEAPVASKL

SEQ ID NO: 107688 - protein, 170 aa, Triticum aestivum
  unsure (1)..(170): unsure at all Xaa locations
  Clone ID: PAT_TA_2106.pep
TAYTSTGYPGRTYRFYTGDTVFAFGDGLSYTKMSHQLVSAPPSYVCMQLAEDHPCRAEECASVEAAGDHCEDLAFDVKLRVRNAGEVAGAHSVPLFSSPPSVHNAPGEAPARGFEKVXSWRPGEAGTVAFRVDVCRDLSVADELGGRKVALXGGHTLHVGDLKHTVELRV

SEQ ID NO: 107689 - protein, 184 aa, Triticum aestivum
  unsure (1)..(184): unsure at all Xaa locations
  Clone ID: PAT_TA_2107.pep
MAPPKKVLMLCGDYMEDYEAAVPFYALAGLGVAVHCAAPGKAPGDPCLTAVHDFLGYELYTELPGHRFRVTADFAXTAADPSSYDALVVPGGRFVEQLXVDAEAVALVKAFAGELPRPVVLTFHTHLLLPAAGAMGGVRVHRRSLPFAASWRRPGRPGPSPPPPAPLTPVRPPSPPSRGPPTGI

SEQ ID NO: 107690 - protein, 165 aa, Triticum aestivum
  Clone ID: PAT_TA_2108.pep
RFVFCKKNPATTATTGTYPLPASTDGQAPPARLPRHEFVGAGLRSWPWRAEASRRRAIRRPACSLGARRRGAPAPAEGQAWLGVAKSHEVVGAGLCAMLDELVLPPCAAQLQFSECLISCGDLDGIEDRVLLQHKSMSNEREPETVFLSDTKACTARHGLDLASI

SEQ ID NO: 107691 - protein, 346 aa, Triticum aestivum
  unsure (1)..(346): unsure at all Xaa locations
  Clone ID: PAT_TA_2109.pep
MAAASEEAIKQFSGLMEQLEEPLKTTFQNVHQGISKXTLLRFLKAREWNVPKAYKMLMDCLIWRLQNEIDSVLAKPILPADLYRSIRDTLLVVLTGYSKQGQPVYAVGVGLGTFEQSIGELXLQSHIQMNEYRDRVVLPGASXKCPGKQIITCLKVNDMTGLNLSAFNGMMEVCSASFIRELXNIMIKVMCGPGRNDYTEGYGLRVTPALLQEGRVRFRLVVGXSRLLLGMIMLSTKESFPYVKQQARYGTSATRHEVDCYSYDHPFHQELYNYVKQQALWNQDSAGPAKQGSMQRTVVPARSCRVGQDHGYYPVGAPQIQGQATAFPSSFSGIPIARCRISLIPS

SEQ ID NO: 107692 - protein, 180 aa, Triticum aestivum
  Clone ID: PAT_TA_2110.pep
RPSPLPRPFRVRPATPPRKPRLRAGRGDAEQGHRKRKGYCEMNEDCENCAFWRDHYYWDHMGDEKKQFSAVAKGDFKNSIRIPRELSTHLRSRISDTIKLSAPNGRAYDVVVTWEFGELVIRSGWDAFVTAHHIEENDTFLFIYHGNSNFEIHIFNSPGCEKMASCFQSPSVIFAFATPW

SEQ ID NO: 107693 - protein, 87 aa, Triticum aestivum
  Clone ID: PAT_TA_2111.pep
MEGFQWCWPGSLLLDAVFFLAAAAVSEANIGEFDEYWQRRQLEARARAEAAYHPNPIEVANSLNRAVHRAVREESGSRRKLLGLHKK

SEQ ID NO: 107694 - protein, 127 aa, Triticum aestivum
  unsure (1)..(127): unsure at all Xaa locations
  Clone ID: PAT_TA_2112.pep
MDDHLAVLARGEGWTEERHAAFLDGVERSFVQEVLRGRRRRQRGAASVAQALPPGAAARPPPRPAPPAPPPPPPWTAPLDPTRRGPCPRPXPATPNDLVGPSMVRSSFPFTQNINTLSTNTVYSLAT

SEQ ID NO: 107695 - protein, 347 aa, Triticum aestivum
  unsure (1)..(347): unsure at all Xaa locations
  Clone ID: PAT_TA_2113.pep
MPHAQKNSALQTPTSSRDRSELEQSNGRGRKHNACLSNGSVDNTLLSVQNSIANMGRGSGNQVAAVVSPLRSSSGHSSQAGQSSGMNLVWQHPLFPPLSRQEVPDARIGSCFQEAPSPPISGQSGYTPVASRSSRTAARAMDLEFPPLSSSNNRTAASTEQGVRKVAENTHAFGLRQQSNGIVNTHHSAQHWSLQNTDLIPSGSSHSPSWPTPNTSPHVSGSLSLTSAGNGRQNTXSRQVLCSVDDVRAANNSLVERMQAALGMDRDRYSMFKEISGEYRXGVINASKYLSYVEQFGLSHLVLEMTRXLPDPYKQKELADAYYANKRLTSLQGNDGGGIVCYKDCTR

SEQ ID NO: 107696 - protein, 444 aa, Triticum aestivum
  Clone ID: PAT_TA_2114.pep
FRKAFFNRITWTTATLPGPLSSFSVTPSFFSVPYSSIPFGATSVVNSIDRTPVAFLAKLFRYWRGSIEVTIKVVKTEFHTGRLILSFSPQLAQTTITNSNTNYVHREIVDLRDGSEFVIKVPYCYNSMYMDTDQAQNDLFMMMQVNVLNELVAPDTCAQSVEILYEVRGGVDMEFQVPVPFNVVPVQQIVPQSGGEGQAELVLDSCIGSSTVHDPSKMSAELCIGESCTSMLQLMKRYLRLATTNASWTANNSFAVYPYYYGAYFTSGVALSGTTGYITGDYVGLLASCYAHSRGALRYRWMNGQTTASGTITKIIPYDRLVVAPVSVTTKTTSQLLGQAPQITLSENAELSNQATTYDDVQSSGASSFIPMYNRTFCRLNRLFYTNNPGDALVSRAPDIAKFQLEIDSSSGNFGATSSLHRCASDDFHFSFWLGVPTMGWLQT

SEQ ID NO: 107697 - protein, 132 aa, Triticum aestivum
  Clone ID: PAT_TA_2115.pep
RTDQLQQRGVWATELKPGSPRRQPCVLPVHGPCGSFLPLLAWSRCHGRECVANVLEPADLSLYWGVDLPMPRVCPVYEQNMCGLGLVCELVSQSFISQTVVLFMCNLAVDKPSNEEDNLASLVQFAIFNRAR

SEQ ID NO: 107698 - protein, 168 aa, Triticum aestivum
  unsure (1)..(168): unsure at all Xaa locations
  Clone ID: PAT_TA_2116.pep
SAHASVIKEVGDGTFGSVWRAINKQNGEVVAVKKMKRKYYSFEECMSLREVKSLRRMNHPNIVKLKEVIRENDILYFIMEYMECNLYQLMKDRVKPFAESDVRNWCFQIFQALAYMHQRGYFHRDLKPENLVVSKDVLKLTDFGLARKIHXAPPFTKYVLTRLYPTPE

SEQ ID NO: 107699 - protein, 318 aa, Triticum aestivum
  Clone ID: PAT_TA_2117.pep
MATSAGGGQPSVLSTLPKNLPLDFLKTITDQFSDERKIGTGAFGTVYMGLMPDGQIITVKKLAENSPIAREKAFANEVQNIMALHHENVLKLVGYCHEGQKKVVLNNGRYIVADIVESLLCHEYLPLGSLQKHLFELHTKMDWNIRFNIIKGICNGLHFVHSIPIVHMDLKPENILLDDNMVPKIADFGLSRLFGQEQTRMNTQNVVGSYGYIAPEYLYRGEISTKSDIYSLGVLILETTTREENCRGNKPSAGQFIKKVRENWTEQHIVSEYPSLKADSLRQIKKCIEIGLQCVETDRQRRPSIEAIINQLNGRHSN

SEQ ID NO: 107700 - protein, 261 aa, Triticum aestivum
  Clone ID: PAT_TA_2118.pep
HSEADEILKICNVIGCPDEQTWPQGLSLAEAMKYQFPQIRGSQLSEVMKSASSEAVDLISSLCSWDPCKRPKAAEVLQHAFFKDCTYVPAAVRPKAAGPPKTPPGVGARGVSGHIARRYSTGALSTSKPAANISIKPSSLSKIGVQRKLQLDRQAPQKSTRPTESNTKQTTSRVPARNSPGNANPILRHSRSLPETGRATVQKVSSITEKLAHMSVTSRTRTAVKPPVPLLKAGHLKSDFLGKSDEIPPAKRLTRKLAKGV

SEQ ID NO: 107701 - protein, 400 aa, Triticum aestivum
  unsure (1)..(400): unsure at all Xaa locations
  Clone ID: PAT_TA_2119.pep
MVPVNRRGTQPRAGMEYFDARRKPHNIGKVFVALLFVALCIFVLKQSPGFGGNSVFSRHEPGVTHVLVTGGAGYIGSHASLQLLKDNYRVTIVDNLSRGNNGAXKVLQLLLQVPVILHLIDADLGHQKSVHKIXFSENAFDAAMNFATIGTADVXLMEPFFSPEVVSIISIPRLYISVLQEISPLYRYSGALCPYEPKTFXCVHACLFLTKESEETEIDDFRHHVIIEQYVCRLGIYLDSRPTLHIVQPSEKTLANVYVGSTLVFSALRKTFQDXEVKVIDNHTXDGTCIRDHIDATDXVNAHVKALNKAEPSIVSIYNVGTGRGRSVKEFVDACKQATGVDIKIEYLSRQAXRDYAEVFSDPTKINSELNWTAQHTDLKESLSVAWRWQKSHPRGDGAN

SEQ ID NO: 107702 - protein, 165 aa, Triticum aestivum
  unsure (1)..(165): unsure at all Xaa locations
  Clone ID: PAT_TA_2120.pep
MPALLLLLLLRLSMGGELVPCSSAGEGQFAFQGFAAANLTLDGLAAVMPNGLLALTNFTLQTKGHAFNPTPLRFLDVNGATNSTAVARSFSTSFVFXAIVSNYDGLSDQXLAFXGRPDQQLLNGDXRGXYLGLLRTPRTAAKRTKYWQELQNNETPFRRSKRKPL

SEQ ID NO: 107703 - protein, 354 aa, Triticum aestivum
  unsure (1)..(354): unsure at all Xaa locations
  Clone ID: PAT_TA_2121.pep
PPPPPHVRLSESAPSAGRGGGGGGCRGRRGRVDGQARRGPTPGPRRAAAAAEPPGPGAPPAVVPGKAFTPSRRGLVVXLAAAYCSLQLPSSSHNLPAILPDKTIXLVRTFSSGLDRLKQVLPRGYWLPRWFFPSCGKVSRTGSGARGSFLKFIILINSICXGILSFLIAVSLLLMFTGKKRCFLANATFWSLQWRPLAGLSWLLLKQLVPNISFHMCIFXKFMLXITANCQPFFVLCVSNYHGLHQRPDSFDFWXTVFSGMFINWHYLPRXWQKDDLTDHYSXPGMFPXAMRPPTVPVAHLFXDRMLFATSELSGTSPHPSQFSQRSDRDGSVAREISTERMAADDADDPEASA

SEQ ID NO: 107704 - protein, 93 aa, Triticum aestivum
  Clone ID: PAT_TA_2122.pep
CCIASSRLLCMGLFCSFFTPLSLYCFPLRVGSAASFTPSRPSFSTRALRSFPSFCIMLRASDGRRRGPPELAHVDRSNSEAKPGPFGQDHLVE

SEQ ID NO: 107705 - protein, 218 aa, Triticum aestivum
  unsure (1)..(218): unsure at all Xaa locations
  Clone ID: PAT_TA_2123.pep
MLQLCTGIDEKSVGSSFQLVFAPIDDFPDDAPLVSSGFRVIPLDMKTDVVSSGRTLDLASSLEVGSTAAQASGASPDDCNVRSVLTIAFQFPYELHLQDSVAAMARQHVRSIGSAGQSGASAPAPACPGTDATRPSPRALRAGAAASPGLCPAXPCPLAAAPPPQAHHPRAASSKPLLRDQQAILRPSFSAVPVFPGPGTCGPHASEPALVPLQDLTL

SEQ ID NO: 107706 - protein, 482 aa, Triticum aestivum
  unsure (1)..(482): unsure at all Xaa locations
  Clone ID: PAT_TA_2124.pep
VDPASEKKSKFSSIVLKLRGKGGGGRGQHVTGGKLREITEEAKAFAIGNKALAALFVHTPAGELQRQIRAWLAENFDFLSVTGGDVAGGTTGQLELLSTAIMDGWMAGLGTGPGGRTDALGQLLSEYSKRVYTSQLQHLKDKEFGTRENFDFLSVTGGDVAGGTTGQLELLSTAIMDGWMAGLGTAQPPSTDALGQLLSEYSKRVYTSQLQHLKDIAGTLATEEADDPVHVSKLRSALESVDHKRRKIMQQMRTDTALLTKEEGGSPIRNPPTAAEDARLASLISLDNILKQVKEVIKQSSTRRPRKSKKKALLESLDDLLAQMPSLLDIDHPCAQKQITDAHNAVESLQEDPDDPAPDPNSNSNTLGESEVSQWNVLQFNTGTTAPFIIKCGANSSCELVIKADQRVQEPKGGEVIRVVPRPSVLAEMGFEEMKXVFEQLPEAVSLLALARSADGTRARYSRLYRTLASKVPALKEIVAEM

SEQ ID NO: 107707 - protein, 68 aa, Triticum aestivum
  Clone ID: PAT_TA_2125.pep
HAFAAFCDGKCGVRCSKAGRHDDCLKYCGICCAECNCVPSGTAGNKDECPCYRDKTTGHGARTRPKCP

SEQ ID NO: 107708 - protein, 140 aa, Triticum aestivum
  unsure (1)..(140): unsure at all Xaa locations
  Clone ID: PAT_TA_2126.pep
APPPPPPRWPSSPSPPSSLPPPSSSSWLRLRRPPVRDERCAAAGAGRAAPRRADTRRAARLPEXPAAAAASKGAPSPGRPPATRTNAPTTTSRPPATPHPSRPPAPDTHPPPPSSHPPPSMASSHVLPGLDALLSIMLCV

SEQ ID NO: 107709 - protein, 43 aa, Triticum aestivum
  Clone ID: PAT_TA_2127.pep
QELFFFTNPTFTRLLFYYLPKLSFFILITLFFSLNTSPKISPT

SEQ ID NO: 107710 - protein, 51 aa, Triticum aestivum
  Clone ID: PAT_TA_2128.pep
DTIFVVTNLTLSTKLNRNKTSQTLTSYIGLERKSRFGFGLTALIRRVSFLD

SEQ ID NO: 107711 - protein, 61 aa, Triticum aestivum
  Clone ID: PAT_TA_2129.pep
FEKKKTEPCLDCSTRPHCHDLIPFPINLNLNLIFNYHVCIKFELMDTVKYLDFLIHFDHSF

SEQ ID NO: 107712 - protein, 201 aa, Triticum aestivum
  Clone ID: PAT_TA_2130.pep
CSKVFSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPNAKDVANMTPEERLATALRAALSTLKIVHSGDLFS

SEQ ID NO: 107713 - protein, 152 aa, Triticum aestivum
  Clone ID: PAT_TA_2131.pep
MRCAVLLLLVFAAARAAAVVTDGLLPNGNFELGPAKSELVNGTVVKGGKAIPKWETSGFVEYIESGHKQGDMLLVVPQGAYAVRLGNDASILQRIPVARGSYYAITFSAARTCAQAERLNVCVSPESGVLPMQTIYGRNGWDCYAWTLKVKL

SEQ ID NO: 107714 - protein, 370 aa, Triticum aestivum
  Clone ID: PAT_TA_2132.pep
MRCAVVLLLVFAAARAAAVVTDGLLPNGNFESGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVIHNPGVEEDPACGPLIDAVAIRTLYPPTLSKGNMLKNGGFEEGPYFLPNASWGVLVPPNIEDDHSPLPDWMIMSSKAVKYVDAAHFKVAEGARAVELVGGKESALVQEVRTVPGWAYPSPSATPPTADMGDSFAEAYAARFHSTVAVPYASNGPGGYKRAVVDFGAVRDRTRVVFQSAFYHMKADGTLCGPVIDDAKLVGLRKKPSARRLML

SEQ ID NO: 107715 - protein, 261 aa, Triticum aestivum
  unsure (1)..(261): unsure at all Xaa locations
  Clone ID: PAT_TA_2133.pep
APSATVVXKGLSQKTNEDDLYQILXRVIKDRPSGVSRGFAFIDFPTVEAARKMKEATGDNGLLIDGRQIFSEYSSKPTGGMSGDSFGQEHITRSTYGRRTISTQCDWICTICGCMNFARRTSCFQCNEPRTDDAPPADAASSIQPFGKRGSEIGPTHVLVLRGLDENADEEMLRYEFAKHAPIKDIRLVRDKFTHVSRGFAFVHFHSVEDATKALEATNGIRHEKNGQVLRVAYAKSTLGPASVASQSNSLAAAAIEAASF

SEQ ID NO: 107716 - protein, 98 aa, Triticum aestivum
  unsure (1)..(98): unsure at all Xaa locations
  Clone ID: PAT_TA_2134.pep
FCGVVLFCTLLVGLLLYSALMLVCCESAMFGECHHLPCILRACFLYTSKLKDFFPHFVXRHQATIGCLLAVMTSMCNLICPCTNLNKINKLNPFIKKK

SEQ ID NO: 107717 - protein, 431 aa, Triticum aestivum
  Clone ID: PAT_TA_2135.pep
TRPIDSEKDKVVTFRNRQYDLPAWSVSILPDCKNVVFNTAKVRSQTLMVDMVPETLQASKSDQWSIFTERIGIWDKNDFVRNEFVDHINTTKDSTDYLWHTTSFDVDRNYPATGNHPVLNIGSKGHAVHAFLNNMLIGSAYGNGSESSFSVHMPINLKAGKNEIALLSMTVGLKSAGPYYEWVGAGLTSVNISGMQNGTMDLSSINWGIQDWVNVDVPQGDDPVGLDMQSMGKGLVWLNGNAIGRYWPRTSPTDDRCTPSCDYRGKFSPNKCRAGCGKPTQRWYHVPRSWFHPSGNTLVVFEEQGGDPTKITFSRRVATSVCSFVSENYPSIDLESWDKSISDGNPVAAKVQLSCPKGKNISSVKFASFGDPSGTCRSYQQGSCHHPDSLSVVEKACLNINSCTVSLSDEGFGEDPCPGVTKTLAIEADCS

SEQ ID NO: 107718 - protein, 120 aa, Triticum aestivum
  Clone ID: PAT_TA_2136.pep
SSYISASSVSKPENFSVIHRQQSTHRPGHSCSVPIMARTAPSGRLSRTATSRTDRSIYRQVDGSLSPRPDGNAIAVSGQLVQGAGEWKKRQTAEQSSTATPRRLRLHPRTAHSTSRFAAF

SEQ ID NO: 107719 - protein, 176 aa, Triticum aestivum
  Clone ID: PAT_TA_2137.pep
MEDPPQPTKEAEPEEAKGGDSLAAPDADDAGGKKSKKKKKKGGFTVDDEDIDKLLAEIEDRPAAAEEPEPKAAKAEDTVPAAAAAAATSVDDAEGKKSKKKKKKSGRTAQEEEDLDKLLAELGEGPTPAPEKEKPSQALPSASAVKEDAETVEDGNAEQKAGEGEVESAAAKKKKK

SEQ ID NO: 107720 - protein, 177 aa, Triticum aestivum
  Clone ID: PAT_TA_2138.pep
METCPSVKNILLLDSEGKRVAVKYYTDDWPVLSAKLAFEKSVFVKTQKASSGAEAEIVMFDGQIVVYKFIQDLHFFVTGGDEDNELILASVLQGFADAIDIILRNNVDKRTALENLDLILLCLDEIVDGGIVLETEGSVIAEKVLAHGAEGATSIAEQTIVQALTTAREHFAKSLLM

SEQ ID NO: 107721 - protein, 335 aa, Triticum aestivum
  unsure (1)..(335): unsure at all Xaa locations
  Clone ID: PAT_TA_2139.pep
TTRPLNYLPEMEKTHKKKEKLLKKQQRXALLLNSYLTFDRFTSGRSHRERKRVTYTFDDYDRSINEALKAIKKSENPVQVVATTNRGVLVPTREASSNGTLAGPSPVCNGRRGESPLKSYSYQGSGGEEKAETLDRRSRQRKRSQRYTTDFVENVSDIDTNFDSDDDIMGEAVYDEEYLRSRKQPKASTSEYDGEFRSEDQAEYSLSSEDEEGIQRSKRLPSRSPQGTRLKSMDVIQTGIKRNKRSARPHMNHQRCSGKDSGLGKPGEPNALDPDASSDAPDSAKTSIKSQEQRLLHIVKMHAPGREESKVAGRRFLHLNEIAPVSGFGGAPVQS

SEQ ID NO: 107722 - protein, 57 aa, Triticum aestivum
  Clone ID: PAT_TA_2140.pep
GEWKRTVAKAPSKAPAVVEAPEPSASVDDATTSPPAATTVARVCQVRIRVKIWKWTF

SEQ ID NO: 107723 - protein, 200 aa, Triticum aestivum
  unsure (1)..(200): unsure at all Xaa locations
  Clone ID: PAT_TA_2141.pep
PPFPPPLLRSPTRASRAPHGPSEEGADGETAEQSGAAAEAVVPRLFAAKEESGKSFSDIAAQTGLTNVYVAQLLRRQAQLKPDMAPAFRAAVPALTDELVELMMRPPCRSYHPDIVPRASHIPDLNEAVMHFGEXSIKEIINXEDFGDGIMSAIDFYCSVDKXQGADGKDRVVVTFDGKYLPYTEQRSEHMMSRLNRNAS

SEQ ID NO: 107724 - protein, 167 aa, Triticum aestivum
  Clone ID: PAT_TA_2142.pep
VRSKHCPICKQCVEQFDHHCPWISNCVGKRNKWDFLVFLCMGIATTLLGAAVGFHRLWTEPIILSSSESWTHFMVTKHPGAVLFMFMDIFLLAGALILTVAQAVMIARNLTTNEAANQSRYTYLGGPDGRFRNPYNQGWQKNCAYFLVNGYNNDEEAAWPTLQQTVE

SEQ ID NO: 107725 - protein, 113 aa, Triticum aestivum
  unsure (1)..(113): unsure at all Xaa locations
  Clone ID: PAT_TA_2143.pep
FGLSRPFSRPGSLSLDALAVCGASALCSLRFPWFGFAXPALSTGLFVSLQALVRANVSIWWPYPFLDLTYPRAPVXYLVVALLHFPCYGLFALSPRGSRDLSWKAGSHIVTHT

SEQ ID NO: 107726 - protein, 400 aa, Triticum aestivum
  unsure (1)..(400): unsure at all Xaa locations
  Clone ID: PAT_TA_2144.pep
MGKAAKSSRKGKKAWRSNISTDDIDEFYEKQTRDAHAGAAAIPSLPSGSLFFVDKPASASTSSAANASDPAPKDVPVKRKIEKNREKVLHHESVLKRNPYIQTIPSSLMSKKDKKKFKKHAKKKELQESREEKSVPMEEDSAEKNLDIWGGDAKGAALPKKGMKRLKKNKSTTSVIPAVEVEPQGCSFNPPHEAHQDALALAVADEMRKIYTKELGPTPVPLTVLGQAVAEEDKFFLDAADDGDAAAGDVYAAEGDKDHDADALTGERKKKQXVREGLNKRARRKERLRTEADAKKLEVFSKQIDSLPNILEEIAKEDKEKEEKRIRLTVAKQERLKSAPRRLGRHKFEPAPVQVLLTEEISGSLRKLKGCCNLARDRYKSIEKRGMLAPNKKLSKRPRR

SEQ ID NO: 107727 - protein, 220 aa, Triticum aestivum
  Clone ID: PAT_TA_2145.pep
MYVYLILHMKPIKSALALAVAVEMRNIYTKELGPTPVPLTGLGTAGLDEERGFREKQMQGNWKFFREQIAAVPDGDQDADALTGERKEKPKRVTRVELNKRARRKERLRTEADAKKLEVLSKQIDSLPNILEEIAKEDKEKEEKRIRLTVAKQERLESAPRRLGRHKFEPAPVQVLLTEEISGSLRKLKGCCNLARDRYKSIEKRGMLAPNKKLSKRPRR

SEQ ID NO: 107728 - protein, 162 aa, Triticum aestivum
  Clone ID: PAT_TA_2146.pep
MSRERRVPLVLALAAAAVVGALAVAEAELQVGFYNATCPIAEGVVFAEMHAILHEDPTLAPSLLRMHYHDCFVQGCDGSIMLRSRRGTAERDPTPNPTMRGYDAIERIKARLETLCPLSRSAPGPFPTAPWRAVGRGGRPGFPVHSRRPDANVTVAEYAEND

SEQ ID NO: 107729 - protein, 216 aa, Triticum aestivum
  Clone ID: PAT_TA_2147.pep
MQPSDIILSFDADAWADAWAVPFRHGERIGFSYLVSQKYTGEKARVKVLRNSKIHEFNIKLSIHKKLIPAHIKGRPPSYYIVAGFVFMVVSVPYLRSEYGKDYEFDAPVKLLDKHLHAMAQSPDEQLVVVSQVLVADINIGYEELVNTQVRAFNGKPVNNLKQLATMVEDCNEEFLKFDMDYDQVVVLETKTARAATQDILTTHCIPSAMSDDLKA

SEQ ID NO: 107730 - protein, 131 aa, Triticum aestivum
  Clone ID: PAT_TA_2148.pep
MASLSLLVPPDRESVAYSYGMVLLEIMSGRFTASAGGLLEGWAASFLRGERQLRDVMDPDLSWNAPLHAETVNRLDGVIRSCTDREARRRPAMAEVARRLREITAMPPDAATPKVSPLWWAELEIISTEAT

SEQ ID NO: 107731 - protein, 332 aa, Triticum aestivum
  Clone ID: PAT_TA_2149.pep
MASHPPNSADGEDPAGNNAELPSLPFHVVTKPSQLPVEFLEPSAAKKLVIGFDCEGVDLCRHGALCIMQIAFPDAVYLVDAIEGGKELVEACKPALESNHVTKVIHDCKRDSEALYFQFGIKLHNVMDTQIAYSLIEEQEGKKRAYDVYISFVSLLADPRYCGMPYPEKEEVRTLLRQDPNFWKNRPLSEMMIRAATDDVRFLLNIHEKMMEKLSKVSSWRLAVRSELYCRCFCINDNQQADWPPLPTVPDDIEAEARVPEVDILSLLDVPPGKMGRVIGRKGSSIMAVKESCNVEIHIGGAKGPPDRVFIIGPVKEVRKAEAILRGRMLEF

SEQ ID NO: 107732 - protein, 169 aa, Triticum aestivum
  unsure (1)..(169): unsure at all Xaa locations
  Clone ID: PAT_TA_2150.pep
TPXSVLVYCLSWVVIFFILLVMKAVSVGRRKFSAEFQLVFRLLKGLIFIVFISTIVILIVIPHMTIQDIFVCILAFMPTGWGLLLVAQALRPAIMSVGLWGSIRALARGYEIIMGLLLFTPIAFLAWFPFVSEFQTRMLFNQAFSRGLQISRILGGHKKDRAALSKDDR

SEQ ID NO: 107733 - protein, 284 aa, Triticum aestivum
  unsure (1)..(284): unsure at all Xaa locations
  Clone ID: PAT_TA_2151.pep
MVPLLAIIASVVSSPCLIAAAPIFFLKETVPVRSDIHDIASLVSSFSLVAYGITIPFGMGAIPWAIMSVVLPVSIKSLAGSFATLANWLTSFGITMTANLLLSWSAGGTFACYTLVSSFTXLFIILWVPGRAKGXRTLEEIQWSFQVELKSVVFAVYMSGIILSKAGASSSFYLVRIAPDEGPIIQKKGKTLSSVYSCTDTVSDDSVKRACNCYALFSSRASVLPLLRDNAHAFFPSIQSCVYSCTTLVQTFSWLCKGGLCSDSHQIILRFCVYCTMVSRDFSK

SEQ ID NO: 107734 - protein, 97 aa, Triticum aestivum
  Clone ID: PAT_TA_2152.pep
MVLDSLSSPHRRSQNTFFLSSPKKPQSSRDDVGSWSALVERHRFLLTTLVVLAFLCTIYLYFAVTLGAPQACSGLTGDEMTVCQEKSALQHGKLKYR

SEQ ID NO: 107735 - protein, 237 aa, Triticum aestivum
  Clone ID: PAT_TA_2153.pep
CLCFALEGATVNFTYVKGHEDKDAEETLQALRDIKSRTGAGEPKALAGDLGYEENCRRVVEEVANAHGGRVDILVNNAAEQYVRPCITEISEQDLERVFRTNIFSYFLMAKFAVKHMGPGSSIINTTSVNAYKGNATLLDYTATKGAIVAFTRALSMQLAEKEIRVNGVAPGPIWTPLIPASFPEEKVKQFGSEVPMKRAGQPSEVAPSFVFLASEQDSSYISGQILHPNGGTIVNS

SEQ ID NO: 107736 - protein, 338 aa, Triticum aestivum
  unsure (1)..(338): unsure at all Xaa locations
  Clone ID: PAT_TA_2154.pep
MASQKFPPQQQDCQPGKEHAMDPRPETLIKNYKSANKLQGKVALVTGGDSGIGRAVCLCFALEGATVNFTYVKGHEDKDAEETLQALRDIKSRTGAGEPKALPGDLGYEENCRRVVEEVANAHGGRVDILVNNAAEQYVRPCITEXITEQDLERVFPHQTIFSYFFMAKFRSDAEYRPGASTTLXSTTGATAYARLRRNPLAYAATEGAIVALTRPLAVQLVENGXILATAPREGAYRTPLLGAYVAEEKVQRFGSAVPTTRPGRPNEVAPSFVFLPREHDSSDNSGQMLHHNRDTDGERWIWGREDRGERGGWVFRGVVVWYVWASSAGRVSSVGWW

SEQ ID NO: 107737 - protein, 146 aa, Triticum aestivum
  Clone ID: PAT_TA_2155.pep
MLSAAASAIPRLRWAAAPPGHASPRARWSLLRRRPLSSSPNVAPTAGPGPLEPPDLPRLAKSARISLSPQEAEEFAPKIQQVVDWFGQLQAVDLESIEPSLRADTAAGSSLREDKAEPFANRDAIIEALPSYDDPYIKVPNALTKE

SEQ ID NO: 107738 - protein, 59 aa, Triticum aestivum
  Clone ID: PAT_TA_2156.pep
MEVHGRHKPTREYVDRGCNGVKPHNNFGKVDPWTAWAYRPRTISLLLMGICFLMRCVCR

SEQ ID NO: 107739 - protein, 299 aa, Triticum aestivum
  Clone ID: PAT_TA_2157.pep
MSSSSAGAPDSVVADADALARKVAAIRAAGPAKLQVIADFDGTLTRYWYDGSRGQSSHGLLRQGNEEFDSKREALFEHYHPIEINPDIPVLEKAKLMEEWWGKTHGLLIEGGLTQEAIKKSVADAAIAFRDGVVELFEFLEARDIPVLVFSAGLADIIEEVFRQKLHRSFKNIKIVSNRMVFNEEGCLVAFKGKTIHVLNKNEHSLDMAAPVHDSLGDPNGSVDDYSLVKKRTNVLLLGDHIGDLGMSDGLNYENRIAAGFLNTNIEKSLKDYSEAFDIVYLNDASMRGVVELVSDLCP

SEQ ID NO: 107740 - protein, 123 aa, Triticum aestivum
  Clone ID: PAT_TA_2158.pep
NLTACFLKPQVLNRWGYYPLILIGSWAFGTINRIHDFIEPGHKIFWLSVLDVGTAALMGLFNSIAYGFNSSVRRAIHERLELFLPERLYRWLPSNFRPKNHLILHQQQQQRSEMVSLKTEDQQ

SEQ ID NO: 107741 - protein, 508 aa, Triticum aestivum
  Clone ID: PAT_TA_2159.pep
MGFISGVVMGLVVGVVIMAGWSRVMQRRSRKRVAKAADIKVLGSLGREDLKKLCGDNFPEWISFPQYEQVKWLNKHLSKLWPFVSQAATAVVKESVEPLLDDYRPPGIKSLKFNKFSLGNVSPKIEGIRIQNLQPGQIIMDIDFRWGGDPSIILAVDARVASLPIQLKDLQVFTVVRVVFQLSEEIPCISAVVVALLAEPEPKIQYTLKAVGGSLTAIPGLSDMIDDTVNSIVNDMLQWPHRLVVPLGVNVDTSELELKPEGKLSVTVVKATSLKNKELIGKSDPYVTLYVRPMFKVKTKVIDDNLNPEWNETFELIVEDKETQSVIFEVYDEDNLQQDKRLGVAKLAVNNIVPETPSEITLKLMQSVDSLKIKDYRDRGSLHLKVMYHPFTKEEQLEALESEKKAIEERKRLKEAGVIGSTMDALGGAASLVGSGVGFVGTGVAGGVGLVGSGLGAGAGLVGSGIGAVGSGLGKAGKFMGRTVTGHLGMSRKSGSSSTVPQPDQPSA

SEQ ID NO: 107742 - protein, 355 aa, Triticum aestivum
  Clone ID: PAT_TA_2160.pep
MAAKARSFNQININATSSSKFSFKLHLPPRSTSLHAKKSTPSLVRCAPTSTSTVFKDKDPFSLERYMASKAMTVNEALDRALPLGHPERLFESMRYSLFAGGKRVRPMLTLAACELVGGDEAAALPVAYAVEMVHTMSLIHDDLPCMDDDHLRRDRPTNHVVFGVSIALLAGDALLARAFEHVARGCTEHGMPANCALRAVAELASAVGTDGLVAGQVVDLASDGTDVDLATLEYIHVHKTARLLEAAAVCGAIVSGGADEEIEGIRRYARYVGLLFQVVDDVLDVTRASEQLGKTAGKDIATDKATYPKLMGMDGTLAYAAQLVASAEAELDRFDGTCTEPLRHLAHFIAYRQH

SEQ ID NO: 107743 - protein, 546 aa, Triticum aestivum
  Clone ID: PAT_TA_2161.pep
MGLDLGALALKYTGLAVSDHDSIVAINIFIALLCGCIVFGHLLEGNRWVNESTTALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 107744 - protein, 240 aa, Triticum aestivum
  Clone ID: PAT_TA_2162.pep
PRVRGRVGSSKNAWEDAVPLSRKTEASPADAQARHDDDDIDEDMDGEGDGAVYYLSKSGDVMVSSTQRSAARQYSSAVTCRSDGGEAVAYFLSHSGAVVACDLARRVFTELPRILPVHFEYSIDVVACDGRAYVVVLSEYLDTASLRLWEFSDGAWRHVAAMPPAMSHALYGKKADVNCVGHGGRVMVCVSSGDAGANGCFMCDVGSNAWEELPRCAGGDGEAMDFVAAFSFDPRMEAAV

SEQ ID NO: 107745 - protein, 197 aa, Triticum aestivum
  Clone ID: PAT_TA_2163.pep
MSSAAAAASSSASPVPPEDDVCSVCHDRFRIPCQANCSHWFCGECIIRVWNHGAAVQPCKCPICRRLINLLVPANVSDDQNDDPQLQRVLGEIQHYNHIFGGAPRSLTQRLQDLPFFIRRLFRELMDPQRTLPLVFRARMILMVILSGVYVLSPVDILPESVLGLFGFFDDFLILVIVFLHLAAVYRSLLLYRHGGH

SEQ ID NO: 107746 - protein, 114 aa, Triticum aestivum
  unsure (1)..(114): unsure at all Xaa locations
  Clone ID: PAT_TA_2164.pep
MTDEERHRRHLSASNVSQVCKGGVESVLHVLRDCPAQLGIWVRFVPRRRQQGFFSKSLFEWLYDNLCDRSSCEDIPWSTIFAVIIWWGWKXRCSNIFGENTKCRERVKFVKEWV

SEQ ID NO: 107747 - protein, 255 aa, Triticum aestivum
  unsure (1)..(255): unsure at all Xaa locations
  Clone ID: PAT_TA_2165.pep
MDVEDELQTAPAPADGGESSHALVSGDQLDVEAYAAQYSGRTRVGRLLFIAEKCGSEQMRLDALRLAYDWALKGEDTALHRDVSAKIAGRLGPRYAADQAWSDAVERRALLRKDKLDSELNVYRTNLIKESIRMGYNDLGDFHYAQGHLSDAFKSYIRTRDYCTTSKHVVQXMCLNVILVSIXAGGNFMHVSNLCHQRRSKPKTIWFYYCRQLXLLLGLTYMETNKFKXAAPNXRQTKDNYLEILHKCMVMPLAL

SEQ ID NO: 107748 - protein, 91 aa, Triticum aestivum
  Clone ID: PAT_TA_2166.pep
LKFSQCPINDMDSELTKSGCEFSPKPGRSSYILVKPGLVNRIILGVLPMAIGKAEWKSSCDTTQSFAVPTTTQTRTRPDTSRVRVAPMQCG

SEQ ID NO: 107749 - protein, 160 aa, Triticum aestivum
  Clone ID: PAT_TA_2167.pep
MSDSEEHQFESKADAGASKTYPQQAGTIRKNGYIVIKNRPCKVVEVSTSKTGKHGHAKCHFVAIDIFTGKKLEDIVPSSHNCDVPHVNRTEYQLIDISEDGFVSLLTDNGNTKDDLKLPTDETLLGQIKDGFAEGKDLVVSVMSAMGEEQINALKDIGPK

SEQ ID NO: 107750 - protein, 177 aa, Triticum aestivum
  Clone ID: PAT_TA_2168.pep
SFLGLLDRVLLPLWRRVTGHTPTPLQCVGAGQALTVLSMAASSLVERERTATVRAHGQEGDPAWVSPLSAMWLVLPFAVAGAGEALHFPAQVTLYYQEFPPSLKNTATGMMAMIVALGFYLSTALVNIVQRATTWLPDNMNASRLENLYWLLTLLVALNFGYFLTCAKLYRYQNIGK

SEQ ID NO: 107751 - protein, 286 aa, Triticum aestivum
  unsure (1)..(286): unsure at all Xaa locations
  Clone ID: PAT_TA_2169.pep
AGYLIRRTASVKSFHALDCRFVKDLTVPDGTRMAPSTPFRKIWCMLNNGNIVWPYGTHLAWVGGDQFARQSLVKLAIPEAGFPLNGEIDVCVDFVSPAKPGRYISYWRLTSPXLQKFGQQVWVLIASVVPSAPAADEPVQVPIAYTQAADELVQVPIAYHQAADEPVQVPIAYHQASSAEALGMPAGVAAPEAAPLPEPISVPEPLPAPTLVNSHVAPASIPLPDETINNNMEDKLLRELADMGFRQVDLNKEVLRQNEYDLQKSVDDLCGFHEWDPLLAELKELI

SEQ ID NO: 107752 - protein, 84 aa, Triticum aestivum
  Clone ID: PAT_TA_2170.pep
ASKKCCCCYSTRSILTSKRPDPNDELVDYVHHVAVAPWAPNANPVDMAWFVVPVLRSGDLSHSTIQFSPSSSALQSFAVTLQQV

SEQ ID NO: 107753 - protein, 82 aa, Triticum aestivum
  Clone ID: PAT_TA_2171.pep
EYLDLCRLYTKPKGLNPDYEDPVILSSKRKTVEDFCNQIHKDMAKQFKYALVWGSSVKHKPQKVGKEHELEDEDVVQIIKKI

SEQ ID NO: 107754 - protein, 369 aa, Triticum aestivum
  unsure (1)..(369): unsure at all Xaa locations
  Clone ID: PAT_TA_2172.pep
MATVMQKIKDIEDEMSKTQKNKATAHHLGLLKAKLAKLRREXLTPTTKGGGGAGEGFDVTNSIDARVGVVVVNSARXSTLWDKLTGTFYGILXYDCNTLICVRXPLTKRGNSLVISVVXGRGEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELDILXDKLPHYCPISAHLEWNLDGLLEMVWEYLDLCRLYTKPKGLNPDYEDPVILSSKRKTVEDFCNQIHKDMAKQFKYAXVWGSSVKHKPQRVGKEHELEDEDVVQIIKKI

SEQ ID NO: 107755 - protein, 221 aa, Triticum aestivum
  unsure (1)..(221): unsure at all Xaa locations
  Clone ID: PAT_TA_2173.pep
DMAFELPLSRYDNHNLIIHGYHDLLFEKHSWIALNTGSFLXFRNCQWSLDLLAAWAPMGPKGFIREEAGKILTAYLKGRPAFEADDQSALIHLLLSQKEKWMDKVYIENSYYLHGFWAGLVDKYEEMMENHHPGLGDERWPFVTHFVGCKPCGSYGDYPVDRCLKSMERAFNFADNQVLRLYGFAHKGLESPKIKRIRSQTTKPINDKEDLDVKAKMSTTS

SEQ ID NO: 107756 - protein, 263 aa, Triticum aestivum
  Clone ID: PAT_TA_2174.pep
SIHHRACVRTYVTTMSSSGARGVRREYGRTYVVRPKGRHLATIVWLHGIGDNGNSWSQVLGNLPLDNVKWICPTAPTRPVAAFGGFPCTAWFDVEETSVDGPDDVQGLDASAAHIANLLSSEPSDVRTRPGGFSMGAATALHSAACYGHGRFSNGVAYPITLSAIIGLSGWLPCSRTLRTKIESSQTAFRRAAALPIMLGHGRGDEVVTYRNGERSSEFLRNSGFSYLNFKAYNGLGHHTIPEEMDDVFKWLKARLGLDRSCG

SEQ ID NO: 107757 - protein, 167 aa, Triticum aestivum
  unsure (1)..(167): unsure at all Xaa locations
  Clone ID: PAT_TA_2175.pep
KLTPIIKGIINMAERKFQNLKSHDCHMIMMQLLPVALRGLLPENVRLAIVKLCAFLNAISQKVIDPEIIPRLRSDVVQCLVSFELVFPPSFFNIMTHVLVHQLTXIVILGPVFLHNMFPFERFMGVLKKYVRNRARPEGSISMGHQTEDVIGFCVDFIPGLKKIGLP

SEQ ID NO: 107758 - protein, 107 aa, Triticum aestivum
  unsure (1)..(107): unsure at all Xaa locations
  Clone ID: PAT_TA_2176.pep
KCKWVNLSGGGVQVDPQYGMTIVDLKNLGYTDEPFVLTNDVAQVIYVKDMSTRPRKRKDKEANTSYDEXKRHIVLSGKRDIVGVEDKTDMSEDYDPAVVCRLLHAGH

SEQ ID NO: 107759 - protein, 148 aa, Triticum aestivum
  unsure (1)..(148): unsure at all Xaa locations
  Clone ID: PAT_TA_2177.pep
AARSTIRVDGLEGKGTLGGHQIICMDGHSLTEAHYTVLQNSALVAPYMEEHKNFLQSKHPENSDDXITREQTRTFAGWLQKHALNDGDIQNDLYSLSQLPSSNIMTFKGXDMQINGNTFYTIAQDKKSTNQNSGVCFDATTNTGKETY

SEQ ID NO: 107760 - protein, 413 aa, Triticum aestivum
  Clone ID: PAT_TA_2178.pep
GQEGRVGRSQKVIDPEIIPRLRSDLVKCLVSFELVFPSSCFNIMTHVLVHRVDEIVILGPVFLHNMFPFERFMGVLKKYVRNRARPEGSISMGHQTEDVIGFCVDFIPGLKKIGLPKSRYEGRLTGKGTLGRDSIICRDGYSWSQAHYTVLQNSTLVTPYVDEHKNSLRSKHPEQCDDWITCEHIRTFSSWLETRLRGDNTVCDELYLLSRGPSSTVMIWKGYEINGNTFYTIDQDQKSTNQNSGVRFDAATKRGKDTYYGYIVDIWELDYGHDFKVPLFKCKWVNLSRGGVQVDPQYGMTTVDLKNLGYTDEPFVLANDVAQVIYVKDMSTKPRKRKDKEANTSYDEPKRHIVLSGKRDIVGVEGKTDMSEDYEKFHEIPPFKVKADPSILINDEDYPWLRRNKQMTQAKKK

SEQ ID NO: 107761 - protein, 177 aa, Triticum aestivum
  Clone ID: PAT_TA_2179.pep
GRVGGRRGVFRPFGDAVVDGIDFFIDQGAPDHYDELARRLSGYNRYYRGAPGVRLTATARCVYPDWHVQRALDTGLFERIHVRFYGEDRCSYNHVYKDGVMAQWSKWTARYPRSKVYIGLPAANVPGRNDKVGLPSMNYDLMPSVKQAVNYGGVMLWDRYYDKQTGYGRELYNGGIN

SEQ ID NO: 107762 - protein, 190 aa, Triticum aestivum
  unsure (1)..(190): unsure at all Xaa locations
  Clone ID: PAT_TA_2180.pep
KLLXXKSYTLVMGRPNSAKLANFPECEVFVYVSCAQTALLDSKEFLAPVITPFEAVLAFSRGREWTGEYLLDFKELISSEKPEVASKSEEARFSFIKGGYVEDDCPQENEEHSETSLALAELTEKALSTQNQNSDAVLYQGGAKSAIEYLKARSYRGMTGEYEGPAPDSVLIGRTGRAAGYSDEKTKSPQ

SEQ ID NO: 107763 - protein, 148 aa, Triticum aestivum
  Clone ID: PAT_TA_2181.pep
MSGDGQSGSARVHFVLVPMMAQGHTIPMTDMARLLAEHGAQVTFITTPVNASRLASFAAHVEEAGLAVRLVELHFPAAEFGLPDGCENVDMIQSKDLLSNFLEACTTLREPLKAHLHEQQQSPPSCIISDTMHWWTGDVARELGIPRL

SEQ ID NO: 107764 - protein, 201 aa, Triticum aestivum
  Clone ID: PAT_TA_2182.pep
AELAVARTCIPAPPNPRPREERAAVYHATRTPGPLRAHDPRPHPQHHPAGRQDPPAADQHQCRTSPGAAPLSPWLRRRPRVHVLERTGGCAGGLRRARWAPWDGWSASGYCFEGPVRVSLSLPFFYKPYLRIDKRAHTTSSAASGGIITTTRGGIGSTACSRGQTAGMSPTVTSRAAASVTFDQFAGTTPSKHRSYSALHP

SEQ ID NO: 107765 - protein, 180 aa, Triticum aestivum
  Clone ID: PAT_TA_2183.pep
DLGFSSLSPEPDYGEYGSDFGEEEECLPRQRKPPEVRNALREKRVAFRQKTGRHHAKVALRKYNRANNTKFELVEVPVIREFWEFGGGCIHYNFTAKQAEDHRHSADADNTKLFFSEVNSAFHGDKDVVLCCIVGEHDNGHCYGCEGFKPTVVHPSSQAYGGGSSTCIDFAGSDGSSESD

SEQ ID NO: 107766 - protein, 161 aa, Triticum aestivum
  Clone ID: PAT_TA_2184.pep
RQQQNCGGRRHRSPATDLDYILHRPTDRRAQDRPNLRFMGIRDLKEAHVVPSWISLFAEFLWTEEFSGALWMFLLDGGRVSHVEESTHMASGGQCRRVASSIPASRKQIDIYLELFCLWTYDQMDSEILFLFRTEGGSDSRCYFIFGEAVYPAKRNSSSGG

SEQ ID NO: 107767 - protein, 178 aa, Triticum aestivum
  Clone ID: PAT_TA_2185.pep
YSLPPLLSLSSSPSSPRHESKLGDWDSSASAPNPAEGWRAPAAAISICGSPHRWRRLPDPATGEQTPDHPSLPASLARTRFRHHPRRVWRRRLGVVVVAAHIPGRSEWEEKAAVEVLIYRHGRRSDLDEMTGAGFLTMLRPAPTQVIGVVVLFDSGSGRRWAASPSVPVCPDRCGLLA

SEQ ID NO: 107768 - protein, 193 aa, Triticum aestivum
  Clone ID: PAT_TA_2186.pep
DAWADAWVSVLPCIPIALRQLLVHNEAKDMVDFLVLLNQIICKFNSSASGILEDVFPTIASRMSVILSQDAFSTGPAGNTEEMRELQELQRTLYTFLHGMVTHDLSAVLLAPTCRQYLETIMQLLLFTSCSHKDILLRKACVQIFVKLIKDWCTTSKADDKLPGFRVFMIEKFATGCCLYSVLEKSFDLRDGN

SEQ ID NO: 107769 - protein, 238 aa, Triticum aestivum
  Clone ID: PAT_TA_2187.pep
GYRVATAAPGLGFPASVCPTVGVGGIISGGGIGLMMRKYGLSADNVLDASMVDADGNLLANKNAMGDDLFWAIRGGGGGNFGIVLAWKLRLVPVPPKVTFLKVAKSMDQGAVDAVTKWQTLAPVLPDDLSVRVVIQKSQANFQSLYLGNCSTAVATMRSRLPELGVTSADCKEMSWLQYTVYIYLGDAINSKPLEALLLNRSTTLGPFVKNKSDYVKKALTKETWKKIFLWPNGGGSG

SEQ ID NO: 107770 - protein, 173 aa, Triticum aestivum
  unsure (1)..(173): unsure at all Xaa locations
  Clone ID: PAT_TA_2188.pep
VVEGAIEEGLARSRAAIRRATSARPGTRASAGYGASGTSATLLPPRGAIYRNAMAFHRSYVEMERRMKIWTYXEGEPPLAHLGPGCRAPXIYSIEGQFLYEIEDPXPLRRRRPVEANVFLLPISVCNLVHYVYRLKPRYLAPLRRLVADYVHVVAERHPYWNRSGGPTTSSCR

SEQ ID NO: 107771 - protein, 129 aa, Triticum aestivum
  Clone ID: PAT_TA_2189.pep
MVCIGRLRALVLRAAAGAGAGRRRWARVLCGRAVDVGGTPRPRGHRWRGFRAVAGARTKMMLDSSDSDSGAPAGQLQLQRRAVAAGTHPQDGGYASAGWQREDGKLKCGYSSFRGKRATMEDFYDVKLT

SEQ ID NO: 107772 - protein, 173 aa, Triticum aestivum
  Clone ID: PAT_TA_2190.pep
LTRPENNAEKATAADGQAKKPEDPYAEKARALEVLFPSTEKVGKIGDANPVKDFEAMLAERSSSTWVQKAIEEMKKYTTNLVQNSLQGDYYEKALECFVALRKACIIEQEPEEYNQFVIKLYERLKKVNDVVKFFQLLSSKNVLLICKEEAPDSDVTEEMARSFFMKTEISSE

SEQ ID NO: 107773 - protein, 356 aa, Triticum aestivum
  unsure (1)..(356): unsure at all Xaa locations
  Clone ID: PAT_TA_2191.pep
DSADEETSEQAQTLVDCDDFDGKLSLSDEYSNEQEEEHRHRVQLEAEERKLEETLEYQRRIEEEAKQKHLAEQSRSTSSAPDIGANGYSTDVNSSVHQDNHQSAPNNFSPAYLEGIKFGDFRFPKVPSREKHSSSDFCAHALTSSNMDFTKPALKMNGVGKYAQNTKLSTNPLIQRSKSSTSQPHKKYIQGAVHNGDDSASSRQNGTTAPRWSSSGKVADFSSNSYQDGKQNELPPVLSSDGPWNANKAEXKLIRGQSHLQLYVSRMILTKGLKKTLEKQCTKALQXSNGKEVYGAGLKNAAGEYNCFLNVIIQSLWHLKRFRHEFLKTSSLHKHIEDPCAVCALYNIFVDLSKAS

SEQ ID NO: 107774 - protein, 343 aa, Triticum aestivum
  Clone ID: PAT_TA_2192.pep
MMDKYARLMQKLEMVNVELFKGMFQLFGIFYHHIYETFGYQDRSQSGKPLPDSQSFRLKAALSKITQDSDQWIKPQNSLYPSSSSLSIGSTIAQMDVMPTAPPSSMFTSYGLKERCAAAETVSLVARVLNRSRAHLHSVLSQNNTSVVEEFFGTLVDTVPDLAEHIHRTSARMLLHINGYPDKIANAKWEVKELGTDHNGYVDLLLGEFKHYKTRLDHGGISKELQHLLLDYGIESIAEVLVEGLSRVKRCTDEGRALMSLDLQVLINGLQHIVSSNVKPRLQIVETFVKAYYLPETEYVHWARSHPEYSKSQVVGLVNLVATMKGWKRKTRLETIEKIEAAA

SEQ ID NO: 107775 - protein, 621 aa, Triticum aestivum
  unsure (1)..(621): unsure at all Xaa locations
  Clone ID: PAT_TA_2193.pep
MVTVSKEGGGEVTGLESAVVEEPEEAANVDEGQEEAEEEEAEEDAMEEDATEVPGDGATPDDMNELSEEEHEESGHEGTHGNNNEGGVACQLSVHSEAQNGQLDSSLPTLGSVSVGNTKDLQVFLHGLPKDCAEKDITEVFSQFGEIESIKTIRKKNGIAFVRYMSTEAAKKALAEFKEGXEVTGGRVKVLASRGDNTLYLSNICKSWTKEQVRTSLRSIGIDGFDMSLPVDPETGGQNRGITFLKFASPDNAKAASQLLQPPVPLITIVGSVKESAQIPTESSQELAMLQVKTVYLEHVPLSWDKGKVKECCKAYGVILDVHTLKKSKTKTSFVEFSSRKSALACVEGINSANFGGEVKLAASLARPRREIQLDKKSAKGGVKVNSDATSKDTNNSIKKKNQNREVEVKKDSPHKLRKGDVSKLTSHVDAKVPQSSNPSKGKRKAGKTENTAVNERAPKRARKNRGVLTKPSNRTSHGGYARVPYAGESSGNIKRPVGPRYVTGNQSYPIAGASSRSKPNARDLEPHAGYIPPTNRVRAPANHVPVTYVYDHPRSAPSTIHHIDGLPYAREIAAPPPAYGYTSNPQYQDGYAYAYLPPPHPSGSYHYPGTGAYSPRRRYY

SEQ ID NO: 107776 - protein, 164 aa, Triticum aestivum
  Clone ID: PAT_TA_2194.pep
MASRAIIRRRKRLFDNVNTHILSSSFSTFQHGAFGFKAQPRIAQQFLEQSLGDSKSDKEKEQYSVNLTKGGLLGLGNGFPQRPAHVISLHGYGIGRSNEFALPFGARGLLQSVRRASTATAGQPKLDIEEEQSEDQKQNKKKKEASPEECDQAVEGLSTAKAKA

SEQ ID NO: 107777 - protein, 255 aa, Triticum aestivum
  Clone ID: PAT_TA_2195.pep
MATPPRHGCMLRAEVVMCIFLVIAPLSTAIGVNYGTKGDNLPSPAKVAAFLVTRTNIDRVKLFDTNPDIVRAFAGTGISVMVTAGNGDIPGLATQTGADSWVATNIAPYYPATDISLVAVGNEIMDTADKNLIGKLVPAMQMLKDALVTAGYNKIRVSTPSSLSILVDSQPPSAARFRDVWDDAIFTPMLQFLRQTKSPLIVNMYPYFGYNGDTLPYALARPNPGVLDAGSGITYTSMLEAQLDSVYSAMKKLGF

SEQ ID NO: 107778 - protein, 388 aa, Triticum aestivum
  unsure (1)..(388): unsure at all Xaa locations
  Clone ID: PAT_TA_2196.pep
GDIGRTXXIRYGPRPIDLDILLYGDSRISTETLTVPHERIRERQFVLAPLVDLLGSSADDPMEKSWHSLSKCSGGFFDVWNELGGESLIGTQGIKRVMAVGNRLLDWSERTLVMGVLNLTPDSFSDGGKFQEVEAAVAQAKLLISQGADIIDIGAQSTRPSATRLSANEELERLVPVLDAITKIPEMEGKLISVDTFYGQVAAEAVKRGATMINDVSGGQLDPSILEVVAELGVPYVTMHMRGDPSTMQSEQNLQYDDVCKEVASELYARLREAELSGIPLWRIVLDPGIGFSKKSKHNLEIINGLGSIRKEMGKVSLGASHVPILLGLSRKRFLGEICNRADPVERDAATVAANAAGIMNGANILRVHNVRCGVDTAKVSDALRMVK

SEQ ID NO: 107779 - protein, 177 aa, Triticum aestivum
  Clone ID: PAT_TA_2197.pep
MFFHIVLERNMQLHPRHFGPHLRDKLVAKLMKDVEGTCSGRHGFVVAITGVEDIGKGLIREGTGFVTFPVKYQCVVFRPFKGEILEAVVTMVNKMGFFAEAGPVQIFVSNHLIPDDMEFQSGDVPNYTTSDGSVKIQKESEVRLKIIGTRVDATEIFCIGTIKDDFLGVISDPGGAL

SEQ ID NO: 107780 - protein, 183 aa, Triticum aestivum
  unsure (1)..(183): unsure at all Xaa locations
  Clone ID: PAT_TA_2198.pep
MEATTKNQETAAGDETARPAPPVLPWSVRLQLFALVTANDIAQRRDGTVNRFLFSFGDRQSPARPRPDAHGVRSADVTVDASRNLWARVYSPAAEAAGPAPLPVLVYFHGGGFTLLSAASTPIDGMCRRFCRELGAVVVSVNYRLAPEHRHPAAYDDCVDVLRYLGATGLPAXVSVPVDLSRC

SEQ ID NO: 107781 - protein, 154 aa, Triticum aestivum
  unsure (1)..(154): unsure at all Xaa locations
  Clone ID: PAT_TA_2199.pep
HARVSMAHASTGRNRFVAXRSSFHLIAETQRVMMEQLAFYQQSRQAAADPHRDLRLNIDEMSYEELLALEESIGTVNTGLADEKISGCVKEVVCCSSDEEQDEEDDGRCLVCLEEYKDNDLLGILKCRHDFHTDCIKKWLQVKNACPVCKSAAA

SEQ ID NO: 107782 - protein, 133 aa, Triticum aestivum
  Clone ID: PAT_TA_2200.pep
AVCHGKFPCQLPYRLNLRQRLRIKTSPMDIALLDQVWARCYLWHLFILRMILLLLFKHLQVYFFLMRNYRLSLLLGFGTREMKRELVATLTKAIDKILWSDMCAMCLDPFRICVILRIVVAALVEYASGKLAI

SEQ ID NO: 107783 - protein, 223 aa, Triticum aestivum
  Clone ID: PAT_TA_2201.pep
MRLNSGTDVLQSQQISSPAQSKSGSSVREDGGNYSNKPVKDEMLDVKLKLKQVELDMLKLRSKQAQINNGKQGALPSGPHSNLEEDADARTVLVTNVHFAATKEALSTHFMKCGTVLKLNMLTDAITGHPKGAAFVTFADKESIGRALSLSGTSFYSRVLTVMRKAEAPPGFLASIQQIGRPLPWNSPPFQKGVSPKQSSGHHLQWKREQSAMENSPANCPTD

SEQ ID NO: 107784 - protein, 76 aa, Triticum aestivum
  Clone ID: PAT_TA_2202.pep
GIHSILIIPQFALVSSNSLSCFLGILGHPLAIRVGSKWALVIIARRPVPSISARHQTAHFHIILLKLVELNGLYRR

SEQ ID NO: 107785 - protein, 202 aa, Triticum aestivum
  Clone ID: PAT_TA_2203.pep
SRKFKQHPILLQRKAQAVLSSVPRLRHHQTCCFISQHPAMTVGEARQSTPGSGGVPKVGITSSGAGSLIRSNLAALPASLSLHSFTRFHGRLACSACWRRWPVSLLRRPPCCLAPPDAPAVAPLPCLASPLDKSSSVSSPATSNPGRVRCSCNGTKVSTVVPVSQVVVGPYRLLFFVFRRVQLVYPRPIVGWVSSERDVKLR

SEQ ID NO: 107786 - protein, 66 aa, Triticum aestivum
  Clone ID: PAT_TA_2204.pep
PATEGLIYGVIVQIFWTRYVILQHHKLKSQRNQKKKKTEAKQQPEIPAASFLASLVAAPISLSASC

SEQ ID NO: 107787 - protein, 219 aa, Triticum aestivum
  unsure (1)..(219): unsure at all Xaa locations
  Clone ID: PAT_TA_2205.pep
MDDKYLRREDKSFLQDGRDTVASALTTLFLHLSKNPQVAAAIRAEAGGDKPSTYEHLKSLQYTHAVLYENMRLFPPVQFDSKFSAAADVLPDGTYVEGDSRVMYHPYAMGRMPSIWGADYKAFRPDRWLTGAGGSFAPPSLXKYPVFQAGLRVALGKELAVTDMKAVSVAVVRAFDVEVVGENGRSGWAPRFVAGLTASISGGLPVRIKRASTSGADFK

SEQ ID NO: 107788 - protein, 90 aa, Triticum aestivum
  Clone ID: PAT_TA_2206.pep
LGLTNPTHDAKVKELLVSVCNGAVETLVKTSHQVISKANSKLDNNANGNSNGSGTGSSRAGEGWVETVSSTLAVPSNRNFVLDVTGRGDI

SEQ ID NO: 107789 - protein, 103 aa, Triticum aestivum
  Clone ID: PAT_TA_2207.pep
NPLMKRNVKSPAITQISLCPLIVCKRMHLCRLPSIIFSTKEKKCCIYIALFFQAFGLTNDLCTTVHVLFKHVSLKSFEGINKYSKCINLSSLKSQCLPLAKKN

SEQ ID NO: 107790 - protein, 124 aa, Triticum aestivum
  Clone ID: PAT_TA_2208.pep
PSGRRWPPETGPTTGSTGSARSPAGPSPWPSTSSSSPSRRRTSSFRRWSERSSSSWGSSRPSVSCGPLDDRPLRPKLLSTVYDTSSVQVCLPRVFEGWLDLCVMGRVKNMRACTHVRLNVSFGQ

SEQ ID NO: 107791 - protein, 165 aa, Triticum aestivum
  Clone ID: PAT_TA_2209.pep
PAAACASACVGGLLVACRLGASPWRSGPRELAVARLALWVLRRPRPVRGLGAGEEVGAAAPKSIVVECFIWSRGRQRHQLRWSRGLGARRGSRSCGLPGEPPMCLWSVGSGRVDGGVVDSVWSAPSGPMCVSFFVVCKPEWRLRVVWWSGNSGCLGNRGVGSLGT

SEQ ID NO: 107792 - protein, 81 aa, Triticum aestivum
  Clone ID: PAT_TA_2210.pep
QVEPRAEPAQLRRRHAERRVVAHEERRALLLLLLHHVVRARKRTRRQKVAAAERERERERERERERERERERERERERERH

SEQ ID NO: 107793 - protein, 129 aa, Triticum aestivum
  Clone ID: PAT_TA_2211.pep
TQKRSDRRRRRRDEERQQRHHQQQLTAYCATSRDSTAEQATASADAAAPAAAPVTGAGAGGMLASISCADAAANSSAATATTTTAARDAIAAGMRDGEAGLAWLLRWSVNQRGGECGAGCLSPRAEFGT

SEQ ID NO: 107794 - protein, 175 aa, Triticum aestivum
  Clone ID: PAT_TA_2212.pep
MSTCKKARAESTSVVSSDRLSSLPPEIKGDILSRLNVEEAVRTSTLSSTWRDAWTNMPKIFLRDGNFAKPKFVTLVDMVLSLYNGTVEKFEISGSKTYHDEFGRWMLMLSRRSPRSVIIELNSGPGYKIPSCLFSIGDLELLHLQNCIISLPRVFQGFKRLTHLSLIKFLSTDLD

SEQ ID NO: 107795 - protein, 159 aa, Triticum aestivum
  Clone ID: PAT_TA_2213.pep
PSLIFGSLEFRETPPKEQTEKGKTHFSSLLKVPRNMLKSRDFQEHCVLSAIEVLSAHFFQWSYHVSFPEVATIPLILLKRLQEQTTIESLRRPLKRMIDQVSENRDFVQRKREVVSFSPNDASSVESFLQEEEMNGDASFTQFYASVAKSRQSRGRKLV

SEQ ID NO: 107796 - protein, 124 aa, Triticum aestivum
  Clone ID: PAT_TA_2214.pep
HPFHPPHFSYITCVIFGSSPQQHPSRSTQMPPTLKLGIPAAAAAAAVMVSTASAAARPPPAPASAAAAAARSLPQPPLSNAYFGYSLSEDFRRRVLLPSLCLFTVFAAVGTCSSYILCFFLFVV

SEQ ID NO: 107797 - protein, 196 aa, Triticum aestivum
  Clone ID: PAT_TA_2215.pep
GRPKVSASILGAATAAWALFEVAEYHFLTLACYAAMIAMLTFFIWTNASAFMNLPVPRIPETILSERTAKQVILGLHRRLTWFVHRLYAIACGEDIKKFIMTVVSLYIASVVATCFSSLTLLYLVVLCTMTVPALYERYEHEVDHLVATGARDVRTHFAKMDSGVLRKIPRGKGATTAAHGTTANNVHGWHRSHVN

SEQ ID NO: 107798 - protein, 145 aa, Triticum aestivum
  Clone ID: PAT_TA_2216.pep
HSSVSHKQNCRSIPSSMSSTSTSISVLSQGSGVAASAAGDMTDLESITHMLQWVVPFASPPAVEQLGRALWGLGSLTLVLALTTVLHQPAAGPVFAHYKAAYYTVLAFVLFVAVPVELGIAFCLPRCSHGRRIHHFARVLVPCAY

SEQ ID NO: 107799 - protein, 73 aa, Triticum aestivum
  Clone ID: PAT_TA_2217.pep
LGHELDVPAFRCGGAWSWKQERRQEDGSRRCVVSALLSCISPLSSYYRICVLFRTTILFNSRYHHVEVANSSL

SEQ ID NO: 107800 - protein, 206 aa, Triticum aestivum
  unsure (1)..(206): unsure at all Xaa locations
  Clone ID: PAT_TA_2218.pep
TREVPLAIFEKKIDALFINNNNFEFTLPANFSSSTASVIVLANLPRVGGCLPSSIGDMAGTLNELILLNSGISSCIPXEIGKLDKLTVLDLSSNGIVGKLPDTIGNMRALEQLNVANNMLAGEIPESICALPNLKNFTYSHNFFCGEPHRCLEVPHIDDRQNCIAGRPDQRPGEQCIEFLHRPPAQCAAHGQSSPPPMYAPPPPMY

SEQ ID NO: 107801 - protein, 100 aa, Triticum aestivum
  Clone ID: PAT_TA_2219.pep
KLHYITNSEKGSAASASWSWFPLILTVTFFNLLLASSVYCQLLGSSNAPCLWLAMLKPLNSAAKQERLLFTFVNPVLRDHLHASCPQVGKSISKRISFII

SEQ ID NO: 107802 - protein, 420 aa, Triticum aestivum
  unsure (1)..(420): unsure at all Xaa locations
  Clone ID: PAT_TA_2220.pep
IFSTPGVSAILFDALAKANINVRAIAQGCREYNTTVVLKHEDCVRALRAAHSRFFLSKTTLAIGVIGPGLIGATLLNQLRDQVAVLKENMNIDVRVIGITGASTMLLSDTGVDLTRWKEEMQKEAKPADLANFVRHLSEDHVFPNKVLVDCTADTNVASHYYDWLKKGIHVITPNKKANSGPLDRYLKLRTLQRASYTHYFYEATVGAGLPIISTLRGLLETGDKILRIEGIFSGTLSYIFNNFEGTRSFSDVVAEAKEAGYTEPDPRDDLSGTDVARKVIILARESGLRLELSXDIPVGSLVPEALKSCSSPNEFMQKLPSFDQDWARQRHEAEAAGEVLRYVGAVDVLNGKGRVELQRYKRDHPFAQLSGSDNIIAFTTSRYKEQPLIVRGPGAGAEVTAGGVFCDILRLASYLGAPS

SEQ ID NO: 107803 - protein, 70 aa, Triticum aestivum
  Clone ID: PAT_TA_2221.pep
LNTSKQRKHASNQYLVLQLLVSRVPPASMSVDRGGVRTYVLAPGRSCRINGGQSAYQCISQKNAAKLQYE

SEQ ID NO: 107804 - protein, 201 aa, Triticum aestivum
  Clone ID: PAT_TA_2222.pep
RAGLEYHFRMISCRAAEIEASKLGCEPGEALAVNLAFALSHVPDESVSPANPRDELLRRVRALGPQVVALVEQELNSNTAPLATRFSDAYLHYGAILDALDSTVSRDSADRARAEEAVANMSANAVGREGADRLERCEVFGKWRARFGMAGFRPVALAAGIADQVMARAGAPPPGLVVNPENGVLRLGWKQRVVTVASAWR

SEQ ID NO: 107805 - protein, 43 aa, Triticum aestivum
  Clone ID: PAT_TA_2223.pep
FMRPPTRPAACRCRSRAEQGRLTPRMLHAWRSHKSQLLCTPFL

SEQ ID NO: 107806 - protein, 109 aa, Triticum aestivum
  Clone ID: PAT_TA_2224.pep
MCGRRSSSCQMCRRSSSSHQRHHKGRMHSELHLRCGRTRNGSMWCVAIRHTQKAFPADCAVYSYIEIIKSFLISRVLAMVTGQVSNTVRPAQKHLVAWHPFSGSEFMRQ

SEQ ID NO: 107807 - protein, 156 aa, Triticum aestivum
  Clone ID: PAT_TA_2225.pep
MAGIRLTPEEPELPQGTPPRPQLPLPVAGSGVTAGGGGSGGLEMASDDERSVAADSWSVRSEYGSTLDDDQRYADAADVLAAAAAAGNFPSAASDYCSDKDDQDPNEEGSMLGLQSYWDASYSEDLPNFQEHRHAGEIWFGADVMDTVAIWTKKLC

SEQ ID NO: 107808 - protein, 110 aa, Triticum aestivum
  unsure (1)..(110): unsure at all Xaa locations
  Clone ID: PAT_TA_2226.pep
MPCCLQLPNVTEXPIAFSVKTHKXMYSPHPXXGIIPPCXKSYIXVXLRAQEEAPPNMXCXDTLIVQSTXVSEDFTSQEITQHFLEEAEVDEVILPIAYVAFEKSDLDVSK

SEQ ID NO: 107809 - protein, 191 aa, Triticum aestivum
  Clone ID: PAT_TA_2227.pep
PARGIDEIDSLCTSRGASGEHESSRRVKSELLVQIDGVNNSSTNEDGQPKIVMVLAATNFPWDIDEALRRRLEKRIYIPLPSFESRKSLISINLRTVEVATDVNIDEVARRTEGYSGDDLTNVCRDASMNGMRRKIAGKTRDEIKNMSKDDISKDPVAMCDFEEALVKVQKSVSPSDIERHEKWMAEFGSA

SEQ ID NO: 107810 - protein, 308 aa, Triticum aestivum
  Clone ID: PAT_TA_2228.pep
MEFFVAHASSPSAQQQLLEVISQMSLKCPQEDAKWWHKFYFRLEVLLHFKKSFPSEEVLNLEDMNVAESICKILRMFYRVIEVISCPSSVTANIYFNEVWKVRTVLQEEASNGNGEFSRMVMEMQETFHGYWQNSYLWLSIPVVLDPRFKIGFIEFRLKRAFGTNSESYLSDIRETVRELFNEYCNPTDLPSAASNSAALDADNDLLEDWDQHLNEQASCQISTELDDYLEEGLVPRKDEFDILNWWMNHTTKYPTLAAMAQDILAMPASAVQSEAAFSSSGPVIPKHYSTLNIKTIEALVCARDWMR

SEQ ID NO: 107811 - protein, 199 aa, Triticum aestivum
  unsure (1)..(199): unsure at all Xaa locations
  Clone ID: PAT_TA_2229.pep
MGPKPTLAATAASLLAVLAAVHLAVAATAVDDAPLPRLPQHDIPAVFAFGDSTLDTGNNNVLPTMVRADHAPYGREFPGGAPTGRFSDGKLLTDYLVEVLGIKELLPAYRSGAANLTGADLATGVCFASAGSXASNDATATNAGAATFGSXLADLKHSXAXXAAGRPEGEEVVSSCRREQRHDDNTHLSGETPAHNMEL

SEQ ID NO: 107812 - protein, 96 aa, Triticum aestivum
  Clone ID: PAT_TA_2230.pep
WQRSCRDGQHQAHQVACYIILPGWTWTLPSTAYHLGITAGAEWPPTQDITEIQQLAGNTKQAPHRRLPTRRWRERHHRKGSHISRTCAQPRGQHMY

SEQ ID NO: 107813 - protein, 37 aa, Triticum aestivum
  Clone ID: PAT_TA_2231.pep
PRVWRLDSLVEKSSDLSAASQMFYKQAKKTNSCCTIL

SEQ ID NO: 107814 - protein, 163 aa, Triticum aestivum
  Clone ID: PAT_TA_2232.pep
PLHHPAPHTTITISRTLPDYGIKVDWCLARPSPRCCCFSDVPADSLLAPDICCSIFSCLTAAPPPVNFSSATPLLPHRQSAAASSPSPSPVPFCLLPLLRLLLLPFSTSLPLLPSPLLLLSQPPPTASYPIPTLLLFPFLASVPLLKKTTCWCSLPVVDPVLL

SEQ ID NO: 107815 - protein, 150 aa, Triticum aestivum
  unsure (1)..(150): unsure at all Xaa locations
  Clone ID: PAT_TA_2233.pep
GANPASFGAPALQATXSSEMAPAGAYRQTHSQRRSSDDGYNWRKYGQKQVKGSENPRSYYKCTFPNCPTKKKVETSLEGQITEIVYKGTHNHAKPLNTRRGSGGGAAAAQVLQSGGDASENSFGGMVTTPENSSASFGDDENGVSSPRSG

SEQ ID NO: 107816 - protein, 206 aa, Triticum aestivum
  Clone ID: PAT_TA_2234.pep
MGGSREIMQLYPRSPHPVLAHVPNDFGNPSLCNYFLVESGGQVLLAVHHLTGQHCGVEPLQQNAYRLFALDIDRGELIPVNCLGGRALFLSRDRSLSVSARDLPSVSSNSIYFSLRRDPVVVHSIRTGFSERLAVSCQIHDGKDRIRPSVRPLTIADHLLTYCHPHEWTKGLMFHEYHSIPESFEELTKNIKAKNSELRIPRIAAR

SEQ ID NO: 107817 - protein, 70 aa, Triticum aestivum
  Clone ID: PAT_TA_2235.pep
VHAFSVADLPLTPAERFAALFRERPRWEWKDLQPFIRDLRVPGASSEGLLIKYARRTQPSADADPIFTAR

SEQ ID NO: 107818 - protein, 576 aa, Triticum aestivum
  Clone ID: PAT_TA_2236.pep
MRWTAFAWESASRAFNNRPTFTGLVVVLAASSGGGLVAYADSQPDQPQGFKKKKIVVLGTGWAGTTFLRNLDSKLYDVQVISPRNYFAFTPLLPSVTCGTVEPRSVVEPIRRILEKKGGDFKFWEAECFKIDPANKKIHCRSNMGTNLDGNGEFLVDYDYLVVAVGARSNTFNTPGVTENCHFLKEVEDAQKIRRSVMDCFEKASLPYLNEEERKKNLHFVVVGGGPTGVEFAAELHDFVTEDLSKLYPSIQHLVKISLIEAADHILTMFDKRITNFAEDKFGRDGIDVKTGYKVVKVSKDAITMQNPATGDIAVPYGMAVWHSPSGTRPKFVDFMKQIGQANRRVLATDEWLRVRECDDVYAVGDCATINQRRVMEDISEIFRVADKDKSGTLTVKEIQDILEDIYVRYPQVKLYMKSKQLNGIADLIRTGKGDTEKESVELSIEEFKKALSLVDSQVKNLPATAQVAAQQGQYLATCFNKMQAAEENPEGPIRIRGEGRHRFNPFRYRHLGQFAPLGGEQTAAQLPGDWVSIGHSSQWLWYSVYATKQISWRTRALVISDWGRRFIFGRDSSGI

SEQ ID NO: 107819 - protein, 124 aa, Triticum aestivum
  unsure (1)..(124): unsure at all Xaa locations
  Clone ID: PAT_TA_2237.pep
IQFLKCTSQLPLPSFQVCDKLFRHWRPKILSTDMVGPHMGMAGYQPRLFRALGCCVRSARWTRGWSRRPVVPDGEGXMSSLKGRLITVTACAXPLPLGRDPRXLTKNRAASVFKXXLXTVPRLA

SEQ ID NO: 107820 - protein, 94 aa, Triticum aestivum
  unsure (1)..(94): unsure at all Xaa locations
  Clone ID: PAT_TA_2238.pep
LSVLHAIKHQVSISMSPWKLRRAWTTWRASCPXGYIDHYPLITKRTMPAFISLKIDPHRCPRNTKFEPPFLPWSEKYRVPYFKGGSTHINFRVP

SEQ ID NO: 107821 - protein, 159 aa, Triticum aestivum
  unsure (1)..(159): unsure at all Xaa locations
  Clone ID: PAT_TA_2239.pep
MVNASLQKEPKETCSRPERAGAAAAEHRPERTGVGAARRRRGPTPASGGSVLAAMDEQEFRRMLDLFPVVRSRDYCKDEVESSSEGTTQQTRAQEXKETKKNAAEALFLRKLKMAAEKKVGATKAELFCKXTFEEAHEKLVYKELDLDAAQRFLNAYKS

SEQ ID NO: 107822 - protein, 120 aa, Triticum aestivum
  unsure (1)..(120): unsure at all Xaa locations
  Clone ID: PAT_TA_2240.pep
RRSSGNQVLLPHFNQMGPRAACVRSXANSARRWRVSLFGYFLPLTTAPTATLTNLGYHMLPSDPLSISFPSLQVPSLGRGAGRRLTLWWPPSPSPGPLVXAPSPLLSISVVGFRTSFCMF

SEQ ID NO: 107823 - protein, 134 aa, Triticum aestivum
  Clone ID: PAT_TA_2241.pep
GFPKKKVDAQAVTVGCPSNGRRASSISALPAPAAQTSAGGTACSLLPAAGSAAAQASPPHRTPIAGLAIPLLTHTCCYSPATADEPVNPRTVVLPSTWETTAESSLPPCRSFPRPHRRPPPWCSRRGLINMVND

SEQ ID NO: 107824 - protein, 625 aa, Triticum aestivum
  unsure (1)..(625): unsure at all Xaa locations
  Clone ID: PAT_TA_2242.pep
SSGRAPVGKLDTGFCNNNFQGQDWHTLTLNHMTAVEVYFGREKMDPPDNTQKLSAAVSTMIIEGIAQNTSGSIFEPEGGQAPEVTGSPTENAILHWGXLQLGIQFSFTXSKSSILQVFPFNSEKKRGGVAVQLGDSEVHVYWKGAAELILQSCTSWIGTDGSKQSMTPEKVGEFKKFIEDMAVASLRCVAFAYRPCEMSDVPKEDQRADWVLPEDNLIMLGIVGIKDPCRPGVQDSIRLCAAAGIKVRMVTGDNLQTARAIALECGILTDPNVSEPTIIEGKTFRELSDLEREEVADKISVMGRSSPNDKLLLVKALRNKGHVVAVTGDGTNDAPALHEADIGLSMGIQGTEVAKESSDIIILDDNFATLVRVVRWGRSVYANIQKFIQFQLTVNVAALIINVVSAVSSGDVPLNAVQLLWVNLIMDTLGALALATEPPNNHLMQRPPVGRREPLITNIMWRNLLIMAFYQVAILLTLTFKGLTLLRLEHDNPAHAEILKNTFIFNTFVLCQVFSEFNARKPDELNIFKGIAGNKLFIAIIAITVVLQVLIIEFLGKFTTTVRLSWQLWLVSIGLAFVSWPLALVGKLIPVPDRPFLDMFTCCCPGKKEADDGKEDSGVKNIEVV

SEQ ID NO: 107825 - protein, 80 aa, Triticum aestivum
  Clone ID: PAT_TA_2243.pep
PFFRPRVRPRVRPRVRDDDDDDGGDDDNDDGGDDDDDNGRSHSDHDCDSGSDCDGDDANSKGRKKKPSAPEKKGVLGGNR

SEQ ID NO: 107826 - protein, 96 aa, Triticum aestivum
  Clone ID: PAT_TA_2244.pep
PASSRRSSRPTTPTSPPRPPRRPPPPPPRTPPPTPPKDDHAPPPRPAAALPPRGWKLLPKGGQLWWRPGQRPGLLWWWWWQRRPWKGTWGRIQSCL

SEQ ID NO: 107827 - protein, 334 aa, Triticum aestivum
  unsure (1)..(334): unsure at all Xaa locations
  Clone ID: PAT_TA_2245.pep
MAAAVPIPAPAPAADDEIVYESMPCIRIYKDRVERYFGSEFVAASAHADAATGVASRDRVISPEVSARLYLPHIDPAKPDNAKLPVLVYYHGGGFCLGSAFNPTFHAYFNNLAALAGVLVVSVEYRLAPEHPVPAAYADSSDALAWVVSHAAPXAAAAGFEPWLADHADFARLYLGGXSAGANIAHHVAMRVGAEGLPHGAAIHGLLMIHPYFLGTDKVASDDLDPAARESLASLWRVMCPTTTGEDDPLINPFVDGAPGLDALACGRVLVCIGEGDVLRDRGRAYYDRLRASGWSGEADIWQAPGKGHTFHLLEPCCEEAVAQDKVIAEFLNH

SEQ ID NO: 107828 - protein, 181 aa, Triticum aestivum
  Clone ID: PAT_TA_2246.pep
FPPAHYTHMPAMGILTGWTASGADGDWRQGALWRSAAGRRHGEQGMAAAGSSSSILPLTSPPLCSRSTALSTSSKDGAAVASVRGLAAAAATEHGWVPARRAGHGGRGILFLHLAADLPSSALMLEDLVYGPAVAMAGERSPPPPRPLVRWRRGPRPRQQRGVNHLPAARALQGPFTQFVK

SEQ ID NO: 107829 - protein, 184 aa, Triticum aestivum
  Clone ID: PAT_TA_2247.pep
QQFPTYSYRSALPATQSHRLIAHHAAARPPPPRSPGQPPPLGFAAVSCRVRRRLHIRPALRLVLHGEAPPGRAGGVPHAPVLRRHRLREDCAGRSQGPPCRCHRSCSQVAAILSSRFYCKCAPVTVSRKLLLASAVENADFAGKRVRANSALPTGIRIRLLFLNCNLSIVMLSTTATNSSLYAY

SEQ ID NO: 107830 - protein, 91 aa, Triticum aestivum
  Clone ID: PAT_TA_2248.pep
FQPRGAPRRISWGSRQSRSTERSAIRRVFRNMFACFGRGHSAGSHASSSHMRPEEMTEASDHSAAFSHGSRSRSMSWRLEDGHAADTMVQR

SEQ ID NO: 107831 - protein, 44 aa, Triticum aestivum
  Clone ID: PAT_TA_2249.pep
MAVDDEAAAAEIGELKQRISGGRLSRRRPTLETIHEESYAALAC

SEQ ID NO: 107832 - protein, 109 aa, Triticum aestivum
  Clone ID: PAT_TA_2250.pep
LSAKTKLPVKVQRRKAGEQGKRLDITTQDGRHCKELKQPDDSAEHELISRHGRDPTSSLLQHLAHPSHSGVWSSSTAYHLLQLRVSNCFRPSTPSLSTALPHRSPALIL

SEQ ID NO: 107833 - protein, 211 aa, Triticum aestivum
  Clone ID: PAT_TA_2251.pep
MFSSNEVNSSFGTDENHSIKSGSDNILVDFYHKLREESMAMIFRYNKDIKEAQKSSAHSDGNKKETPRGREFQEIWEKLRDSSLAEGFRIHAPPSRDESISGLLNSTKEEHIKDFEQHYHLAEKIALAQHDMSLAVELYKHSVSTLHTLGLASKEEQCDYVAAWYSMFLSCAQELQHGAVLWQESCHPKVHDLVISEGANWFVALGEIYRV

SEQ ID NO: 107834 - protein, 179 aa, Triticum aestivum
  unsure (1)..(179): unsure at all Xaa locations
  Clone ID: PAT_TA_2252.pep
PPPPGAPPPHLAFSWRVLAPTPPNELPPPPPSVAAPASSWPAADLASFRRESNPQLFVALPFPCRPPPSPPSTTXPLPPPMRGLDPVPPPTTTKTPAHRRPPAQCPSAHESDLPSAPAQPSIPSGAACPLIRCALLQRACTLLRRHRDRAPPPPASSSIPKLVLECGRCTAQIPTHRSS

SEQ ID NO: 107835 - protein, 348 aa, Triticum aestivum
  Clone ID: PAT_TA_2253.pep
MAARSPYFAPEEGARCIRPGESPAAALRRILATPGAHQAPCCFDALGARLVERAGFPICFMGGFCVSASRLGLPDVGLISYGEMVDQGRLITEAVSVPVIGDGDNGYGNSMNIKRTVKGYINAGLAGIMLEDQVAPKACGHTEGRKVISREEAVMHIKAAIDTRKESASDIVIVARTDSRQAVSLDEALWRVQAFADAGVDVLLDSRQPVSLDEALWRVQAFADAGADVLFIDALASIEEMKAFCGVAPGVPKMANMLEGGGKTPILTPAELKEIGFSLVVYPLSLIGVAMRAMEDALLAIKGGGVPPPASLPSFQEIKDTLGFNRYYQEDKQYTVPQAEPSMPTGNP

SEQ ID NO: 107836 - protein, 297 aa, Triticum aestivum
  unsure (1)..(297): unsure at all Xaa locations
  Clone ID: PAT_TA_2254.pep
MARWSSCMALLVLAVAAQLGASDLSPGYYGSSCPSLESIVRGVVTQKMDDTIRTIGSTIRLFFHDCFVEGCDASVLIXSTPGNPTEMDADDNKSLAFEGYETVRIAKEAVEAACPDLVSCADILTIATRDAIALSGGPFYPVELGRLDGLSSTASSVAGKLPQPTSTLNQMVAMFRAHGLNMSDIVALSAAHTVGLAXCRKSRAAVYGSPADATLNPKYAXFXRTXCPPTVVGPMCNGQSXPXSSKQYTELQDGGAVRQVREAASWAGAPGSAHGNRRSVNRKSMSNMEGILVRLVI

SEQ ID NO: 107837 - protein, 369 aa, Triticum aestivum
  Clone ID: PAT_TA_2255.pep
EARSTVADAQAHCTDALPVNSTDDLAVLDAEHVLWATAFSYTDSIPLQAAPDLRLADATHLPGGAATLPQLPARVPVLPSKIPCLRRLMRTLAVPGVFGVVQPAAVSVAAAPGSVAAEPCYALAPLSRLLVGSRNLVSIITMLLSPIFVTSFLGLAAPFLLALAHPEPLWEMSGHDAALDALINSAMVSDSRFIVDIAVRESGDVFRGISSLVDVGGGLGAAAQVISEAFPHLQCSVLELEHVVSKAPAGTSVKYVAGDMFESVPPADAVFLKSVLHDWDDEKCVKILKTCRKAVPPREAGGKVIIIDIVVGADKKHGEVHALLDLYIMFINGVERDEQEWSKIFLEAGFSDYKIIPVLGFRSIIEVYP

SEQ ID NO: 107838 - protein, 36 aa, Triticum aestivum
  Clone ID: PAT_TA_2256.pep
MVPMDQPKAALEMLKRWTSGNLSDASLLSQRLDFAI

SEQ ID NO: 107839 - protein, 275 aa, Triticum aestivum
  unsure (1)..(275): unsure at all Xaa locations
  Clone ID: PAT_TA_2257.pep
PPPRRLRRPRPIWLPAGLLLGLKGFALGNGLTDPAIQYKAYTDCPCDMGLLTQSEFSKISNLVAACXLALGQRVTSGTVPGLAAYFVCNTIFSSSRWLSGSFHHYDIRXPCVVSLCYDFSNXEKFLNLKSVRQSLGVGDIEFVSCSPTVYQAMLLDWMRNLEVGIPELLENDIKVLIYAGEYDLICNWLGNSRWVDSMEWSGKKAFVSSTEKPFMVDGKEAGVLKSHGPLSFLKVHDSGHMVPMDQPKAALEMLKRWTSGNLSDASGSQRLDFAM

SEQ ID NO: 107840 - protein, 114 aa, Triticum aestivum
  Clone ID: PAT_TA_2258.pep
VIEAPPYLAPHIWYQRPATTPSPSSIWRNSSRPAACGRFVSNLKRWIRPSRTTWRRSPRPWKNSAPTCAATPTRSAPVPRNSLLQNKTGSNAVLETQQRWNLMESWMSTKLICT

SEQ ID NO: 107841 - protein, 246 aa, Triticum aestivum
  Clone ID: PAT_TA_2259.pep
LTRGFQDYTAKLSYFGLAKDGPNGDATHVTTRIMGTHGYAAPEYIMTGHLTAKSDVYSFGVVLLELLSGRRSIDRARRSREQSLVDYARPYLKKQDKLHRVMDPALECQYSCQGAELAARVAYKCLSQNSKLRPTMKEVVQALEPILKMDDYLQVGPFVFTVVVENTEKNVGSKGKLIGDEWKADMKVEKIVEDKQQSHQDRHRQKFPNSTIHADILLQRDGAIGPYTTALQRHRRASSYTEERGA

SEQ ID NO: 107842 - protein, 132 aa, Triticum aestivum
  unsure (1)..(132): unsure at all Xaa locations
  Clone ID: PAT_TA_2260.pep
MAPPAKLTQYTQLILLLLAAAVASDHLTLQQAAAAADELQGRPQQGLGRPGCRDKCGDMSIPFPFGMXKPGCFLPGFEVTCNTSSTPPRAFLAYNHSEPPYQVIYQYAFGTGEWGYKPNRGASRRLFQNINS

SEQ ID NO: 107843 - protein, 263 aa, Triticum aestivum
  unsure (1)..(263): unsure at all Xaa locations
  Clone ID: PAT_TA_2261.pep
QNPNIIPTFSYSILSDPHKKRQYDTSGFEAIETDSQELXELDLSSLNTVNTMFAAIFSKLGVPIKTTVPATVLEEALNGSIVVSQLQLGNPVRKKVERQXAHFYXVDITEQEAKKGLVCRVHSTAKKQXKLLYFELEENGGLSLALKEHSVKASKVSSAGMYFLGFATYTLETDCPGSFPAENEKRLSVEAKMLTKRAELSKFETEYREVLAKXTEMTSXYTQEMQTNDELLNERNVIHASYTNNPPLKRLAGINLIHYLLQI

SEQ ID NO: 107844 - protein, 102 aa, Triticum aestivum
  Clone ID: PAT_TA_2262.pep
IDGDAPSSQLRSLSCLAGAQDSRNPAESAVLGRPGSRSSPERLVEWQCGIQALARDLRAPARPLQISRGSGQAKKMSPQPPRDLPEDRGEANVLIEEAPGSP

SEQ ID NO: 107845 - protein, 366 aa, Triticum aestivum
  unsure (1)..(366): unsure at all Xaa locations
  Clone ID: PAT_TA_2263.pep
AAFSAPLGRPLQTSHGAVGEAGIASGPSLTVLTVGRRLRVRLGSLSRRNFEAKVSGVPSLSGLHRGKSLESATDLQDSLVTNLQGNWASLPPELLRDVMKRLEEDDSNWPSRKDVVACASVCTTWREMCKDIVRNPEFCGKLTFPVSLKQPGSRDGLIQCFIKRDKSKLTYRLYLSLTSAVLDDNGKFLLSAKRSRRTTYTDYAISMDPKNISRSSSGYIGKLRSNFLGTKFIIYDTQPPYNASKLCPQERTSRRFSSRKVSPKVPAATGSYPIAQVNYELNVLGTRGPRRMQCTMNSIPTSAVDPDGVVPGXQPKELLPRLFEESFRTTAIPGTHGLQQCPFGKGPLRGGDENGDKENPLVLKEQ

SEQ ID NO: 107846 - protein, 210 aa, Triticum aestivum
  Clone ID: PAT_TA_2264.pep
GYYGPTIIMGAMDERSLTFHTNRRRYGPYGDEYGTYFSTSFADGRVVGFHGREGWYIDGIGVHVQRGKVPSSSLRRAASRSPSPAPRSDYDPGDVDEEVPYAAMVKEPAAAGPGPWGGPGGRAWDDGVYAGVNQVYVTRGALIGSIQIQYDRGDRSEWSARHGTSGHITHRVKLDAPHEVLTCVRGYYNADPAEGPRALRSITFVSNRGR

SEQ ID NO: 107847 - protein, 83 aa, Triticum aestivum
  Clone ID: PAT_TA_2265.pep
LFDAQQQCVKVQFEVDEPSSSVDSMIGALTRLKSMNVKTRGIHSILSGQRLTTEMNVETTIAACEVEKAVEEALQGSREESAA

SEQ ID NO: 107848 - protein, 171 aa, Triticum aestivum
  Clone ID: PAT_TA_2266.pep
MATAILSIAAVVLLLAVQDSHGAKLCMDSTFPRAVNGSLSFCGYNGTACCNTTDDAAVRRQFAAMNISGTPCGDLVKSILCARCNPYAGELFTVRTSPRTVPLLCNSTGVSSRVSGVAAATGYCAKVWDTCKDVSIPGSPFQPPKGGASAPKLAEVWESEGDFCGALGGES

SEQ ID NO: 107849 - protein, 291 aa, Triticum aestivum
  Clone ID: PAT_TA_2267.pep
VEGPMVLLPDCLIMVSLYYRRVLVMKLDRMYRVMKVLIKLLQQNQPMSAPYLFHQLKMETMVLLILWTLHRRKVEILSKNAMLHLMFILMRYHRGMQMRCLTGFPCLSRVHGAGLSAAPAPNDSGNLVQECHAASDVHPDEVPQGNADEVPHGNPVPLTSATEEAADHSGDKSVPAEPEIHEELHMNSTSESRAKDAAPPRPVRFRPPMMRVPTRLLAPPLITPSIGPWDRSHGNSRMVSPGNDNPSCTNSSSAVPPNNNELINSAADASADNSLDEGRRSKHLLYQVAVY

SEQ ID NO: 107850 - protein, 120 aa, Triticum aestivum
  Clone ID: PAT_TA_2268.pep
MAPPLPSRAALALIVAVAALLVLVVAAELDAGSSTWAAEDYGGGAVTAMRAACRVEDEEGCGGEATLRRHLGGGGYIGYDALRRNAVPCSVRGASYYNCRPGGQANPYSRGCSSITRCRG

SEQ ID NO: 107851 - protein, 370 aa, Triticum aestivum
  Clone ID: PAT_TA_2269.pep
MPSASSAVPPAAAPGDESQSQKVLLGRYELGGLLGRGASAKVYRARDLLTGRDVAIKSFPNPRAGARDGEGSAGSAAIEREAAILARLRHRHVVRLHEILGTRKKVHFGLDLAAGGELFSLVDSDGRMTEDLARHYFRQLVSAVRYCHSRGVYHRDIKPENLLLDGDGDLKVADFRLGAVADESLHHTLCGTPAYVAPEILSKQGYHPAKVDIWSCGVVLFVLAAGYLPFNDASLINMYRKIYAGRFRCPNWFSPALRHLLRRILDPNPSTRIDTDGIMEHPWFRHGASGDGELEELMRGHEEEAWFKTEFKEDMARDMTAFDILAFSPGSDLSGLFGAGPGTERVFRGRARRGRAGPGRGRREEAGAPR

SEQ ID NO: 107852 - protein, 206 aa, Triticum aestivum
  Clone ID: PAT_TA_2270.pep
PVQILLSYPESIVELEQQEPGTPEPRASTKFISDCSPELSHDKQEQPSPISVLDSFYEDVADPECENIKQCDLHEELRGALYFPDNESNLLASGEDKSVRLDYIKLVLVLSQLCAEQNLEVWHLEDELISPCLLEELPNQGDQIDDLKILFDCICEALTEIQERYFRLSSWLSFLKHDIRAPPVGEDLVAEVDKYVDDYLRHSFQR

SEQ ID NO: 107853 - protein, 64 aa, Triticum aestivum
  Clone ID: PAT_TA_2271.pep
KGMASLSFSLLFLSSAFLTTKLRLCILFVLFTHPYCVIHSLLVVDLFENVLLASFCIVIILKSS

SEQ ID NO: 107854 - protein, 183 aa, Triticum aestivum
  Clone ID: PAT_TA_2272.pep
FLRVGTTGETICSLRPILHRTHYVCALTAGSSIGNIQHMITKNYYYPIPPGIGRTTQSAQIGYGKATVAAYGYNWNANNPIDWISDMFVGVRGSTVLHANVVGQSGNTVQVNSFSAARAYVPLPNLPGNSNTISTSVSVTAGLINDISRDALSNAPSTGSGLSLTNCATQSALSVNVPQFLPH

SEQ ID NO: 107855 - protein, 173 aa, Triticum aestivum
  Clone ID: PAT_TA_2273.pep
ASPPLVGSTFCPSWGAALTVWLRDEEAPKPAWRRLTLVRASFLQVFSQHGAMSTTMRNLRSARFCSVVRDGIYKLNLAPPLENRLMLLDSLARNRSVQPSYRLPLLTQYKNFLEYCREKHALHAGSTHHPPRGMAYPSVVQWTTTASGQVLDTSPPSIGHHGAWVFAWHFPSC

SEQ ID NO: 107856 - protein, 111 aa, Triticum aestivum
  Clone ID: PAT_TA_2274.pep
STRPRRLLSHSSLLTQRPASLSRWKESLQHGGQDQRPDREGGAVCSTCTVKDSSHGRGVCLVLAVAQLRHGVVPLLQRLRRRRGRPVLAAGQRPGDVEAEEAHPERVVHGH

SEQ ID NO: 107857 - protein, 141 aa, Triticum aestivum
  Clone ID: PAT_TA_2275.pep
MMTANAKLQKQALLPPRSPFPTAASPSPYADHGPIARPQGATHHRFGHGHGHGHHQRTSSESIIEEQPSWLDDLLDEPETPVRRAGHRRSSSDSFALFDGSAASGAFANGFEEMGGGGQAAPWGGVYYAKPSSYLQGRPWE

SEQ ID NO: 107858 - protein, 174 aa, Triticum aestivum
  Clone ID: PAT_TA_2276.pep
TDLAGAGLCASRSAAVPWWRGDGLGRPGGACTEVLVAPRRRSGSCGRWRHGHPVSLGCGDGPTAVASVRRGWWSQAAVLPRARPDLSPPGCAAACAAGSGRFRLRSARGVPFLHLLQLGSPSRLRVYGVGALELPVLALAGVVPGDAVGHYFSGLLTCCGSAGRQVFGMQMAAM

SEQ ID NO: 107859 - protein, 192 aa, Triticum aestivum
  Clone ID: PAT_TA_2277.pep
RMLSRTMRWLTSSARGRHTLAAQASSVGRSSPSKRTAHASARSALARAPPTLGATAAGGAGIAEAERALVHHPRRRPPPPAPPPPQALPDERHHVAPHVDRRQEARHGRHSSMECTDHTYVRARPVLELSPPELGGDTAAEAHPYVHAHSCGSHGSHHAHGSSRAWSDQQRRPHTQHLGGGCGRSQVWYICA

SEQ ID NO: 107860 - protein, 162 aa, Triticum aestivum
  Clone ID: PAT_TA_2278.pep
MSGAFGGASRPSSRAAVGPRPSRRGPRPVPEGLQFVLNTLPVDPSCIGDGDGFTAHVKEMAGDTNNRDPKQYRIRMRGIDAPELNMEYGKKSKKGLVKLIGEKCVEIHVYGMDHFDRYIGDIYCDGVFIQEQMLKRGLAWHFKKYDKRPEFAQWEREAKMAR

SEQ ID NO: 107861 - protein, 140 aa, Triticum aestivum
  Clone ID: PAT_TA_2279.pep
TIYMCSLLLNLQAKGAGGAADPCSSRRRSVRTYHTPTEGGGWGRTLLISMASRERVAGRRTGARSAPGQCELVHQLSPPAWLDLLIHVSLRCRLPQLTLVRLSANEEEGTERERRLEAVELGAGEERARAQGRAAAPRAE

SEQ ID NO: 107862 - protein, 177 aa, Triticum aestivum
  Clone ID: PAT_TA_2280.pep
SRKDKYLDWRKRVLVAMDAAIGMEYLHSKDIVHFDLKCDNLLVNVKDPSRPICKVADFGLSKMKQATMVSGGMRGTLPWMAPELLTMSGTKVSEKVDVYSFGVVMWEILTGEDPYDGMHYGGVIGGILSDTLRPPVPTSCNPEWKKLMEQCWSTEPERRPSFTEVATCLRSMLQAQK

SEQ ID NO: 107863 - protein, 82 aa, Triticum aestivum
  Clone ID: PAT_TA_2281.pep
TKSDTASHVPAPCDPHHKLPRRLAVHGAFLAIPGLPLHLNGDRARVIRVLRLVGGVGGIGDHRLDSEEAALGELDAGWIHPS

SEQ ID NO: 107864 - protein, 163 aa, Triticum aestivum
  unsure (1)..(163): unsure at all Xaa locations
  Clone ID: PAT_TA_2282.pep
MIYCLERPTRKLLLMPVKPFEPNKSCYVCSETPLLLDVSTKXTKLREVIDKIIKIXLGMNXPVGKFDEEKETDGMVLSGWSAPVEKQINSNGESKSAASSSSAHATDDTVEDPSKPGMKRKLDELLETKENCDASSSAQVVEDDDDCVMLDGNPALIKKKRLQ

SEQ ID NO: 107865 - protein, 313 aa, Triticum aestivum
  unsure (1)..(313): unsure at all Xaa locations
  Clone ID: PAT_TA_2283.pep
MEDSKGSDGGGGERPGADHNPSPDQPPPVAAPGGGDDAAAAAAAAAALAEDEARRPFTALSQVDADLALARVLQEQERAYMMLRMNGVGGGGGRGDGYWNAGSXRYDEDAEEDYEEELENHLRGEGEGEDEGEDDGSEESEYEEEGFDEDEEVEDVDLDPAEYEDDEAYARALQDAEEREVAARLMALAGISDWRAVEHVEDHINDAHFXIDPDEYSYEELVALGGVVGTESRGLSADTLASLPSVTYKTKDMQDGNTEQCVICRVEFEEGESLVALPCNHSYHPDCINQWLQINKVCPMCSAEVSTSASKQA

SEQ ID NO: 107866 - protein, 137 aa, Triticum aestivum
  Clone ID: PAT_TA_2284.pep
MEASSWDALRKQARRLEAQLDDQMIAYRKLVSMKSDGSENDIETDIERSLKQLQQVNSQMQTWVSSGGSEVLSHTLTRHMEILQDLTQEFYRLRSSLRVKQQHASLLDLRDFDRAKFDVEESGDSEQALLREQAAIS

SEQ ID NO: 107867 - protein, 185 aa, Triticum aestivum
  Clone ID: PAT_TA_2285.pep
MQKVFSKNAIRTDKETSVNQLQLVKSQKKTWVSSGGSEVISHTLTRHMEILQDLTQEFYRLQSSLRVKQQHASLLDLRDFDRAKFDVEESGDSEQALLREQAAISRNSGQVDTVISQAQATLGALMSQRSTFGGITTKISNVSSRIPTINHILASIRRKKSMDTIILSLVASVCAFLMFIYWLSK

SEQ ID NO: 107868 - protein, 120 aa, Triticum aestivum
  Clone ID: PAT_TA_2286.pep
SDALLGGDAGRKRLRRGAGYRSVHSSSNKSSLVMCFRSSSASVATGVMSSGSVPPASSSNARWLQVAALLFLLFWGELAHGGGRADASPNKLGEFPDPAEDPLVVLVSGGHHGGGSREKA

SEQ ID NO: 107869 - protein, 100 aa, Triticum aestivum
  Clone ID: PAT_TA_2287.pep
DPASDCDCRAPHDLANPSSSSLSLRTNQSEYNSPYSHAHIGRSNPTVQKRRRPPLTWKREREQRRGEGLPRLHATSWNSLVPKSFFHSGRYQEIIQVSHL

SEQ ID NO: 107870 - protein, 149 aa, Triticum aestivum
  unsure (1)..(149): unsure at all Xaa locations
  Clone ID: PAT_TA_2288.pep
GSDKLCSFKTTPGRGGYIKEVVISDVEMDGIRVAIEFIGNLSSHPDDDFDPSELPVIDQITLKGIXVGTNISVAGILLGIDSDPFTAICLSNLSFSITDSLHSSPWSCSXNVSGYSESVLPEPCSELYAPSSNSSICFSLPSYSALDVA

SEQ ID NO: 107871 - protein, 334 aa, Triticum aestivum
  Clone ID: PAT_TA_2289.pep
TSNHESDSCLPYYVNCLSSFSLPSGCKKSEGHSDAQPSIVGDFDGMARSSHPSYVSVDQGTRRENHVICKTGDNSENGVTPGQQGGVFLGKRTFEPIVLGRDFAGPVVGMNEDSGKKVSSNVDAAPIAKARSLTKESLQGNTCVHKAVATLEGLYSEMPVKIGLEHLSHCSAGVEESVKISSDKVTSRSKTQEDLIKSIYNFSVVLLSTCDGGYELEESEHALVQSTIHNLSSLSSKISKAALKNDDVNGNCCQTKSDTRCHGKNHQPQKFDGLDWENIGADFKTFILEDLTKLPEENAIGDTKDAQMLIYKNLWIEAEASMCKLKYELQLARM

SEQ ID NO: 107872 - protein, 212 aa, Triticum aestivum
  Clone ID: PAT_TA_2290.pep
MDDVLVHRSAGGHNFRRRSAGGGGRRVAPMSSPPLPPSAYGFFPYSSAPPGPFLYPPYNFYSCGSLPPLPFNHPGLPPRPPATRAKHATFPYQPLTPPPRPAAVTKVKQTTATGMTVSEPRKMLEGKSKKPRTPRSAEEPPRAQRRKPRPRAAPLPATSAVTEALDDLEREVTRGFVEDLLHALAPPPSSLPLPTFSLDRAAATQVAGPCTV

SEQ ID NO: 107873 - protein, 71 aa, Triticum aestivum
  Clone ID: PAT_TA_2291.pep
MIIPVRCFTCGKVIGNKWDLYLDLLQADYSEGDALDALELFRYCCRRMLMTHVDLIEKLLNYNTLEKTETS

SEQ ID NO: 107874 - protein, 71 aa, Triticum aestivum
  Clone ID: PAT_TA_2292.pep
MIIPVRCFTCGKVIGNKWDHYLDLLQADYTEGDALDALGLVRYCCRRMLMTHVDLIEKLLNYNTLEKTETS

SEQ ID NO: 107875 - protein, 71 aa, Triticum aestivum; identical to SEQ ID NO: 107874
  Clone ID: PAT_TA_2293.pep

SEQ ID NO: 107876 - protein, 117 aa, Triticum aestivum
  Clone ID: PAT_TA_2294.pep
VPRPRLPLSCPGPRAVPGPGAAATRPRRRRRLPCGTSFDHRWAQSRAPHDALARERPSPGSSGCLRLRAGRPRRHPLDPFGQPPKVHHLQHPGRRRSQVKLDGLEADMLILVPRCFS

SEQ ID NO: 107877 - protein, 102 aa, Triticum aestivum
  Clone ID: PAT_TA_2295.pep
CLFMGLNNNLGLVNSGIPYNFTGESWNNSSVHQSGGAGSAQVSIAAAAAAHHSAFPALLSLAPRSHQLVYYSSEADQFPVDDLGSQSLSLSSARAFHDQTGS

SEQ ID NO: 107878 - protein, 111 aa, Triticum aestivum
  Clone ID: PAT_TA_2296.pep
MDRYWSHVATVDQLPATPTKDKLMDRYWSHVAQCTSCSAALKAMKALEVALQVASIAVVGLLAVAKGTLLTSVVQRAVIVSAAVLCFAASRWLADFIQKNFYFEDYVHAYK

SEQ ID NO: 107879 - protein, 274 aa, Triticum aestivum
  Clone ID: PAT_TA_2297.pep
TPLALWCLKLAGGKRKPQKYKLPPGPWTLPVIGSLHHLASGVPHRKITELCRRFGPLMLLRLGEVPAVVVSSAEAAALVMKTNDPVFADRPSSATVDIAGCGGRGIIFAPYGDHWRQMRKVCIMELLGSTQVNRMEGIRAEETGNLLRSITASAGAATINVTQIVMALSNDVVTRAVFGGRFEQQDEYLGELHKAFELLGAFCLVDLFPSSRLVRWLTNDERRMKRSYGRTQRIIAKAIEGRKATRAAGVGASGAYDEDLLDVLLRLQLEDSLE

SEQ ID NO: 107880 - protein, 229 aa, Triticum aestivum
  Clone ID: PAT_TA_2298.pep
MAKARPHSGRSGHRRRNLLLAAALLSAALLLPAAMASAAVAAAAEGDGENRSRGAATQWATGKDEGELAAEREAAGGGSVVEDDFAGGFGSLDSMLQWAIGNSDPGRLKEEAADVQKLSEDELLKRRHEIKDLMEKLKMPSDADLMKIAIADLNNASISLEDRQRALQELLILVEPIDNANDLDKIGGLVPVIQDLNNANEEIRITSAWILGTASQNNALVQSQILGYG

SEQ ID NO: 107881 - protein, 180 aa, Triticum aestivum
  Clone ID: PAT_TA_2299.pep
MPPPLQAHRILLSHRRASPIPRRRFTAVSSLSSAPAKTVAPGPPADAWVSIRESLLSGERTAADITSEYLSRLRRTETSLRSFIHVADAAAEREAEELDRRIASGGRDAVGPLAGVLVGVKDNLCTASMPSTGGSRILDGFQPAYDATAVRRLREAGAIVVGKTNLDEFGMGSTTEGSGF

SEQ ID NO: 107882 - protein, 29 aa, Triticum aestivum
  Clone ID: PAT_TA_2300.pep
FLSLSQISVTLGGVLIRIAFCSGLCNIQT

SEQ ID NO: 107883 - protein, 158 aa, Triticum aestivum
  unsure (1)..(158): unsure at all Xaa locations
  Clone ID: PAT_TA_2301.pep
KXKSXXXRAVGITHSISILGNLLGXPNVCFMIGFIRHGGGGAPPGPGGSSRASLPPLSAAGPHCPSWAAAPPIAPCCAAAASARCGPPPSVVGGMLSLPNYALPTYRWKGEAHQGMPYYGKNEALLKIVYYYLSSMWGDRPKEESATTRWPCLLPSID

SEQ ID NO: 107884 - protein, 186 aa, Triticum aestivum
  unsure (1)..(186): unsure at all Xaa locations
  Clone ID: PAT_TA_2302.pep
QSLRWQQPSPPPXMQVDPSGQVQWPQQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPILRPLFQLAQGLGIIQPQQPAQLEGIXRSLVLKTLPTMXQRVWCQPDCFNXN

SEQ ID NO: 107885 - protein, 196 aa, Triticum aestivum
  Clone ID: PAT_TA_2303.pep
TKGNKSWSSTAVAAALELVDPPGCRNSAPEQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQLVQGQGIIQPQQPAQLEGSGIGLKLSPGTDATAVTNHIAHSADWGNENQEYAIGDGHRAY

SEQ ID NO: 107886 - protein, 156 aa, Triticum aestivum
  unsure (1)..(156): unsure at all Xaa locations
  Clone ID: PAT_TA_2304.pep
MKTLLILTIIAVALTTTTANIQVDPSGQVQWPQQQQPFPQPQQPFSQQPQQIFPQPQQTFPHQPQQAFPQPQQTXFPHQPQQQFPQPQQPQQPFPQQPQQQFPQPQQPQQPCAQQPQQQFPQPQQPQQHVPRPQQPXLPFAKHQHHHFPQPQHPKH

SEQ ID NO: 107887 - protein, 202 aa, Triticum aestivum
  unsure (1)..(202): unsure at all Xaa locations
  Clone ID: PAT_TA_2305.pep
MKTLFILTILAMATTIATANMQVDPSGQVQWPQQQFPQPQQPQQPFPQPQQPQLPFPQQPQQPFPXQPQQPQQPFPQLQQPQQPLPQPQQPQQPFPQQQQPLIQPYLQQQMNPCKNYLLQQCNPVSLVSSLVSMILPRSDCKVMRQQCCQQLAQIPQQLQCAAIHGVVHSIIMQQEXQHQHQQQQQQQPTTTKAYRSLRXLF

SEQ ID NO: 107888 - protein, 141 aa, Triticum aestivum
  unsure (1)..(141): unsure at all Xaa locations
  Clone ID: PAT_TA_2306.pep
MQVSNSSHKSTMKTLLMLTIIAVALTTTTGNIQVDPRGQVQWPRQRQPLPQPQHPLSQYPQRIFPQPQQYISHQPQQALXHPQQTLSHEPQQQCPQSXQPQQRCSQLPHQQFQQSHRLEQPLXHQPHHQFPETKERQQPFS

SEQ ID NO: 107889 - protein, 196 aa, Triticum aestivum
  Clone ID: PAT_TA_2307.pep
QPQQPFPQPQQTFPQQPQLPFPQPQQPQQPFPQPQQQFPQPQQPQKSIPQQQQPLIQSSLQQQMNPCKNFLLQQCNPVSLVSSLVSLILPRSDCQVMQQQCCQQLAQIPQHLQCAAIHSVAHSIIMQQQHQGIQILRPLFQIVQGQSIIQQQPAQLEVIRSLVLKTLPTMCNVYVRPDCSNIRTPFASTVAGIGGQ

SEQ ID NO: 107890 - protein, 175 aa, Triticum aestivum
  unsure (1)..(175): unsure at all Xaa locations
  Clone ID: PAT_TA_2308.pep
MKTLFILTILAMATTIATANMQVDPSGQVQWPQQQPFRQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLFQLVQGQGIIQPQQPAQYEVIRSLVLRTLXNMCNVY

SEQ ID NO: 107891 - protein, 219 aa, Triticum aestivum
  Clone ID: PAT_TA_2309.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPQLPFPQQQQQQQQQQQQQGIQIMRPLFQLVQGQGIIQPQQPAQLEVIRSLVLGTLPTMCNVFVPPECSTTKAPFASIVADIGGQ

SEQ ID NO: 107892 - protein, 197 aa, Triticum aestivum
  unsure (1)..(197): unsure at all Xaa locations
  Clone ID: PAT_TA_2310.pep
MKTLFILTILAMATTIATANMQVDPSGQVQWPQQQPFRQPQQPFYQQPQQQFPQPQQPQQPFPQPQQAQLPFPXQPQQPFPQPQQPQQPFSQSQEPQQTFSQAPQPEQLFPQQQQPLIQPYLQQQMNPCKNYLLQQCNPVSLVSSLVSMILPRSDCQVMQQQCCQQLAQIPRQLQCAXIHSVVHSIVMQQEQQHGIQ

SEQ ID NO: 107893 - protein, 197 aa, Triticum aestivum
  unsure (1)..(197): unsure at all Xaa locations
  Clone ID: PAT_TA_2311.pep
MKTLFILTILAMATTIATANMQVDPSGQVQWPQQQPFRQPQQPFYQQPQQTFPQSQQPQQPFPQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLFQLVXXXXIIQPQQPAQYEVIRSLVLRTLPNMC

SEQ ID NO: 107894 - protein, 194 aa, Triticum aestivum
  Clone ID: PAT_TA_2312.pep
LTLTKGNKSWSSTAVAAALELVDPPGCRNSARAFPQPQQPKQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLFQLVQGQGIIQPQQPAQYEVIRSLVLRTLPNMCNVYVRPDCSTINAPFASIVAGISGQ

SEQ ID NO: 107895 - protein, 256 aa, Triticum aestivum
  Clone ID: PAT_TA_2313.pep
MKTLLILTIIAVALTTTTANIQVDPSGQVQWPQQQQPFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLARIPQQLQCAAIHGIVHSIIMQQEQQQQQQQQQQQQQGIQIMRPLFQLVQGQGIIQPQQPAQLEVIRSLVLGTLPTMCNVFVPPECSTTKAPFASIVADIGGQ

SEQ ID NO: 107896 - protein, 213 aa, Triticum aestivum
  unsure (1)..(213): unsure at all Xaa locations
  Clone ID: PAT_TA_2314.pep
MKTLFILTILAMATTIATANMQVDPSGQVQWPQQQPFRQPQQPXTKQPQQTFPQPQQAFPHQPQQQFPQAPSNHNNNFRKPQATTTTISPSPNKAQLPFPQQPQQPFPQASTTPNNHFPSHKQPQQPFPQQPQQPFPQTQQPQQPFPQFQQPHQPFPQPQQQFPQPQQPQQSFPQQQRPFIQPSLQQRLNPCKNILLQQCKPASLVSSLWSII

SEQ ID NO: 107897 - protein, 337 aa, Triticum aestivum
  Clone ID: PAT_TA_2315.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLARIPQQLQCAAIHGIVHSIIMQQEQQQQQQQQQQQQQGIQIMRPLFQLVQGQGIIQPQQPAQLEVIRSLVLGTLPTMCNVFVPPECSTTKAPFASIVADIGGQ

SEQ ID NO: 107898 - protein, 297 aa, Triticum aestivum
  Clone ID: PAT_TA_2316.pep
MKTLLILTILAMATTIATANMQVDPSSRVQWPQEQPPPQSQQPFSQQPQQIFPQPQQTFPHQPQQAFLQPQQTFPRRPQQQFPQPQQPQQPFPQPQQPQLPFPQQPQQPFPQPQQPQQPFPQSQQPQQPFPQPQQQFPQPQQPQQSFPQQQQWMIQSFLQQQMNPCKNFLLQQCNPVSLVSSLVSIILPRSDCQLMQQQCCQQLAQIPQQLQCAAIHNVAHSIIMQQEQQRGVQILRPLFQLAQGLGIIQPQQPAQLEGIRSLVLKTLPTMCNVYVPPDCSTINMPYANIDAVIGGQ

SEQ ID NO: 107899 - protein, 297 aa, Triticum aestivum
  Clone ID: PAT_TA_2317.pep
MKTLLILTILAMATTIATANMQVDPSSRVQWPQERPFPQSQQPFSQQPQQIFPQPQQTFPHQPQQAFPQPQQTFPHRPQQQFPQPQQPQQPFPQPQQPQLPFPRQPQQPFPQPQQPQQPFPQSQQPQQPFPQPQQQFPQPQQPQQSFPQQQQLMIQSFLQQQMNPCKNFLLQQCNPMSLVSSLVSIILPRSDCQVMQQQCCQQLAQIPQQLQCAAIHSVAHSIIMQQEQQQGVQILRPLFQLAQGLGIIQPQQPAQLEGIRSLVLKTLPTMCNVYVPPDCSTINVPYASIDAGIGGQ

SEQ ID NO: 107900 - protein, 338 aa, Triticum aestivum
  Clone ID: PAT_TA_2318.pep
MKTLFILTILAMATTIATANMQVDPSGQVQWPQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLAQIPQQLQCAAIHGIVHSIIMQQEQQQQQQQQQQQQQQQGIQIMRPLFQLVQGQGIIQPQQPAQLEVIRSLVLGTLPTMCNVFVPPECSTTKAPFASIVADIGGQ

SEQ ID NO: 107901 - protein, 267 aa, Triticum aestivum
  Clone ID: PAT_TA_2319.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQSQQPQQPFPQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLFQLVQGQGIIQPQQPAQYEVIRSLVLRTLPNMCNVYVRPDCSTINAPFASIVAGISGQ

SEQ ID NO: 107902 - protein, 328 aa, Triticum aestivum
  Clone ID: PAT_TA_2320.pep
MKTLLILTIIAVALTTTTANIQVDPSGQVQWPQQRQPCSHPQQPFSQPQQPFSQQPQQIFPQPQQTFPHQPQQAFPQPQQTFPHQPQQQFPQPQQPQQQFPQPQQPQQPFPQQPQQQFPRPQQPQQPFPQPQQPQLPFPQQPQQPFPQPQQPQQPFSQLQQPQQPLPQPQQSQQPFSQQQQSLIQPYLQQQMNPCKNYLLQQCNPVSLVSSLVSMILPRSDCQVMRQQCCQQLAQIPQQLQCAAIHGVVHSIIMQQEQQQQQGIQIMRPLFQLIQGQGIIQPQQPAQLEVIRSLVLGTLPTMCNVFVPPECSTTKAPFASIVADIGGQ

SEQ ID NO: 107903 - protein, 334 aa, Triticum aestivum
  unsure (1)..(334): unsure at all Xaa locations
  Clone ID: PAT_TA_2321.pep
MKTLLILTIIAVALTTTTANIQVDPSXGQVQWPQQQQPFPQPQQPQQIFPQPQQTFPHQPXQQAFPQPQQTFLHQPQQQFPQAPXQPQQPFPQQPQQQFPQPQQPQQPFSPSNHNNXFPKPQQPQQPFPQPQQPQLPFPQQPQQPFPQPQQPQQPFPQLQQPQQPLPQPQQPQQPFPQQQQPLIQPYXLQQQMNPCKNYLLQQCNPVSLVSSLVSMILPRSDCKVMRQQCCQQLAQIPQQLQCAAIHGVVHSIIMQQEQQQQQQQQQQGIQIMRPLFQLVQGQGIIQPQQPAQLEVIRSLVLGTLPTMCNVFVPPECSTTKAPFASIVADIGGQ

SEQ ID NO: 107904 - protein, 270 aa, Triticum aestivum
  Clone ID: PAT_TA_2322.pep
RHEAFPQPQQPFCQQPQRTIPQPHQTFHHQPQQTFPQPQQTYPHQPQQQFPQTQQPQQPFPQPQQTFPQQPQLPFPQQPQQPFPQPQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPILRPLFQLAQGLGIIQPQQPAQLEGIRSLVLKTLPTMCNVYVPPDCSTINVPYANIDAGIGGQ

SEQ ID NO: 107905 - protein, 302 aa, Triticum aestivum
  unsure (1)..(302): unsure at all Xaa locations
  Clone ID: PAT_TA_2323.pep
MKTLLIVTILAMATTIATANMQVDPXTKYIGPQQQPFPQPQQPFCQQPQQTIPQPHQTFHHQPQQTFPQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQLVQGQGIIQPQQPAQLEVIRSLVLRTLPTMCNVYVSPDCSTINAPFANIVVGIGGQ

SEQ ID NO: 107906 - protein, 289 aa, Triticum aestivum
  unsure (1)..(289): unsure at all Xaa locations
  Clone ID: PAT_TA_2324.pep
MKTLFILTILAMATTIATANMQVDPSGQVQWPQQQPFRQPQQPFYQQPQQTFPQPQQAFPHQPQQQFPQPQQPPQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLFQLVQGQGIIQPQQPAQYEVIRSLVLRTLPNMCXNVYVRPDCSTINAPFASIVARASVDNEK

SEQ ID NO: 107907 - protein, 81 aa, Triticum aestivum
  Clone ID: PAT_TA_2325.pep
ATNALIHSWSPRQSFKRKPKAAKGGNREGNLSWMCAGTPWQSGKAMDGDGEITWAFYFCSFKISHISLPTLSSIISLATNS

SEQ ID NO: 107908 - protein, 168 aa, Triticum aestivum
  Clone ID: PAT_TA_2326.pep
GRPHVRGRPLALGPVPDPPVGFQWDPKKFCWYLYFMYFTLLYFTYYGMLAVGLTPSYNIASIVSSFFYGVWNLFSGCVISQPTMPVWWRWYSWACPVSWTLYGLVASQFGDLTEPLQDTGEPINAFLKSFFGFRHDFLGVVAVVTAGFAIFFAVAFGLSIKVLNFQRR

SEQ ID NO: 107909 - protein, 166 aa, Triticum aestivum
  Clone ID: PAT_TA_2327.pep
MDATKTAAKAVAAGNGDADAAPSTRRTAAPRPVPRRDEPLAGEGGAAADPAPATATTGATVAESGVEDEQVERFYALLANIRAMRGMNESGGDDAGASTEGASEVCGGGRKRARWAEPPWRPAFRLEDFQDASASKKDMNDDGAASHRRPGKETKDEAADGGKEDD

SEQ ID NO: 107910 - protein, 362 aa, Triticum aestivum
  unsure (1)..(362): unsure at all Xaa locations
  Clone ID: PAT_TA_2328.pep
MPPPPPHPNGGKVTPNLAMDAEGTRLLNLTVLQRLDPAVEDILITAAHVTLYDFNIDLNQWSRKDVEGSLFVVKTNSQPRFQFIVTEQAQLRIISWEDLLXDFEYELQPPYFVAIGVPHKELNGIWFNNQXECQAVASLXFGGILNAYAKVPPKPKVPSRKSEIAEFEAAPXILSHPPSNISLRNWWALRSFVALVGHPDPPPASTXTPSTPAKTHATCIADASTLRSVSCFPLVGRNIPSMDPPPAPCPSIIIPHAGPSTDLVPPAVFVSPSPTSTPLALPVLLCMPTISPLHPXSTSSQRLPFGTLLLQPFPPPTPPASLTPAHNDGPAISRDKVKDALLRLVQSDEFPDLIYRELLNAS

SEQ ID NO: 107911 - protein, 176 aa, Triticum aestivum
  Clone ID: PAT_TA_2329.pep
MAVNGSANGSSGANGSAGPTRTVLVTGGAGYIGSHAVLQLLAAGFRAVVVDSLENSSELAVRRVAALAGDHARNLSFHKVDIRDEDALDAVFASTRFDAVIHFAGLKAVGESVQKPLFYYDHNIAGTINLLKVMAAHECKKLVFSSSAAVYISRHISSAISLVLPYGLCGRRGNSS

SEQ ID NO: 107912 - protein, 223 aa, Triticum aestivum
  unsure (1)..(223): unsure at all Xaa locations
  Clone ID: PAT_TA_2330.pep
GFNTSANWVCPWIYTQGNGCYQHRCTNNSLEVAVDGVWKSCPESGGPVQFPGFNGDLICPAYHELCNTVPVQISGQCPKSCSFNGDCIAGTCHCFPGFHDHDCSRRSCPDECSGHGICKAYGICECESGWTGIDCSTAVCDEQCSXHGGXWDNGKCEFRCSDYAGYTCQKGSTILPSLSMCHDVPVRDSDGQHCAPSELSILQQLEAVVLVPNYNRLMPSGRT

SEQ ID NO: 107913 - protein, 352 aa, Triticum aestivum
  unsure (1)..(352): unsure at all Xaa locations
  Clone ID: PAT_TA_2331.pep
DLKALLLLPLGVPIIIFVIYVHGQKVTYFLRPIWEKPPKPFTNPLSALPHYYHENASMANLCKLHGWKVREAPRRVFDAVLFSNELDILDIRWHELSPYVSEFVLLESNSTFTGLVLNPKRMQHVICQGADLFDMLPDGVHVPRDQSPSLVHSQVRIQRFIFPPISSRRLIXQESLSWQLHEEECVTGHTSILMRWCDGTPEILHLQLKNYLYSFQFMLDDKSWRASVHRYRAGKTRYAHYRQTDDLLADSGWHCSFCFRYINDFVFKMKAYSHVDRIRFSYFLNPKRIQHVICQGADLFDMLPEEYTFQEIIAKLGPIPSTYSAVHLPAYLLEKADQYRYLLPGNCMRESG

SEQ ID NO: 107914 - protein, 312 aa, Triticum aestivum
  unsure (1)..(312): unsure at all Xaa locations
  Clone ID: PAT_TA_2332.pep
AGSCVPPSPSSHLLCRSLAAARTLSVAAAGSSSSSSPVKMARSALDEVTDTGAFDRTPSTFRSFVFRDASARFPAVAGRYHLYVSYACPWAXSRCLAYLKLKGLDHAIXFSSVKPIFERDXGESDDHLGWVFPATXTRCPGAGPDPFNRAKSVRDLYEIASTNYTGRXTVPVLWDKQLKTVENNERSEIIAMLNAEFHGLAENPGLDLNPAHLQVSIDEVNGLVYDAINNGVYKCGFAKKQGPYAQPGPTLYEALDKCEEILGKQRYMCGNQLTEADVRLFVTLIRFDEVYAVHFKCNKKLLREYPNLFNYT

SEQ ID NO: 107915 - protein, 250 aa, Triticum aestivum
  Clone ID: PAT_TA_2333.pep
VTRPLHPLQRIAYLNMSTYPIVTVFILAYNLFPVLWLFSEQFYIQRPFGTYIMYLVAVISIIHVIGMFEVKWAGITLLDWCRNEQFYMIGATGVYPTAVLYMALKLVTGKGIYFRLTSKQTDACSNDKFADLYTVRWVPLLLPTIVVLVVNVAAVGAAIGKAAAWGFFTDQARHVLLGMLFNVWIIVLLYPFALGIMGKWGKRPVILFVMLVMAIGAVALVYVTFHAPYPADFSEAAASLGEASVTGPSG

SEQ ID NO: 107916 - protein, 213 aa, Triticum aestivum
  Clone ID: PAT_TA_2334.pep
SFPPAVIQSAIRIPQHRSRNQICPPHPISTPHPISSPPTMANIHHVNNVAQMLGVVVQFVGVDLNAAAGHTVFIHGVNSINDCAEMLRHAEYLEDRGAVVSNVDSLRLLVRANDLILDVSDHLVGSLVFDPIHDVNDLRLRRLGAFATCIDDLATGLQAGVFHDFANVFAARITEAIAGFGDGLLTAQQVIIEAVGASANLDHDTFHTYIPIP

SEQ ID NO: 107917 - protein, 126 aa, Triticum aestivum
  unsure (1)..(126): unsure at all Xaa locations
  Clone ID: PAT_TA_2335.pep
MMAPELDKQCSNIQLGEELEICDIKLALKALRKKILSLDFHNSLHVHDPQNSFEYLEVLYKLRQLSEKLGNLDPGGEAKEHKELTVYADDLFEMAMARLXEEFVTXTYYKQPXEHELLSFRSKEDG

SEQ ID NO: 107918 - protein, 227 aa, Triticum aestivum
  unsure (1)..(227): unsure at all Xaa locations
  Clone ID: PAT_TA_2336.pep
SARGSTAGSKKLIYFGPMAAAPPFDLEDLLRASAEVLGKGAFGTAYKAVMESGAAVAVKRLKDVDLPEPEFRERIAAIGAVQHELVVPLRAYYFSKDEKLLVYDYMSMGSLSALLHGNRSSGRTPLDWEARSAIALSTARGVAHIHSTGPTASHGNIKSSNVLLTKSYEARVSDHGLPTLVGPSFSPXRVSGYRAPEVTDIRRVSQKADVYSFGVLLLELLTGKAPT

SEQ ID NO: 107919 - protein, 138 aa, Triticum aestivum
  Clone ID: PAT_TA_2337.pep
MNPIAKCYLMFFLLLAVLLPEARANSCHPGDLRALLDFAGSLNGRDVLLRATWSGAACCSWEGVGCDAANGRVTALRLPGRGLEGAIPGTSLAGLAQLEELDLGSNNFHNISGVLTVLHGCQNLATLILTRILMVKSY

SEQ ID NO: 107920 - protein, 184 aa, Triticum aestivum
  unsure (1)..(184): unsure at all Xaa locations
  Clone ID: PAT_TA_2338.pep
SQRAGSAKQLRQAREAGSCSSRSTHGRPEPPAHHHARPPCRPRGPGRPAPPHPADGLRPAGSGHEARIHRQPARRHDSTARRRGGRRCRSLGPPPQRPAPPRSRRGQEAXIRPGARPREARRAVQGRPAHTAXARRGPPPPAAARALPGGDARRRRGGRGLSGGGRRRARFRPGRPSLLLSRTR

SEQ ID NO: 107921 - protein, 164 aa, Triticum aestivum
  Clone ID: PAT_TA_2339.pep
QTCRHSRRIGRPRFQEFPIPPAISDLLAQPKGQQKIGPNYERVNSEGGHGDNHVHIISQVKDDLKEAHGSHGEESRKKVMMALEPKIGKDLKGQPLSHGLQANNYVEEKNDAHRAKIAENLKEISVPYGSESDNNFKKVSLNLKKILAAYTTLKDEKLMEISVS

SEQ ID NO: 107922 - protein, 123 aa, Triticum aestivum
  unsure (1)..(123): unsure at all Xaa locations
  Clone ID: PAT_TA_2340.pep
LVXXCRRGHMPNSAXXKQLQXXRATLPASAASRHAGSPPLAPPPAAGLFPLPYIRSNHATSPRQFFEPPVSKCSSPSLPCFRALLLALHFRATRRFLVISAALCESPGTDRAHRLLVQQDEHT

SEQ ID NO: 107923 - protein, 191 aa, Triticum aestivum
  Clone ID: PAT_TA_2341.pep
MSPADAAAAHLTTAPDPDEDICPSPAASAASGAPAAPEEIAPPVPTPLPPPPASAVDAAERAWAHWRRLGSPRLVVAPMVDNSELPFRMLCRRYGADAAYTPMLHSRIFSENEKHRDMEFTTCKEDRPLFVQFCANDPDILLQAAKLVEAHCDYVDLNFGCPQRIAKRGYYGAFLMDNLPLVKSLVQNLSE

SEQ ID NO: 107924 - protein, 114 aa, Triticum aestivum
  Clone ID: PAT_TA_2342.pep
MGFRKGLLACFGPGGGGDEEETEQEARATPGARRRRTVMNLRSLSLEDLSRTLATTTLHAFTLDELKSVTKNFSTANFLGEGGFGPVYKGCVGGALRPGLAAQQVAVKYLDLDS

SEQ ID NO: 107925 - protein, 148 aa, Triticum aestivum
  Clone ID: PAT_TA_2343.pep
AGAVEEATGTDGSGLDRWHAADDTGAAGSRPGAAARPAPAAAGEPPPALPPNLMPLPPPSPPPYPYPPFFFSPPPYRYAAGRRPVVAPPPCRERAAAQAAPEHPGHGDRVGSASAGHRRVPLHRCGCPAPYPKGGLEGPPPVPHVVQS

SEQ ID NO: 107926 - protein, 386 aa, Triticum aestivum
  unsure (1)..(386): unsure at all Xaa locations
  Clone ID: PAT_TA_2344.pep
MAEAPPPXLLYIAVADGGGRRAFRYTRPVLQSTLQLMGCKARHAFKISKRVFSVMRSEFLDASRSDRAVKEENASSLGIGEDAEMLNTDILDATGSSLPFELYKTQTTILVSRERFLNIVCDALSSYKYVGPNQKADLLLACRIKEKKESVTVLLCGTSGCGKSTLSSLLGSRLGITTVVSTDSIRHMMRSFADEKQNPLLYASTYHAGEYLDPVAVAKSKAKKLATVSHTNGGKDGTSDVKSHHGSXDLPPRTELVGSKQMAIEGFKAQSEMVIDSLDRLITSWEEQKQSVIVEGVHLSLNFVMGLMKKHPSIIPFMVYIANEEKHMERFAVRAKYMTLDPAKNRYIKYIRNIRAIQEYLCNRADKHLVPKINNTNVDQSVAAIH

SEQ ID NO: 107927 - protein, 361 aa, Triticum aestivum
  Clone ID: PAT_TA_2345.pep
MGEAVRGSGEECNWSVGRWVYDNASQPLYSGLNCSFIFDEVACEKYGRNDTRYQYWRWQPDGCDLPRFNATKLLEKLRNKRMVFVGDSINRNQWVSMVCMVEASIPEGQKMRVYNGSLISFTAFEYNATIDFYGPPLILESNSDNPIIHRVEYRIIRAEKIEKHARAWGNADVIVFNSYLWWRKQKPDMKMKVMYGSFEDGDAKLDEVEMVEGFEIALKKLTEWVGANVNNKTKIYFAGSSPTHTWASDWGGDDSNKCLNESEPIQKVGYKGATTDYSMMDMAKQIFRPLEQKGINVQILNFTQLTDYRIDAHPTVFRRQFTPLTKEQIANPSSYADCTHWCLPGVPDVWNHFLYSYLVQK

SEQ ID NO: 107928 - protein, 246 aa, Triticum aestivum
  unsure (1)..(246): unsure at all Xaa locations
  Clone ID: PAT_TA_2346.pep
WDSDTASCASPLLLAALLPLPAKASSKLYIVYMGEKKHDDPSMVTASHHDMLTSVFGSKDEALRSIVYSYKHGFSGFAAMLTESQAETIAKFPEVVTVKPNTYHETHTTRSWDFLGLDHDRPRQQPGLLQKSXYGEDVIVGVIDSGIWPESRSFDDTGYGPVPARWRGVCQTGQACNATSCNRKIIGARWYGRGISADVLNRDYKSPRDLAGHGTHVASTIAGSQVRGVSHGGRGLGVARARAPRA

SEQ ID NO: 107929 - protein, 168 aa, Triticum aestivum
  unsure (1)..(168): unsure at all Xaa locations
  Clone ID: PAT_TA_2347.pep
LLKICLGLWFTTHSKLRTILGSGLIREQQVMAWVWNSASCITQFLKAIQFSQQISATIIGITTVMVSMLMISLKTFXLKSHELLEGDDMQQLLRVFNMGGASTGLPDETFSFPXMQSPLPNPDLEGEPSRPSGKAVVGWLKIKAAMRWGIFVRKKAAERRAQIVELED

SEQ ID NO: 107930 - protein, 155 aa, Triticum aestivum
  Clone ID: PAT_TA_2348.pep
MALHWSGGLAVAVAAALAVSALFPAGAAGHPPLPGPLVPQFYEHTCPQMQALVGAIVAKEHAKDPRMAASLLRLHFHDCFVQGCDASVLLDADGSGRFTTEKRSNPNRDSLRGYEVIDEIKAALEHACPHTVSCADIAAVAARDSTVLTGGPGWE

SEQ ID NO: 107931 - protein, 166 aa, Triticum aestivum
  Clone ID: PAT_TA_2349.pep
MAGSSSIPATTVREIRVVQRADGAAAVLAIGTANPHHCVPQGDYPDYYFRVTNSDHLTDLKPTFAKLCGMTGIGRRFFHHTDEMLATHPNLSLDARLDVVATAAPELAASAAAKAIAEWGRPVGDITHLVVSTNAGSHAPGTDVRLVSLLGLSHDVLRTVLQLNGC

SEQ ID NO: 107932 - protein, 404 aa, Triticum aestivum
  unsure (1)..(404): unsure at all Xaa locations
  Clone ID: PAT_TA_2350.pep
EYKESDHVKLASHSSIPATTVREIRVGERADGAAPVRASGTANPRHCVRQRDLPLYHFRVPNSDHPPDHQRPPVRLYGLTGIGRRFFHHTDELLAAHPPMSLDARLDVVATAAPELGASAAPSPVGPXGRAVSDITHLVVSTNAGSHAPGTDVRLVSLLGLRHDVLRTVLQLNGCASGCAALRLAKDLAENNRGARVLVVCVELTITAFRGPDEGDTFDTLIPQGLFGDGAGAVIVGADPNAHERPLFEMVSASQYVIPDTEHMLTMQLGNGGIGGTIATGLPRLAAGIVERCLLDAFGNHLAVIGGVVEWNNLFWAVHPGSSVMLDHIVRALRLAPGKLAASRTVVREYGNMLGATVIFVLDEVRRQREDPQGEGAGHDEGWGVMMGFGPGFTVEAMLLHAAT

SEQ ID NO: 107933 - protein, 84 aa, Triticum aestivum
  unsure (1)..(84): unsure at all Xaa locations
  Clone ID: PAT_TA_2351.pep
FFFFNMSTXEKIECKKLACFRTFRNSVLQIEARREIISGETPCHSSYNTARKQVASNRNKRKETTQTRPTRDQPSRKRVSNRGR

SEQ ID NO: 107934 - protein, 89 aa, Triticum aestivum
  unsure (1)..(89): unsure at all Xaa locations
  Clone ID: PAT_TA_2352.pep
GGIWAXXXNCSLAAQGGVFQFCHQSHICFSVQSDIICCSYIFITLSIHKKRQLKDLSSITNSQSEKKITITAPATTNIHYKKAKQKRNR

SEQ ID NO: 107935 - protein, 129 aa, Triticum aestivum
  Clone ID: PAT_TA_2353.pep
VAATPASARYSQAPLAATPLPAPTPPLSSVFASPAPSPQASTTMAVFALLAPTRFSPAPPGGATSAQRPAHSDVASPTPPHSSARATPGPETSAPTDARPSTPAHTCSSPTPAPATSSPRAGTPSSVTC

SEQ ID NO: 107936 - protein, 292 aa, Triticum aestivum
  Clone ID: PAT_TA_2354.pep
SARVILNEEVWRQIEDMCGMTKAAAVPVIPDSEGTDSNPFSLEALAVFMFRVLQRVNLPGNLDKASPNAGYILLMFYNLYDGKSRREFESELYERFGSLVKMPLLKPERAPLPGDVKTILDEGMSLFRLHQSRHGRVEPSKGSYAQEWAQWEKRLRVVLSRNANYLTSIQVPFDVAVKEVLEQLKAVAKGDVKTPDTAKRRFGNIIFAAVTVPQADILSLLRKLVQNDGDVNNVLNGIKVVDNLSKAYVTLAHKRAHGVAAFASYGVYHNQEVLALFNVLLYTDKKAVLDAH

SEQ ID NO: 107937 - protein, 81 aa, Triticum aestivum
  Clone ID: PAT_TA_2355.pep
TLDLISQSMLNIRELYSLRSDGLGIYFFSVFPVTKAQGGTQGLWTMLSPQGIAMEGRVGPTTMGRPKPKTWKPTAYTRACQ

SEQ ID NO: 107938 - protein, 184 aa, Triticum aestivum
  Clone ID: PAT_TA_2356.pep
KKWFSDHPRYISNPFYLGGSSYAGKMIPVIAQYISQGNEQRRQPEINLKGYLVGNPITGSAFDDFNTKIPYAHGVGIISDQLYEAAMASCDGDYVTSVTKMCAGVLNTIQKLISEVDEGYILDDRCVRAAPKPVKDDPPRSRFLSEEQIQPTESSADPTINCFSYRYYLSNIWANYNRTRDALK

SEQ ID NO: 107939 - protein, 243 aa, Triticum aestivum
  Clone ID: PAT_TA_2357.pep
CPTLIRSSNPETEALRKSSQAYCAQPACAEPSCMIQPSCTAPTTCFGPRFFSKSKKDRKPKPEVVNQVRPWPELMAEPSDARSMSFVGTHEYLAPEIIKGEGHGSAVDWWTFGIFLYELLFGKTPFKGSGNRATLFNVIGQPLRFPEYPVVSFSARDLIRGLLVKEPQQRLGCKRGATEIKQHPFFEGVNWALIRCASPPEVPKPVEIERQTTKLPVSTSEASAAPTGASQKGSDNYLEFDFF

SEQ ID NO: 107940 - protein, 87 aa, Triticum aestivum
  Clone ID: PAT_TA_2358.pep
MREEGLRMAEDAPGTTGRPRRLTRVRTLGRGASGAVVSLFAAGDGDGDELLAVKSAGAVDAQALLRREGGILASLCSPYVLPCLGSR

SEQ ID NO: 107941 - protein, 266 aa, Triticum aestivum
  unsure (1)..(266): unsure at all Xaa locations
  Clone ID: PAT_TA_2359.pep
MAHILGIHSLVLLLLLASSAASTDIVLGQKAGAAVEARPGPGKYAVIMDAGSTGTRVHVFRFDKRMELVDVGGDIEVFATVNPGLSSYAGRPQDAANSIMPLLEKANTAVPRSLMRRTPIKLGATAGLRLIGDEHAEQILEAVRSVVHTKSKFQYNPSWINVLHGSQEGSYLWVALNYLLDKLGGEYAKTVGVIDLGGGSVQMAYAISADAAAAAPVVKDQYVTKEYLKGRDXNVYAHSYLHYGAMAARGEIFKAKNGPVSYCMLR

SEQ ID NO: 107942 - protein, 83 aa, Triticum aestivum
  Clone ID: PAT_TA_2360.pep
PAGTRRPGPTGSTSRLATPPSNTTSTSRTTMKMLQRLLFSSFVYFRLCFALRFGRFLCPKYRCLFFWVNCLSSCKNKWPYVKQ

SEQ ID NO: 107943 - protein, 119 aa, Triticum aestivum
  Clone ID: PAT_TA_2361.pep
KTKYITSINGQVTGIGCNIVARPAGVPGRGGGGSSRVRFVLCRPPAAAASPASGPPAERSAARGLSRLSVRHPATHRTPRRRRRMMPIDAPPCHGHYHGNVRHLPRQPTEPRMIWKYYP

SEQ ID NO: 107944 - protein, 107 aa, Triticum aestivum
  Clone ID: PAT_TA_2362.pep
MARLLLLGFSLLLLTGLRPGRAFLVADPQPDVSDDVPALLAFKKAIYDDPLARLSDWNSSDPDPCLWFGVTCSDFDARVVTLDLSNSSLVGFLATRIGFLTSLQKLK

SEQ ID NO: 107945 - protein, 227 aa, Triticum aestivum
  Clone ID: PAT_TA_2363.pep
VHASAHASARAAAPASLRLEFERTASRRRRFRAKFTCPKICGRLQSDEIPIGSKDGSAVTVAAENIVFHDAAVSEKVTLGSFAGDYDQDDDNAAALGEYLKRPVRLASYAWAQGGGFAQSITPWAAYFSDTFIRRKLENYGKIRCKLHLKFMVNASPFHYGSLRACYFPMGDARSTFVNSADLLPFSQTPGVYIEPQNMTSAELVLPFVWQHNWLEITKLSDFQRMG

SEQ ID NO: 107946 - protein, 315 aa, Triticum aestivum
  unsure (1)..(315): unsure at all Xaa locations
  Clone ID: PAT_TA_2364.pep
MRSWANRPHSSLLASFLAASCLLVAGSPQDLHEASGSRILHQTKPHTHEMHCSRERSRAAWKAVDEYLMPFVEKEKYELPSKCRLRPENDMFREQEQHKIHFDVNEWRCGFCKKSFRAEKFIDQHFANRHNNLLDNTQGRCSAELCEALHCDLTMEFKKPKSKCNAAAAARNRHLCENLADSCFPINQGHSAMPPSXNFPCPCAGLPVRALPAPHRPPAGPRHELSVPPFRAAPSRCGASLPFPKGGRKQTNRFYLALCILTMLLLPVFYLIVFLHQREMKKGDQVFKRIGKTVHKKKPSYVVRSLATHYPSSLR

SEQ ID NO: 107947 - protein, 269 aa, Triticum aestivum
  Clone ID: PAT_TA_2365.pep
ASLGAAYFQDPHDLCECHPDVVLLATSILSAEAVLRSLPLHRLRRSTLFVDVLSVKEFPKNLLLTSLPEGFDILCTHPMFGPESARDGWDGLPFVFDRVRVGDSPARRARANAFLNIFEREGCRMVEMCCAEHDAHAAETQFLTHTVGRMLATLELSSTPINTKGYETLLRLVDNTCSDSFDLYNGLFMYNKNSTDLLNRLESAMDSVKKRLFDGLHEVLRKQLFEGKASPPNTATTGHHADVHRRQLLLEGKPPSPSVPTPNNVTVPK

SEQ ID NO: 107948 - protein, 187 aa, Triticum aestivum
  Clone ID: PAT_TA_2366.pep
MESGRLIFGSAAPCRAAGGGGGQMMLFGGSGSFLGGSPVVAGVEDGRRKRPFLTTVDEELQMDEEMYGYYGLDEHAPERKRRLTAEQVRALERSFEEEKRKLEPERKSELARRLGIAPRQVAVWFQNRRARWKAKQLEQDFDALRAAHDELLAGRDALLADNHRLRSQVTSLTEKLQAKESSELEER

SEQ ID NO: 107949 - protein, 273 aa, Triticum aestivum
  Clone ID: PAT_TA_2367.pep
TRPGTDAVFLSLIRAFSWNPATFLHAYPPLPLAQATRQAATAVLQDIADSGVLFALLMCDHKVISLVGAQKATLHPDDILLLANFILSSESFRTSESFSPICLPRYNPMAFLYAYVHFFDENTYLTLLTPRSDAFFDLKDSRARIQDVLSKSNVLLEVQRSLHENVLRVEDVPIDPTSQSTSAPAQSSQGLNSQPLSSDEAIGGPAGLWHFIYKSVYLDQYVSSEFALPIRNPKQQKRLYKAYQKVYASMHDKATGPHKTQFRRTEDYVMLSW

SEQ ID NO: 107950 - protein, 243 aa, Triticum aestivum
  unsure (1)..(243): unsure at all Xaa locations
  Clone ID: PAT_TA_2368.pep
HVYSMATPTVDGAREVLSYLGCKDATGRDIIQKVVITDLREEVVVYIKGTPFVLRELDQPVDTLKHVGISGPMVENIEARLKEDILSEVKQLEGRLLLHQEEFNTATNQCSVLGYWEHIDLEDVMTPAEVYSTLRDQGYCIDYKRIPLTREREALAADVDSIQSSINESSRYYLFVSHTGYGGXVAYAMAITCLRLGAXXKFVMEQTAETHFVSSSLTKSVPVKTFTDIALRQGDYRDILNLT

SEQ ID NO: 107951 - protein, 339 aa, Triticum aestivum
  unsure (1)..(339): unsure at all Xaa locations
  Clone ID: PAT_TA_2369.pep
MGERKVLNKYYPPDFDPAKIPRRKQPKNKQITVRMMLPMSIRCGTCGTYIYKGTKFNSRKEDCIGETYLGIQLFRFYFKCTRCSAEMTFKTDPQNSDYTVESRGLGAKLVPWRXEDEVVGHNXKEKPGEEGKGHAMGALGNRGIGSKEDHEILAALEEMRSMKSRHCGVFLXQRLEIWNHSAHRKEEKTVAELDEEDEELIKSITFGTPKSXVKQIEDDDEGGDFDDNFGIPGQSSVTLKINGSSESMSNPTDVLTKANGPESNKEGNKSSVASKMPKFIVKPKPAAATANPQKKQKTESTAVQDNGKAPAAEEKIEASEGKKTNVLQSLCQYDSDESD

SEQ ID NO: 107952 - protein, 229 aa, Triticum aestivum
  Clone ID: PAT_TA_2370.pep
HEATIACHVLSATVKGQGYSLPADIQYVDTRWEVPVVLPLRDCLAQELSLLCEFDSLKTQELLDRPCSGINGLVASFVARLREENPSREHTIVRTAQKLKPFPFNKFSANGYHDFLPSRLRPKFQDVDSDESASSEVLCLICRSPFSESELQNFESTRRKSQKKIDLYTAYCCQSCHFQILPGGRDLYDHFFSLIPRFWTERADTASASHSSLRDQIEDYLLEDDDDGN

SEQ ID NO: 107953 - protein, 124 aa, Triticum aestivum
  Clone ID: PAT_TA_2371.pep
SCVRLRKEKLRSHPALRRGVIEGEVELRLGGVGERYMGLPLKIGQPLLMRQWPCFRLSRRSLVVSGITAFTSPRLQYITTPACGHEHVFSTVTLYSGTFRTSRPVNTDETRMSSSWHGPASPLA

SEQ ID NO: 107954 - protein, 112 aa, Triticum aestivum
  unsure (1)..(112): unsure at all Xaa locations
  Clone ID: PAT_TA_2372.pep
CGGGARRSAPPRRAPPPPPPRRLPHPPPPPRPPPRPPAPPPPPPRPAPRPPXAPPPSLGPPPPPPPPPRXGAAAAPPPRCPSKCPGGPGGRCPRPSPEDPLVRSGDEVGRPG

SEQ ID NO: 107955 - protein, 149 aa, Triticum aestivum
  Clone ID: PAT_TA_2373.pep
RGASGVVYKARDRRTGATVAVKRLRGGGFGDHDGSRLSEDLLREAACLEACRGHPSVVELRAAHRDGAGGAFLVMEYVGPSVAQVMRERGRPFPEADARRLMRQLLDGARAMHDLGVLHRDLKPDNVLVDAHGDLKICDFGMSRFAAAT

SEQ ID NO: 107956 - protein, 312 aa, Triticum aestivum
  unsure (1)..(312): unsure at all Xaa locations
  Clone ID: PAT_TA_2374.pep
LGPVRGGHRAQETGFAFKTLPHKAPQRFIAHNNKPPLIAGPQLVTLLTRLGCCSQEEEKILVYEYLPNKSLDFFIFDENKRALLDWTKLAAIIVGAANALLYLPRRSRLLVLHRDLKPSYILLXSEMNPKISDFVGXAKIFSSKXHLKGDITRRVVGTYGXYMAPEYASXGNFXIKSDVFSFGVVILEIXSGKRNSGTQQCGGFLNLLGYAWQVWVEGKWVDLVDASLVSDTHSTKMRGCINIALLCVQEXNAVDRPXTMGDIVSMLSNETMILAEPKQPAYINVRVGNEETSTALESYSINDVSISITSPR

SEQ ID NO: 107957 - protein, 167 aa, Triticum aestivum
  unsure (1)..(167): unsure at all Xaa locations
  Clone ID: PAT_TA_2375.pep
MAHVLAAAEPLTLLKRPPPQNDGFGDDNGSTEEKAPKARRRESDPAVALAAARHEFGEHGGVNMSIEASATFTVMEPDTMRRLFTGELGPERGDLYIYSRHFNPTVLALGRQMAALEGTEAAYCTASGMSAISCVLMQLVGAGGHVVGSCXLFRGPHAXLLSRFLPR

SEQ ID NO: 107958 - protein, 360 aa, Triticum aestivum
  unsure (1)..(360): unsure at all Xaa locations
  Clone ID: PAT_TA_2376.pep
GGSSPGRLDPRALETCRAASSTASGMLVTACVLMQLGGAQAGTWWQSRXLYGGTHALLSRFLPRTSGVQATFVDTDDEAAVRAAXRPGETRLVYVETMSNPTLAVADIPMLARVAHEAGAKLVVDNTFTPVVVSPARLGADVVVHSVSKFISXGGADIIAGAICGPASLVNXMMDLQDGALXLLGPTMNAKVASELAXRLPHLPLRMQEHSRRAAEFAARMRRPGRHVPYVPSPDHPHHARXLRAMGNPGYGAGGMLCLDMGTEERANRLMYHLQNTTQFGLMAVSLGYYDTLMSCSGNSTSSEMDPEDRARAGISPGLIRMSVGYNGTLEQRWTQFERALALMQQQDTPAAAAKYGKAV

SEQ ID NO: 107959 - protein, 166 aa, Triticum aestivum
  unsure (1)..(166): unsure at all Xaa locations
  Clone ID: PAT_TA_2377.pep
HPSSASVRSIWWSRLVDVIVAAGDTPRVVPRPRREWPWGEGATPHMPGCWIEEIVDPGIKGQYCSEAMWRVLEVXTACTRSLPAPRPCMEDIARELEDALIIENNASEYMRSMESTGTFGSNRYLSIDRKMFASGSARIDPAKFASGSGRIDAGKGPLQTMPSLPR

SEQ ID NO: 107960 - protein, 100 aa, Triticum aestivum
  Clone ID: PAT_TA_2378.pep
MQIPTGLPRLQVGPEGNKQIVRSGSSRRVGLIRPNSPKSPFASASTLESAEGSDEDAATKGGGGLDNGHASTNGNLEGEHKGNSLVENGAGTPLYAKNMT

SEQ ID NO: 107961 - protein, 148 aa, Triticum aestivum
  Clone ID: PAT_TA_2379.pep
MASKRILKELKDLQKDPPTSCSAGPSGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRSKYETTARSWTQKYAMG

SEQ ID NO: 107962 - protein, 161 aa, Triticum aestivum
  unsure (1)..(161): unsure at all Xaa locations
  Clone ID: PAT_TA_2380.pep
ILEPCFPLLGQPDCSSPTILLVQLCWAALAVFGLPSLGLPGFPHVTAELVGSGGYLPPEYGQSWVATLRGDIYSFGVVLLELLTGRRPVSVFCTPKELVXWVLQMRSEGKQIEVLDPTLRGTGYEEQMLKVLEAACKCVDHNQFRRPTIMEVVSCLSQYER

SEQ ID NO: 107963 - protein, 497 aa, Triticum aestivum
  Clone ID: PAT_TA_2381.pep
MASPRFKPVEECSSEGRSGQTVAADFDGTLLRSSNAFPYYLLVALEAGSVLRAVALLLSVPFVYVTYIFFSESLAISTLVYISVAGLKVRSIEMAARSVLPKFYAQDVHPESWRVFRSFGKRYIITASPRVMVEPFAREFLGADRVVGTELEVGKSGKATGFMVKPGVLVGEHKKQAVVKELGDAVPDVGMGDRATDFNFMSICMAACLDAYRVSSRVPSPLPLTPLLPPLGRLVQRPTPLVALVTFLWMPFGFALALLRVYINLPLPERIVFYIYHMMGIRLIVKGNPPPPPKKGSPGVLFVCNHRTVLDPIEVAVALGRKVSCVTYSISKFSELISPIKAVALTRERDKDAENIRRLLEEGDLVICPEGTTCREPYLLRFSALFAELTDRIVPVAINTREHMFHGSTVRGFKLMDPYFFFMNPRPVYEVTFLNMLPKELTCGGGKSPIEVANYIQKTLSDQLGFECTTITRKEKYGILAGTDGRVPSKNKEKEKN

SEQ ID NO: 107964 - protein, 191 aa, Triticum aestivum
  Clone ID: PAT_TA_2382.pep
FFLDELALGLEASGMAFLWVVRTDKWSPPERWHERVGGRGMVATAWAPQRAILGHRAVGAFVTHCGWNSVLETVAAGVPVLTWPIVFEQFITERLLTQVLGIRERLWPDGAGVRSTRYEENEVIPAQDVARALTTFMQPGGPGDAARRRVMELAAKVHAAVAEGGSSDRDLHRLIDDLMEAAGAGAGRTTI

SEQ ID NO: 107965 - protein, 266 aa, Triticum aestivum
  Clone ID: PAT_TA_2383.pep
TDNSTVASDGKSPAPEKLKLVSGSCYLPHPAKEATGGEDGHFICIDEQAIGVADGVGGWADHGVDAGLYAKELMSKSMSAIKDEPEGAIDPSRVLEKAFTGTKARGSSTACIITLKEQGLHAVNLVDSGFIVVRDGRTVLKSPSQQGRVNFTYQLESGGGSALPSSADVFHYSVASGDVIIAGTDGLFDNLYDNEITAVVVEALRSGLGAQGTAQKIAALARERAEDKHRQSPFAAAAQEAGYRYYGGKLDDITVVVSYVTSAAAV

SEQ ID NO: 107966 - protein, 148 aa, Triticum aestivum
  unsure (1)..(148): unsure at all Xaa locations
  Clone ID: PAT_TA_2384.pep
MGGRRTTACCLTLVELALHAVNLGDRGFIVVRDGRTVLKSPSQQHDFNFTYQLESGGGSDLPSSADVFHYXNLYDNEITAVVVEALRSGLGAQGTAQKIAALARERAEDKHRQSPFAAAAQEAGYRYYGGKLDDITVVVSYVMSAAAV

SEQ ID NO: 107967 - protein, 118 aa, Triticum aestivum
  Clone ID: PAT_TA_2385.pep
MEIIILISLVVLLVLGALFVIPRSKNKGEGKDARSAGNGTTSTSYSKKEVSTHNTRKDCWIIIKDKVYDVTPYVEEHPGGDAILNNAGGDSTEGFFGPQHGTRVFDIIEDFCIGKLED

SEQ ID NO: 107968 - protein, 87 aa, Triticum aestivum
  unsure (1)..(87): unsure at all Xaa locations
  Clone ID: PAT_TA_2386.pep
MGGHGGLNILPQKRWNVYRFDNQEKVRVDEAEAARQDQLQREATRRRESHARLVALRRNRGLQSDSRLPFPXSPILPPPPSPRPRGI

SEQ ID NO: 107969 - protein, 132 aa, Triticum aestivum
  Clone ID: PAT_TA_2387.pep
EAAAARSKSDAPPSSVQGSARQPEATHHRLHLHELLLRRGQRQPGSSSSLSPDLGLCPEIEGPSLSSEICYPSEAAVLQEQLNVLHVHLTNLNLTNRTFCSVCSEIEHTSSIWKLWCKIVSCLSLMILLKVH

SEQ ID NO: 107970 - protein, 142 aa, Triticum aestivum
  Clone ID: PAT_TA_2388.pep
WGHGAVVEEIHGLIRVYKDGHVERLPAIPDVPCTWGSTAAGSGVLARDVAVDRATGVWARLYAPAAAAGKVPVVVYFHGGGFSVGSAAWSCYHEFVAQLPARAGCAVMSVDYRLAPENRLPAAFDDGLTALRWLRQQAGRNN

SEQ ID NO: 107971 - protein, 201 aa, Triticum aestivum
  unsure (1)..(201): unsure at all Xaa locations
  Clone ID: PAT_TA_2389.pep
MDPVTASIHGHHLPPPFNTRDFHHHLQQQQLHLKSEDDHGGGSPFGGHGTKHGHEDDENSGNGHGSGGELALISPSGGGLQDGGENGSRRPRGRPAGSKNKPKPPIIITRDSANTLRTHVMEVAGGCDISESITAFARRRQRGVCVLSGAGTVTNVTLRQPASXGAVVALHGRFEILSLSGSFLPPPAPPEATGLTVYLAG

SEQ ID NO: 107972 - protein, 138 aa, Triticum aestivum
  Clone ID: PAT_TA_2390.pep
MRVPQMTRVIHDSGEGMQKEFALDMVSSDVNFPKGHFPDYRIGPNNQIIDPEETHEVVPLKEIVEKETTQLLEQRKRLSVRDLREKFEKGLTGASKLSEEAKRREAASLDRQVLLKKLRDVLDTLKGRVAGRNRDDAD

SEQ ID NO: 107973 - protein, 132 aa, Triticum aestivum
  Clone ID: PAT_TA_2391.pep
FDKVALEEDINYGMSSELEKHLQFPDQLLMREYFNSVKIRNLAREAGVILVEEFLPVRNLEEQILPKSLPQNFGQQLLPRNLPQMKKRVKQSLDSTRAYLHRQGATRARGLKYVVGAVSLACIIMAGQRESN

SEQ ID NO: 107974 - protein, 174 aa, Triticum aestivum
  Clone ID: PAT_TA_2392.pep
GVYLVLTSPEVHVENFCGQVCGFHYFTFPSVVGYTLPYAWVGNSAGRCPEVCAYPFAIPAWAPARRPEAPPNGDAGVDGMVSVIAHELAEMASNPLANAWYAGGDPSFPTEIADLCEGIYGTGGGGAYTGQLLTDGRSGAAYNLNGVGGRRFLVQWVWDPYRSYCSGPNALDHQ

SEQ ID NO: 107975 - protein, 224 aa, Triticum aestivum
  unsure (1)..(224): unsure at all Xaa locations
  Clone ID: PAT_TA_2393.pep
CHEAVFRSNEEFKKAISLRELDDVTSLEDKLGRSLTREEKNRIGVSNLRLFLEELLQNRYIESVPSITPLLEKEHRAASRKLRKVTQEISDLDEAKLKEKARLFHDSFLTKLSLLLKGMVVAPPDKFGETLINERINGGTFTGSENFQLPNKMMANAGMRLYGGAQYHRAMAEFRLVVGSIXKCPPITREEIVNACGVEDFHDGTNYSRTACVIAVAKACDTFE

SEQ ID NO: 107976 - protein, 131 aa, Triticum aestivum
  Clone ID: PAT_TA_2394.pep
FELLLVTACGKQCRCTFQSPRFFDPRGVFLIWGVGDIIFPGLLVAFSYRFDRAGKKGILNGYFLWLTVGYAVGLFLTYLALFLMDGHGQPALLYLVPCTLGVIVVLGWIRGELPHLWNYGRRPENSVGEEV

SEQ ID NO: 107977 - protein, 662 aa, Triticum aestivum
  Clone ID: PAT_TA_2395.pep
MPPRRSKGGGGGKPDPEATDAEPVETAVDAMSEDEADDDNSKEESAESGAEDTDGEDSKEEAAETKAEEMDTEHQEEAAETKAEETVAEPEANGADAETKVEAAEANVEAEAAAESDSEREADAGKADPEAEAEETDGENDKQAARADGESGEEAAGSGGEDEEEAAGTDGDNAAEVGGEKVDADSEAEGEGTDAEPDAREESPPPSPPARSRRRKRVVKPDPPTEDDEEEETPLPPRRRRRRKAGERGDSPPPLPDNLRCRRSDGKKWRCSARALPTVSFCEYHYAKASKGKKPPADGEVLAVALQRQKKNKRKGRRRLNLAPESPKATRDLPNGLMTISPGSSGAVGSPVTTKVGVDIPAPLRRCYRSKNAEPVPVGPVKVVPHAMSKAKAAQMSVRRCGLKKVARVVKCKNCENKYFCNSCINKWYSGMSRNDIKIQCPVCRGCCDCKKCTLGQTKGGMQKESPAGQGKLIRIKICNHQFYKLLPLKLDQEQLDELEIEAKIQGTKLSNIRVQVAEDDQSGSLYCNNCKLSVHQVLRSCPRCPFKLCLSCCQKIREGNMSGSTPEDKFTQRLLQQESAHEDGSISCPSIELGGCGDSLLNLIYATPSDDQSEELSSGDELDAPGNDSGVKDAQAHSSPLAESNGSLARLSGGQQESMST

SEQ ID NO: 107978 - protein, 129 aa, Triticum aestivum
  Clone ID: PAT_TA_2396.pep
MEIDRHKRPSIVDIIHDLDQTEKNIENINSYEQDPSPPLDSSSNVVEPVASAPPTTPSPPPFLTQSYIGSSTPCPRPPPKNSPVMTPPPPPPPVPRGGIMELFGTFMHRKAKISGHGQRSLTMNWRQNT

SEQ ID NO: 107979 - protein, 182 aa, Triticum aestivum
  unsure (1)..(182): unsure at all Xaa locations
  Clone ID: PAT_TA_2397.pep
MAEPAAAASTRKLYGYELSSNSVRIAALLNEKGLDYELVVVDDTKSPEFLAINPLGQVPAFQDGDDILFESRAISRYIAAKYRSTGTDLLPATPSAKLEVWLEVESHHFYPAVADLVYELRVSPAMPGRRAXPTLAVVDALARKVADVLDIYDAHLAAGNRYLAGDAFTLADVNHMAQLFAM

SEQ ID NO: 107980 - protein, 120 aa, Triticum aestivum
  Clone ID: PAT_TA_2398.pep
RSCSKKKKKKKKKKKKKKKKKKKKKKKKKKKKKKKRPPKRIKPNRSDGVRSCKYALLYRDLNEINEIMLLFKHQKKKKKKKKKKKKKKKKKKKKKKKKKKKKKKKKKKKKKKGAPQKIKI

SEQ ID NO: 107981 - protein, 61 aa, Triticum aestivum
  Clone ID: PAT_TA_2399.pep
CSCSKKKKKKKKKKKKKKKKKKKKKKKKKKKKKTKKKKKKKKKKKKKKKKKKKRAHKKINK

SEQ ID NO: 107982 - protein, 106 aa, Triticum aestivum
  unsure (1)..(106): unsure at all Xaa locations
  Clone ID: PAT_TA_2400.pep
VMLATHNVKSGQLXXARAQELGIGKGDRNLQFAQLMGMADGLSLGLRNAGFQVSKYLPYGPVEHIIPYLIRRAEENRGLLSASAFDRQLLRKELVRRFKNAVMGRE

SEQ ID NO: 107983 - protein, 492 aa, Triticum aestivum
  unsure (1)..(492): unsure at all Xaa locations
  Clone ID: PAT_TA_2401.pep
RTLRPPPSIAIASRITAGGRRACDGRREVPGGGRAGAAAGSRCPVPSSGASRRGDHVLEFGSTRGRLFTAXEPSTALVRALAPLQSMAAGPLVDVGPGATPSQDVGARAVGRGGAGPGAAPQVGAGWTAVEAEAIEQRRWRAGMGAVLSPASSPPSTSPPRCRRDRGSRVAVYVASALPPGSASVCTSISARIRIALLEKTSDLLRWQHKNPSVHLPWKQHAFPILSDSSPLYLTPSEPAALTAEEERELQLAHDRLLAVGARCAEHDIPLLVDAEYASVQPSIDYFTFVGALACNGGGRPIVHGTVQAYLRDARDRLEAMVRAAEEERVCLGVKIVRGAYLTREARLAESLGVPSPIHGSIQDTHDCYNGCAAFLLERVRRGSASVMLATHNVESGQLAAARAQELGIGKGDRNLQFAQLMGMADGLSLGLRNAGFQVSKYLPYGPVEHIIPYLIRRAEENRGLLSASAFDRQLLRKELVRRFKNAVMGRE

SEQ ID NO: 107984 - protein, 161 aa, Triticum aestivum
  Clone ID: PAT_TA_2402.pep
MRGRNDGGQSKVPVVLFCVMVVCLCLLFLYFSGSNGQAGSAALEYGTKFSRSLGWGSDGDGDDGSDESIFGTGDANDVKLKSFPVCDDRHSELIPCLDRNLIYQMRLKLDLNLMEHYERHCPPPERRFNCLIPPPHGYKVPIKWPKSRDLVWKANIPHTHL

SEQ ID NO: 107985 - protein, 360 aa, Triticum aestivum
  Clone ID: PAT_TA_2403.pep
TRRKPAPVRRRRKRSVIEHYEDDDDDFIVEDEQVKVNRNSRKKARFGRQVAVDRPVPVAEADIWPAIDSDSSEFEFGTSEDEPEGEPVRAAVRKGRKRRGVSGSSSDSEFHVSDKELSDVREEVKTKKRVVLQSSTDSEFHVSDKELSDVREEEVKTKKRVRVLQSSSDSEFHISDKELSDVREEEVKRKKRTCVLQSSSESEFHASDKELGDNRIEEARRKKRLLVSQSSSDSEFHVSDKDVRDLGEAKSLVAQPMLSVSPRRLSFTRNGWDKGKEKKELVDAGKPWCGICLSEDQRTTLQGVLNCCSHYFCFACIMEWSNVESRCPLCKRRFTTITKSSKVDLDLELKKSVIKVEERD

SEQ ID NO: 107986 - protein, 272 aa, Triticum aestivum
  Clone ID: PAT_TA_2404.pep
MHHDPNPFDEGTAGDENPFSNGGGRGGKQQHGFRPTEPVGFGGGGSRGDATVDVPLGNMGDSNGKARELSSWESDLRRREADIKRREESLKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 107987 - protein, 272 aa, Triticum aestivum
  Clone ID: PAT_TA_2405.pep
MHHDPNPFDEGTAGDENPFSNGGGRGGKQQHGFRPTEPVGFGGGGSRGDATVDVPLGNMGDSNGNARELSSWESDLRRPKADIKRPQYFPIIHQDIANEIPANVLKLQYLAFASWLGIVLCLSWNFIAVIVCWIKEGDSKLFFLATIYALLGIPLSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 107988 - protein, 123 aa, Triticum aestivum
  unsure (1)..(123): unsure at all Xaa locations
  Clone ID: PAT_TA_2406.pep
MTSKVANSSGSDNADAKLSPSGLPVREVPGGYGVPFLSPLRDRLDYYYFQGAEEYFRSRIARNGGATVLRVNMPPGPFITADSRVVAFLDARSFSVLLDEAKVDKTDTLXTGTFMPSLALFGG

SEQ ID NO: 107989 - protein, 169 aa, Triticum aestivum
  unsure (1)..(169): unsure at all Xaa locations
  Clone ID: PAT_TA_2407.pep
HRRCPQNSSNKVRYLVTESARRSCISLEEFICDHFLPETPVIISGCIDHWPAMTKWKNIQYLKKIAGDRTVPVEVGKSYVCSEWKQELITFSQFLERMWSTACPSPSTSLAPHPFFVQISPLPVHVRGPHPCAAGPAELHSPNPSFGPHXAGSPSHHVPHLSILLKNRV

SEQ ID NO: 107990 - protein, 165 aa, Triticum aestivum
  Clone ID: PAT_TA_2408.pep
SSSTEVATGPPVHAASAQQQRGGEFEAMDVVQAEPRRGELTMMVTEVLVSGAEEEEEMANSPVAEDEAAEEDEVMVEAAPDHLPHEVEEGAERDRAGMDAAGFSVGKLRVNGVGALCSFGVAAATFCILVLGGRPQQQRQLRDLMAQVQVSPDDEVDHSFLLFVN

SEQ ID NO: 107991 - protein, 613 aa, Triticum aestivum
  unsure (1)..(613): unsure at all Xaa locations
  Clone ID: PAT_TA_2409.pep
VRGRLKGLRSSVAADDRCPACPCAQSPLSPVQLWAVEKLSVLLLLGSVGPRGLGAFVAAAMLTRRILGEENDKAMESPDRDQIDRYITSSVKSAFMKIAHFVEIKADTSHEHVLASLAEETKKLLKIETNIFSPVLSRWHPQAAVLSSXLRNKLYAYKLGTFACSIPEHLTSDVAREPCAXDLWSSNIIRGMASVVGGDCLDTLCRQKLVPXEIEITPGTVVISWVNGQAQRDQPWLQREIGQRTWDPIXPQQRHGGSIVEVYRIIEETADQFFAFKVPMRIGELNSFCRGIDKAFQIYTQLVTQPIVDKEDLVPPVPVLTRYKKELGIKAFVKKEIQEVRPVDERKSSEIVQLTMSKLCVRLNSLYYAISQLGKLEDSISERWAKRQSDKINIRRSMNGKSKGVVSNQKNQFDGSRKEINAAIDRVCEFTGLKVIFWDLQQPFIDNMYKNNVLQARLDTIVEVLDLVLAQLCDVIVEQLRDRVVTGLLQASLDGLVRVILDGGPTRVFSPNDAPLLEEDLEILKEFFISGGDGLPRGTVENLVSRVRPVINLIKQETRVLIDDLREVTQGGKSKFGSDSKTLLRVLCHRNDSEASHYVKKHFKIPSSAPPST

SEQ ID NO: 107992 - protein, 211 aa, Triticum aestivum
  Clone ID: PAT_TA_2410.pep
IAWGTYTRPASRKMTMGGGDNQQLQVVSVLELQAGVVEDQPQPLGGWHAVEATSMLENCKANSTATDGGTSSRIDIPGPATEQNIPKPSDPLHPCPPPQSLPEGVQSVLNTSRVNRKCIGDGDGFTAYEERIAGDTDLRVPPGFESRVEGVGPPGRGVVRGLGSGQALVGLLGGTPAATPAFAPGECGPALGAIYCVGVLAQVLSLKGGFA

SEQ ID NO: 107993 - protein, 93 aa, Triticum aestivum
  Clone ID: PAT_TA_2411.pep
PRNASAAPEILSPSVLDFPSLKLSSPVTPLTGDPFFPSPASSSGDAAERAAIADKGFFFHPSPRGAEPPRLLPLFPVSSPRMAAASATAAPAE

SEQ ID NO: 107994 - protein, 172 aa, Triticum aestivum
  unsure (1)..(172): unsure at all Xaa locations
  Clone ID: PAT_TA_2412.pep
SEANASLEGKLASMXAELKQAYPTRAEEQMNSEKHISELNQDLANLTSKLELILSEKDTVDNKLATLLTDITARDEKMKQMDGHLSQLQLEHAKISAESAIVHESLSELRARVSELEELVEKQNLAISEGAEGKREAIRQLCFTLEHYRSGYQQLREMLQQGHRRPPMLMAA

SEQ ID NO: 107995 - protein, 246 aa, Triticum aestivum
  unsure (1)..(246): unsure at all Xaa locations
  Clone ID: PAT_TA_2413.pep
GTTPHKRPQSQSSFLGRMVFRTSNITVDMDLVRQIEAKYPAFLFKQHLTAFVEGLYGMIRDNVKKELSALLLHAIQVPRIMKASMVRRSFGSSSLRGRSFSNQGSYWLAIVDNLNELLNILRENCVPAIFIRKIFTQIFSFINAQLFNSLLVRHECCSFSNGEYVKQGLAQLEVWCGEVKPEYAGSALHELXHIRQAVGFLVIXKKSRISYDEIVNDLCPVLSVQQLYKICTQLLGWDKYNTESVT

SEQ ID NO: 107996 - protein, 179 aa, Triticum aestivum
  Clone ID: PAT_TA_2414.pep
ASIASGDSNRSTASDREQTSQVRRKRGKIAQGIKVPVTLGPKLSETVKGKLTLGARILQAGGVEKVFRQWVSVDKNERLVRASQCYLSTTAGPIAGMLFVSTERVAFRSDRSLAVAAPDGAKLRVPYKVTIPLRKVRRAVPTENKHKPEQRYIEVVTNDGFEFWFMGFVSYHRSLQHLE

SEQ ID NO: 107997 - protein, 237 aa, Triticum aestivum
  Clone ID: PAT_TA_2415.pep
RLAAAAGPAVAVPALAAAGLSALHPLPAAPPAPSRPAPLPAPPAPPAAGSARAVAPGGGRPCWSGSRGLRSSPAGAPSRRPPLALAPPAPPPPARGRGRGLVAAARGTGEGGRAPAAGGARPRPRPPGPAGPRLVPEDDMDTPSFLFESVEQGLEGTTNPGRCASGRAPPPPGAPAEASFPTVVVRQPPVPPPRIMDDPMQVPRSIMEGWHPQEIDQLPEAFSGGWVGFFSYDTVRY

SEQ ID NO: 107998 - protein, 290 aa, Triticum aestivum
  unsure (1)..(290): unsure at all Xaa locations
  Clone ID: PAT_TA_2416.pep
VAVASSAFIGASFILKKIGLMRAGKCGVRAGGGGYTYLLEPLWWAGLLPVLLGEVANFVAYVFAPAVLVTPLGALSIIVSSVLAHFVLKERLNKLGVLGCISCIVGSVVVVLHAPEEHMPDSVEEIWDLATQPGFLAYAGTTLLLMAIVVVFIEPRYGQKNILIYLGICSSMGSLTVVSIKAVGVAIKLTLDGMNQLAYPHTWLFIPGPQLSVXSQLNYLKQGTGYFDLTMVSPIYXXMFNNLTIVAIQIKFKXDGAGTNLXSTASXECCXXVTTLPGNNLPHAXKAKRN

SEQ ID NO: 107999 - protein, 238 aa, Triticum aestivum
  unsure (1)..(238): unsure at all Xaa locations
  Clone ID: PAT_TA_2417.pep
NIMFSPFYLVPRPPSRPPDQLTRQIPLLRHMEFAACYFMAGSFRANPYETCTTSQQYKHLAYVISFLPYYWRAMQCLRRYIEEHDINQLANAGKYVSAMVAAAVRFKYNVTPTPFWMWMVLISSSGATVYQLYWDFVKDWGFFTPKSKNLWLRDDLILKNKFTYYISMMLNLXVLRLAWAQSVMKIPYSXNETRLLDFSLASLEIIRRGHWNFYRLENEHLNNVGKFRAVKTVPIAIS

SEQ ID NO: 108000 - protein, 279 aa, Triticum aestivum
  unsure (1)..(279): unsure at all Xaa locations
  Clone ID: PAT_TA_2418.pep
RWHTSRPSPSSCSPACGLASSEVRCPPVTTHGRPTHSWKVGPSRRPAKLEPPTANADKPPELGIRDNGSIQSEKKKRHAKAPPKHHGPGKHAPPADPSPPAPDPDGGQPPGVPVPGGPPRPPXPACPFPCPPPPPGPLPPPLPPFPCRPPPPPAPPRPAPGQQWPPPPPRPQPAPRCHCPPLPAWPEPGPGEQWPPFPAWPQPEPGKQWPPFPAWPQPEPGKQWLPFPAWPQPEPGKQWPPFPFYPPPMPSWQWPPSPSFHGEEEEHASRLAPPVPAHN

SEQ ID NO: 108001 - protein, 230 aa, Triticum aestivum
  Clone ID: PAT_TA_2419.pep
FAFLASFILSCSSNSFFCLPASRGNATGAAWGGSWCAGASTASAWFRAPPGKAGLRAGLSRAPRAAAAVAGAIYSDQDCKVRTVRGGRCHESQVLRWREAAGCSTGSVAVGGSGCWLRRSGCGSSPCTRGPGPHSCRTPAPTSPSSSRLTRLGCDSRRRICCGSTGAAPGECGGGESDYGREGGREGGVVAAAPASGRNPAGLADGRIRRAATGIVTNPRGSPGEARRTR

SEQ ID NO: 108002 - protein, 205 aa, Triticum aestivum
  Clone ID: PAT_TA_2420.pep
MVGAAEGKLALGDMRVLKPLAHLLVGLVLYWVAEEMTVPVLVDVTTAALCPGDGSTSCPEAIYLTGLHQTVGGIFRAVGFTLMGQLADEYGRKPLLILAAGTSIIPYSVLALSSTKVAVYVYLVTRTLSFMIGQGTITCLALAYTADLVEPSKRAFAFGCMTGILSASHSLGNVFSRFLPEHWIFQVSVLLLVCSVVYMKICLVE

SEQ ID NO: 108003 - protein, 341 aa, Triticum aestivum
  unsure (1)..(341): unsure at all Xaa locations
  Clone ID: PAT_TA_2421.pep
MTAGLQLGVIGSLALSVASSVAIVICNKALTNTLGFPIATTLTSWQLKVNYCTLHVAQSLHFFEXKAIDGHTMLLFVGXLNGTPIGLFNRSYQALSYGLSSWTRLPISPCSRPLATCVRPFWPRQPIKLSLMVLLLGVGIASVTDLELNLLGSVLSGLAIGTTCVGQILTNTIQKKLKVSSTQLLYQSAPYQAAILFATGPFVDRLLTNRSVFAHKYTTPVVGFIILSCLIAVSVNFSTFLVIGTTSPVTYQVLGHLKTCLVLSFGYTLLHDPFTMKNILGILVAIFGMALYSFFSVRESKKKSTNDALPVSQMPDKETEPLLATKDGSDIKKANGVSHGC

SEQ ID NO: 108004 - protein, 69 aa, Triticum aestivum
  Clone ID: PAT_TA_2422.pep
YISHVDGSHPAPCCAVQVYKHAFMHHRPIDGRPHQHRPVACSHACADTGELNLHGCRRWRPTGPCPTRP

SEQ ID NO: 108005 - protein, 240 aa, Triticum aestivum
  unsure (1)..(240): unsure at all Xaa locations
  Clone ID: PAT_TA_2423.pep
RRPRPRRAPARGPCSRAHRPVPAAPCPAGPGPPRPPGGAPGASVPGSSPGRACVPARAPPPPAPAPRADAPPAAWTARHPSPRSGFGDPVPPSKRVRGVRFLDYDGTLSPIVDDPDAAFMHRPLRMPVLHVRQALPGGAQPAGPRPDSVRELAKLAELYYAGSHGMDILRPRPXASTVQGPARSFSFQPRKASFLPLVEAVRRRLAGLSXHRAAAALEANGACGSVHSRCVDEKSWGALA

SEQ ID NO: 108006 - protein, 188 aa, Triticum aestivum
  unsure (1)..(188): unsure at all Xaa locations
  Clone ID: PAT_TA_2424.pep
MSQNRCRKLTGARTTNPPQHSAGGFQIRLALGALKSTGKKKKNKKKSSGRAGAMVAQNQRTPGDQVFWPKVVLKKWLNLRSKDAKFNADEDDGDDDGEQEESCGCDGAEAEREAGGVDIAEESLDAAPYKLRRRNSETMRAQYISTKELRICIGTYNAAGIEPPEGLDMXXWLGTTGGEQADWYVFGF

SEQ ID NO: 108007 - protein, 281 aa, Triticum aestivum
  unsure (1)..(281): unsure at all Xaa locations
  Clone ID: PAT_TA_2425.pep
MAIAPIMENIQRARSPPTSPLRDPPPPVRGGGGGQREESHLMGLRKRRSSFPGKSQPASSASAGSASPPTRSAPSPAAPFAGGPLKRWWDWVPGXLRSTKLGFAGDLEMNDEGPAAPGRPSPGTRPHVLYKARSGVRRLVASDHSAAHHPPPQGLAAPLLLRAPALQAPRPSSAYTLEFQLRPSNGALSSCFALVLGGVREIPNRHDDGKELEEGEIKSQRFGDGPYTIISGEFRLLFTVLLPFCGSNSLRIITSVSGGLQSLSLGALMLWILSFALRNKN

SEQ ID NO: 108008 - protein, 202 aa, Triticum aestivum
  unsure (1)..(202): unsure at all Xaa locations
  Clone ID: PAT_TA_2426.pep
MFRNQYDTDVTTWSPQGRLFQVEYAMEAVKQGSACVGLRSATHAVLAAANKSANELSSHXRKVFRVADHAGVAXAGLTADGRVLSRFLRNECINHAFVYDAPLPVSRLALRLADKAQVCTQRSWKRSYGVGLLVALLDESGAHLYYNCPRGNYFXEYQAFAIPSRSQAAMTYLERRFDEIQRLHPGRAHQGCALSHKGDPPR

SEQ ID NO: 108009 - protein, 84 aa, Triticum aestivum
  Clone ID: PAT_TA_2427.pep
MLPGGPPLPAGAARSARPCPCPPPAPPTRSTAWGSHRQFSALLSSAVLEWVLILLMLLEGLLSRLATAFARLCNLPPPCPACAR

SEQ ID NO: 108010 - protein, 383 aa, Triticum aestivum
  Clone ID: PAT_TA_2428.pep
VPPVLTSPRHDAIALHRAFKGSGCDSTTVINILAHRDAAQRALIMQEYRAIYHQDLYHRLSTELSGNHKKAMLLWVLDPVGRDAAILNQSLNGDITDLRAATEVICSRTPSQLQIMKQTYRARFGCYLEQDITERTYGDHHKLLLAYLGIPRYEGPEVDPAAAARDARELYRAGEKRLGTDERAFIRVFTERSWAHLAAVAGAYHHLYARSLEKAVKSETSGTFEFGLLTILRCAESPARYFAKALHKAMKGLGTSDTTLIRVVVTRAEVDMQYIKAEYHKKYKRSLADAIHSETSGNYRPLPPPRPRRARHEALPVPRSRRHMVVRTAKTALRDRLVGQSTCVYTSVSSIQVAKKPGLNAMATAQYVHVTTEMKLATTVFIY

SEQ ID NO: 108011 - protein, 106 aa, Triticum aestivum
  Clone ID: PAT_TA_2429.pep
KLMASLPYTGQSQSPPPYFDLSLFRYCEKLFSAIDRHRHCTEHPIKFISVRQPNVVKFKIKPGSDSGASDSRGKRISSLFHPFFPLALSIQQTNMQPTVVNVHFRR

SEQ ID NO: 108012 - protein, 117 aa, Triticum aestivum
  Clone ID: PAT_TA_2430.pep
ATPAYGAEHEEDPHTASSSHGAGMEAEPHTATLSYGSEHEEDPHKATMSYVLEHEEVPLQCHMGSGNEEDPHKATMSYGSEHGEDPHKATMSSGLEHEEDPHKATMAYCPEHEEDPQ

SEQ ID NO: 108013 - protein, 144 aa, Triticum aestivum
  Clone ID: PAT_TA_2431.pep
VSFSRRWRSRIMCRTPRLLSAGRGGCWCWCCGRCSSSVAGPIPAQHAHHPPVGVDPVPRPAPRRARKLQPDAAVLPERALAGHLRQRLRERRNEVGEGQVRRAGDAAAGEEVGVVVEVVGVHLHLRRSRRPARFAPPLCVDELQ

SEQ ID NO: 108014 - protein, 215 aa, Triticum aestivum
  Clone ID: PAT_TA_2432.pep
HLKFAIQSQEFFRTLQRYYSNAYMDAYKQAAINLFLGYHRREQEKFAPWESESVAGENVLDDKTSQLIKRARSDGSILRKSNTSLSSNGPNGISTPGFGASENELQPPNCRSGSVHDAVSKLRYTPTVPHTKYTSCELDYGNFSGDSNFLDLDWLSASDNGSLSRSRAVSTPNVNDNGARGVTPGITEGDLAEIHAQGLSHNFLQWVDEGEAFWY

SEQ ID NO: 108015 - protein, 92 aa, Triticum aestivum
  Clone ID: PAT_TA_2433.pep
MNSHSTMVVPSVFAAFDKDGDRKVSVSELRCCMAASLGEDISEEEAAVVLAAADADGDGLLNQEEFSRLAAGAHEEDDVRRRCLREAFGMYA

SEQ ID NO: 108016 - protein, 125 aa, Triticum aestivum
  Clone ID: PAT_TA_2434.pep
SPPLPPSSGYRPSTPGGTRRGTTAAGGTGGGTPSTPRGSPRPGGPFRSEPNSPPAAAAARPRLSFDRSPRSADAKPVAERRVPKIGTPPPDQKQLRREIELQSRLESAHEDLKKAKDQLSFVVGE

SEQ ID NO: 108017 - protein, 150 aa, Triticum aestivum
  Clone ID: PAT_TA_2435.pep
THTHTHTHTHTHTHTHTHTYIYIYIYIYIYIYIYTQKSTYTYPSMQSVLRTKACISQACSWLGFFASNVMATSGHVSRAAPAAILRPRYRMVIVDRRPLSRRCHLHYSPTRPATRPRARRHGASVNHYHGKDKQRKKLHRAAGRETLEVV

SEQ ID NO: 108018 - protein, 156 aa, Triticum aestivum
  Clone ID: PAT_TA_2436.pep
GASGGQCGYDSDAEAFACVCADGSSRPARCDGKKSSNKVILIASVSATACLILLVCLVMALKFHRQIRSMSFVSNIMDKNIKADNANVEKLLKLYGSLAPRRYRYSELKKMTSDFKHKLGEGGYGAVFLGTLGDRRAVAVKFLHHSRPNGEDFLNE

SEQ ID NO: 108019 - protein, 148 aa, Triticum aestivum
  Clone ID: PAT_TA_2437.pep
MFSPQPPLRVASRVRSPPLSFRPPARAAGRRGDGSGGWLLLYIVVVGLVFGFPLWVSGHVPYRSVPLMPARGIGRPSVLFFLAMVAWCYWWQGRSASASSLIISQLSGCWSYEAFGAGLISLLRHGGGAEELVAVLGGRRSGGPGDVV

SEQ ID NO: 108020 - protein, 144 aa, Triticum aestivum
  Clone ID: PAT_TA_2438.pep
APAPGRRRRGAASGRRRRASPRAPLPRRGGRAAAPRGRRGASPAAPLPGRQGHQAAPPERRRASPPAPLPGRQGHQAAPPERRRASPPAPLPGRQGHQVAPPERRRARDWSPRSRGCPGRDGAGDRGRGRRRRSSPPPPRPRRC

SEQ ID NO: 108021 - protein, 264 aa, Triticum aestivum
  Clone ID: PAT_TA_2439.pep
ARAMATNIPTSDIEVTTSSEERKSMLKLAERMVASFCGGVTASVAHQWTTLSGSGAEDVRVMTRKSVDDPGRPPGIVLNAATSFWLPVPPKRVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHAAAGATGTGGSLLTVAFQILVDSVPTGKLSLGSVATVNSLIACTVERIKTAVISNGGASPPQ

SEQ ID NO: 108022 - protein, 226 aa, Triticum aestivum
  unsure (1)..(226): unsure at all Xaa locations
  Clone ID: PAT_TA_2440.pep
SKRHAENASSSNPRPFKTESPRKHGIFSHQNSCKKSNKGNLKPPNNAPVKGVQAVKSSMTLSRSYSLGSLPTPPAPVPSPRGPLSKQLSFNNSKSEPKVKQLAEGVASKLKPVKHSPIDVREKGPMRKLMKSESFKREGSVSKDSXSLIQNKSSLLSRDEKPRMLKLMSDKSFLERRPSFILQKPPLSPRPDSSVKSGDRKVDQDNPRPGPSILNTSKKPGNIEKK

SEQ ID NO: 108023 - protein, 165 aa, Triticum aestivum
  Clone ID: PAT_TA_2441.pep
YASWLYEYRGWDSKIANPKHRRFTWGLRTAERHAVDFYISDFQSGLRALVRTGSGARVTPYVDESVVIDVNPENKDMSPEFLRWLRERNLSSDGRKMRLKEGYIKEGSTVSVMGVVQKNESVLMIVPPSEPISSGCQWGSCFFPANLEGLVVRCEDTSDMDVIPV

SEQ ID NO: 108024 - protein, 193 aa, Triticum aestivum
  Clone ID: PAT_TA_2442.pep
MAEDHGSSRHMSSMSMSHKELGDDDARVVHVGDAERTNERLQFAGNAVRTAKYSPLTFLPRNLFEQFHRLAYVYFLVIAVLNQLPQLAVFGRGASVMPLAFVLAVTAVKDAYEDWRRHRSDRAENNRIAAVLSPGVGAQFVPIEWKHVRVGDVVRVGANESPPADMVLLATSDTTGVAYVQTLNLDGESNLKT

SEQ ID NO: 108025 - protein, 253 aa, Triticum aestivum
  Clone ID: PAT_TA_2443.pep
MEATTATKRLMGLCCCLSGVLLLSFLLPGALAEERFYEFVVQETVVKRLCRTNRIITVNGQFPGPTIEVHNGDTLAIRAVNLAQYNVTLHWHGLRQLRNGWADGPEFVTQCPIRPGSSYTYRYTIQEQEGTLWWHAHSSWLRATVHGALIILPKRGMPYPFPKPDKEFPVVLAEWWRRDPIAVLRQSMVTGAPPNVSDTILINGQPGDFLPCSSQETSIIPVVAGETNLPRIINAAMNSELFVSLAGHKMTGG

SEQ ID NO: 108026 - protein, 93 aa, Triticum aestivum
  Clone ID: PAT_TA_2444.pep
HAPSPGRRSPPRLQHLTTPAAYLRHPSTARSAIRGCLAPLFTETGEGNSSLQTPAVMVRMKISGTSLATVTMPTQEDEATPRHHILVPNNECL

SEQ ID NO: 108027 - protein, 267 aa, Triticum aestivum
  unsure (1)..(267): unsure at all Xaa locations
  Clone ID: PAT_TA_2445.pep
RADGYGYEKTTEVDGDGIYKVFDLKNYSFLYSIPDTNVQEIKISPGIMLLIYDRTPSYVPLRILSIEDGKPLKLFKHLLHRGKKIDFIEQFNEKLLVKQEDENLQILDVRSSELIEISXRSFMTPSAFIFLYENNLFLTFRHRTVAVWLFRGELVTSFEAPSLCLQDCSTLYMTFRNRTVAVWNFRGELVTSFEDPAPWHGASSTSDIKTGTGQAQIAANGPADGVAARGTATPTGSVMYTDTCSERRTRNEIYTGNSQGLVHVWSS

SEQ ID NO: 108028 - protein, 225 aa, Triticum aestivum
  Clone ID: PAT_TA_2446.pep
GALSDWLHGGGATLVWKQRVQAAFDVADGLNYLHHSSNPPCVHKNLKSSNVLLDADLRAKVSSFALARSVPTGVDGGDAQLTRHVVGTQGYLAPEYLEHGLITPKLDVSAACGTPLELLSGKEATFDGGAKRGETLLWESAEGLVVDGEDARGKVRAFMDPRLSGDCPLHRAVAVASLAGPCPAREPGGRPSMDEVFVTLSAVYNSTLDWDPSDYSNSRSSIVGR

SEQ ID NO: 108029 - protein, 165 aa, Triticum aestivum
  Clone ID: PAT_TA_2447.pep
KRPVPCHSHDITVVRHPPSDPSTRSRPCSLSACGAAPLALLLDDAGLVQVASDRWRRHQRCREGAASGGRPAPLPSFHQTPPTSSPLPPSTSSPQPTPPTNYAVFPSPGASSLDPVAGRPLTSPPLPGDWRGRIQIHSIVEPRLFSSPVNMEVRRVQPPRRRPEH

SEQ ID NO: 108030 - protein, 138 aa, Triticum aestivum
  Clone ID: PAT_TA_2448.pep
WRPREDGANDAEPEHAFYAPLPLPLPRGRRRAGARVLRPSPSPSLSREASARAEARRGAGGRIWGGGSSSGDPPPPPSPPGFVSGAGAPGRLVFDPAPPNQRGSRADPRPASVAALAPEFSLIRWIDHYIILVLHPHA

SEQ ID NO: 108031 - protein, 138 aa, Triticum aestivum
  Clone ID: PAT_TA_2449.pep
FSVFPVFRSRSNTNTNTVASPPAAEGILSPLLPRRRAGPRRVNRDGALEPPSSRAMEDRGGSCGGGGARRVGDYVLLRPIGSGAYSQVWLGKHVARCTEVAVKEIAMDRLSAKLRDSLLSEVDILRRITHSNIIALHD

SEQ ID NO: 108032 - protein, 68 aa, Triticum aestivum
  Clone ID: PAT_TA_2450.pep
KHGEEEEDEQASKGRCNGVRVPLQQLQQQQGEEASAQERPAQAADRQDSRQPRGAGRQERFQLQKMMA

SEQ ID NO: 108033 - protein, 108 aa, Triticum aestivum
  Clone ID: PAT_TA_2451.pep
MSSSPPASTVADAAAVGHPSQLAISNGVLLAAVIFLFMVVVFVFLLYLYAKRFLGANPMLNGAGATSSRFIFVGDSPFPRRGLPASVLRTLPVAVYGGGASPKTPGGG

SEQ ID NO: 108034 - protein, 145 aa, Triticum aestivum
  unsure (1)..(145): unsure at all Xaa locations
  Clone ID: PAT_TA_2452.pep
VDKYFRCLLGVPLSLVLLLRAVALSIMAGGLLPDVPPWQRHILCVAWSTLWVPCLPXXAAPPASPACVSAFRPPPLAHTSALVSASEDWTWSVGCNPLSISSKGWRLSEFQXDVIARNYIYYWSGRNPYQVVNSAIQRFGNRGHP

SEQ ID NO: 108035 - protein, 267 aa, Triticum aestivum
  Clone ID: PAT_TA_2453.pep
MLAVRCAGGGGGAAGAGAYLTAQRTTAARSGAFNGRSALLAAGTGARELSLRVSLSPNSHPHRVGASCPWPVRCSPCPSPDMEVPRVSKKKTRNEEWEALKTEFGRMFRPQLRNLGELFSLRRVYDIEDYQLGILFGAFLGCVGCYQLWKTAPSIFVDAVLAFVFYKLSVVSSELHRSHKSNSLITRLKFGTILIMVWKDIKKNYVLLDVIRMPVLLLYICAFLFDVAGVKKYGRQGLVYFVNLLKTRGGIQRDIQDYVVAWLCLSL

SEQ ID NO: 108036 - protein, 251 aa, Triticum aestivum
  Clone ID: PAT_TA_2454.pep
RRCRNPFSARNLYFTPPCMWRSVKSCCITGVSALADRTAAGRSFGMFKNYHIDGNKEMIAIGTMNILGSFTSCYLTTGPFSRSAVNYNAGCKTAMSNVIMSLAVMVTLLFLTPLFHYTPLVVLSAIIMSAMLGLIDFPAAVHLWHVDKVDFCVCAGAYLGVVFGSVGSGLAGGTSMLDELKKTLDRRGIQIVLANPGSEIMKKLDSSKVLELIGHEWIFPTVGEAVAECDFVLHSHKPGMVVDGASHENMV

SEQ ID NO: 108037 - protein, 118 aa, Triticum aestivum
  Clone ID: PAT_TA_2455.pep
MHPLVGALLVGAGERWWWPCWGPAARHAAAWAGALALAVSVASFAPEAAFVWALAGGGCAAGSVRVPLDGGGDHVCVPARMAGRTCADIIVPPAFAALSVGASACFVRAIAVGRRHGY

SEQ ID NO: 108038 - protein, 210 aa, Triticum aestivum
  Clone ID: PAT_TA_2456.pep
LLPYVTLIIGPAYDAHACVVLPPSAILEMENQSILTNQAALTLTTLICAMGTGINGSMALVAERHDMSAWVIGLDTRLFTVVYSGVVCSGVAFFVQGIVTETRGPVFVTAFQPLCMIITAVLGSVILKEETTLGSVIGAAIIVLGLYSLIWGKSNDIIDKPVHSVAEKLALPLTSVNGNGTNGTNGGRHVNGGQVAHDVETPAVKGAICH

SEQ ID NO: 108039 - protein, 101 aa, Triticum aestivum
  Clone ID: PAT_TA_2457.pep
PWYKTARLIMDQREYDIPVTGDNLFMVCRTYFVFPCSKYHHMRPIMDTSRSHNHRRNHRLGCLCRYPCIPSRCSKHLWRRAHPARRRRARPGSRTGKRRSS

SEQ ID NO: 108040 - protein, 306 aa, Triticum aestivum
  unsure (1)..(306): unsure at all Xaa locations
  Clone ID: PAT_TA_2458.pep
YGKEKVVTSLSHVPSVCSKLVTGITEDPAIQNIDQLNGVNQLDVVDYIEXDIYKFYKVAENECRAKDYMDSQVEINAKMRGILIDWILEVHQKFDLMPESLYLTVYIIDMYLSLQTVLRRELQLVGVSALLIACKCXVASPAEVLAVVLLSDSAVSREQILKMEKAILNMLEWXNLTVPTPYVFLVRFAKAASSSDQKNDKEMENTVFFFAELALLQYGLVQSKPSMVAAAAVYAARLTLKKTPLWTDTLKHHTGFTEAQLMEAAKILVASHSTAPDSKLKVVYKKYSSEKLGGVALRPPATDFCK

SEQ ID NO: 108041 - protein, 172 aa, Triticum aestivum
  Clone ID: PAT_TA_2459.pep
LVPNSARAVVFADKGGDHRAASGVYFIPALTSSVVSVGQLDEGWFDIGIRRGVLTVHDQQKRLLIEVTRSPNRLYKFFFQPVHPVCLAVGHVSDAWRWHARLGHQHFDGLRKMARGNLRSWATSLEPPDDCVMHCRGTRLCRFPTYRRRNPGLNGTLRPITRQRKPTPAPSL

SEQ ID NO: 108042 - protein, 283 aa, Triticum aestivum
  unsure (1)..(283): unsure at all Xaa locations
  Clone ID: PAT_TA_2460.pep
MERVRRASHAGSWYTNNXPGKLEEELDGWLSAAALTKSPDVRAVIAPHAGYSYSGRCAAYAFGNIDPTNISRVFLLGPSHHYYTPKCALSRATVYSTPIGDLPVDLEVIEELKATGKFEFMDLNVDEAEHSMEMHLXPYLSKVFQGHNVKVVPILVGAVNSQNEAMYGQLLAKYVDDLTNFISVSSDFCLLGISXSYTYYDYKLGSIHYSNKEFARFSLKNIENGDRDEFKQYLEQYXSTICGRHTISALLHTIKHWSTKISXDFARYKQSSQFMTTSNSSGR

SEQ ID NO: 108043 - protein, 178 aa, Triticum aestivum
  Clone ID: PAT_TA_2461.pep
MDPSDVEMEPAEHPSQPQPQQPPPPPQPAAAGDGWSMLSRARGLLQEGQPSLALQAVLLAIRSQGGEQALIQTLNRARDLYRQRSQPAPNIDELASLLAQCAIARGFNDIKSLIPLAPGSDPVTTLKSDEACILAECGRKQLLHFLDMDGSSFICLKCGGLFSTSRKDEHLAYWCGAA

SEQ ID NO: 108044 - protein, 192 aa, Triticum aestivum
  Clone ID: PAT_TA_2462.pep
HASAHASEWVPAYVKDAFWAGISTVRRSERLEAFFDGYITPETTIKIFIEQFDTAMKLRSDREAYDDFRSFQQRPQALSGLLFEEQFANAYTINIFQKFQDQLKQLMNVTCTEVSRNGSIVTYTVTVIGKERKFDYRVMYNSAEKEVWCICRSFQFKGILCSHALAVLKQELVMLIPSKYILDRWRKDYKCP

SEQ ID NO: 108045 - protein, 260 aa, Triticum aestivum
  unsure (1)..(260): unsure at all Xaa locations
  Clone ID: PAT_TA_2463.pep
MASRLGVVLALAAVVLLAAAGAAAGQSTPRPPNAQGPKPKPKPMKVKCTENRKENPYCFNRNMDCPANCPQSCYPDCNSCKPVCVCNTPGACGDPRFIGGDGNAFYFHGRRDADFCVVSDRDLHINAHFIGKSGHSGMSRDFTWIQAIAVLFDGHRLYLGARKTGTWDDAVEHLEIILDGEPVYLXPTWVEGAKWTSSRVPELSVTRTKGANGVLVALHGXXSVRANAVPINEXDSRVHRYXVTADDARALQLGLSTLND

SEQ ID NO: 108046 - protein, 362 aa, Triticum aestivum
  Clone ID: PAT_TA_2464.pep
MSTKETRLKEVNSVGMKDWANIQTDIVGLIIKKLGIPDYIRFRAVCTSWNHICKEVSNHPRVDPWLMLPTKPLDGAKFFSLPEKKTQTIHIPSVATIFGSMWTPVGSSHGWLIFFSPPQGTIQLVNPISSTSFQLPSIGRRHMSKAMLLDMSESNFTVAVIHRDQKGYQVTRKGSKSWSFVDSKHILVDVFKHRRQLYTIDVYGTGPGGPAPPRSWPDDDFPQVEPHMHNLVHYQHQKFNCLVETPSGDLIRVKRQSQNKFALWVLDRETSSFERTSDIGEFGLFVSHYSSFCFPAKDHPYLKANCVYFIDGYNNMCAFNLEHGTKELVEALEAAAPAQSQQDFYGRQPRAEPFLWLIPSLK

SEQ ID NO: 108047 - protein, 232 aa, Triticum aestivum
  unsure (1)..(232): unsure at all Xaa locations
  Clone ID: PAT_TA_2465.pep
RSCSLPSFASFSVANRTIMALWKARSLSSESKVQIAEEQSQNNTLQSEDSGIFVGVDDSKSLQMSEVFSSTISANMNSLLEVFEGGSLEMKVMEKVGCLKYSATQWESDKPDEYQRQIHYKFSRKLSPVGGEVTGTQLKSPMPNKKGWIIEEVMELQGVLLGDFFTLHIKYQIEDLAPKQKACSVQVXLGIEWXKDTKHQKRTRRMSFSSSARLKEFSLHQALCTQIGHRDM

SEQ ID NO: 108048 - protein, 174 aa, Triticum aestivum
  unsure (1)..(174): unsure at all Xaa locations
  Clone ID: PAT_TA_2466.pep
VTISAEWFPGQPRPAHLDGSSPGDFGFXPPGVLVPEALGLGNWVKAQEWAALPDGQATYLGNPVPWGNLPTILAIEFLAIAFAEQQRTMEKDPEKKKYPGGAFDPLGFSKDPAKFEELKLKEIKNGRLAMLAFVGFCRQQSXGTGPLENLATHLADPWHNNIGDIVIPRNIYGP

SEQ ID NO: 108049 - protein, 112 aa, Triticum aestivum
  unsure (1)..(112): unsure at all Xaa locations
  Clone ID: PAT_TA_2467.pep
PWGNLPTILAIXFLAIAFAGEQRTMEKDPGKKKYPGGAFDPLGFSXDPAKFEELKLKEIKNGRLAMLAFVGFCVQQSAYPGTGPLENLATHLADPWHNNIGDIVIPRNIYGP

SEQ ID NO: 108050 - protein, 173 aa, Triticum aestivum
  Clone ID: PAT_TA_2468.pep
MAMASSSGLRSCSAVGVPSLLAPSSRSGRSGLPFCAYATTSGRVTMSAEWFPGQPRPAHLDGSSPGDFGFDPLGLATVPENFERFKESEIYHCRWAMLCVPGVLVPEALGLGNWVKAQEWAALPDGQATYLGNPVPWGNLPTILAIEFLATHLADPWHNNIGDIVIPRNIYGP

SEQ ID NO: 108051 - protein, 256 aa, Triticum aestivum
  unsure (1)..(256): unsure at all Xaa locations
  Clone ID: PAT_TA_2469.pep
MAMASSSGLRSCSAVGVPSLLAPSSRSGRSGLPFCAYATTSGRAXMSAESGSPATPRPAHLAPPPRHGTLSGSTPWGLATVPENFGAVQGSSEIYHWPRGRALAWLGLLGAGMALGTGXTWVKAQEVGRPLPDRAATYLGNPVPWGNLPXTILAIEFLAIAFAEQQRTMEKDPEKKKYPGGAFDPLGFSKDPAKFEELKLKEIKNGRLAMLAFVGFCVQQSAYPGTGPLENLATHLADPWHNNIGDIVIPRNIYGP

SEQ ID NO: 108052 - protein, 221 aa, Triticum aestivum
  unsure (1)..(221): unsure at all Xaa locations
  Clone ID: PAT_TA_2470.pep
GASPSNPPPRRRPRGXGRRLGLPLPLSPTNPRQPQIHFPSSRSHAPSPPARPDRCYGRRCAPPRRAPPPLPFDVPTTRAIIVHIACATGSQPKRNTTAACIFFPNYGSRVLVVDPRHLVHPKPTYELSTDLLDPGDGCPCHCDRLRHRRPPPSRLSNQMEPRSQMPSPILTTTCEAAGRLVVRRSQARPCLSDRRFVQAFLRTVYSCYQDMRLVCILIEPS

SEQ ID NO: 108053 - protein, 319 aa, Triticum aestivum
  Clone ID: PAT_TA_2471.pep
MARTPRQLHLSSRRLRSSPPHAPSHYQKATRAAKENKLNLTSEKKDWKHATCPICLERPHDAVLLLCSSHTKGCRPYMCGTNYHQSNCLEQFKNAYVKEKPANEVSIAVAAASKKPKDVELACPICRGEVKGWTVVEPARRFLNRKKRTCIHEDCSFMGSYKKLCKHVKARHPSSKPREVDPARLAEWKELESAKERQDAISIVTGLNPGSMIIGDYLIDPNSGSSDSFMDNSDWSDDSDSYTFPDGGDIMFSGAPDIRSLRRVVRRAYRTSGARPRQNVQRRALTISRSSGRRRWPQVGSALSARMPRGRQARSTNDS

SEQ ID NO: 108054 - protein, 101 aa, Triticum aestivum
  Clone ID: PAT_TA_2472.pep
SSEWVRSRIVEGTQASLAVDCSWFLVPPSSPHRPVLAGAAYFDVDEVADRSEDKSPSPHMLPSPDQFAAWMDRHNITPDDHVLLYDHSNGLLTASARVWRT

SEQ ID NO: 108055 - protein, 189 aa, Triticum aestivum
  Clone ID: PAT_TA_2473.pep
LKAITASKRMKSGPSQVWVNVPANTFQPRARPLFQYRHYSEQQPLRLNPTEISEVIAEVCSETTSNANQFNAPARLTTQSRQPSADVAFSVLIKLVIDMYMMDSEAAAPLTLYMLEGMLSSQKSPARTKAFDLILNLGIHAHLLEPMIVEDAPLIEKGDTTSNSYLNNEYGPNMDEQREAEPEEEQRIS

SEQ ID NO: 108056 - protein, 192 aa, Triticum aestivum
  Clone ID: PAT_TA_2474.pep
HHHAGQLTERARAARIQEPVVAAPEYCHANFSRYFTPAFWSDPALGARLAAGRRRPPCYFNTGVMVVDLRRWRAGNYRRRIERWMEIQKERRIYELGSLPPFLLVFAGEVEAVDLRWNQHGLGGDNVRGSCRPLHDGPVSLMHWSGKGKPWDRLDAGRPCPLDHTWKSYDLYIAGDGGSAASPASGPAFSAW

SEQ ID NO: 108057 - protein, 181 aa, Triticum aestivum
  unsure (1)..(181): unsure at all Xaa locations
  Clone ID: PAT_TA_2475.pep
ALGFLRAVFVAFARWGLLRIPPFGTRAAPEVFDPKKPQPVKKTLKVKVYMGDGWRMDFKQTHFDQYSPPDFYARAGFAGAPAASXFDPKKPQPVKKTLKVKXTWVDGWRMDFXRHTLTTPRRHMSKQDDFAGQTVLPVSELQPGIRAVALFDRKGNKLXNVKLLMRFEFVLIWNGLVWFER

SEQ ID NO: 108058 - protein, 160 aa, Triticum aestivum
  Clone ID: PAT_TA_2476.pep
MAGTRAFLVALVVALTFLFMEGLAAAVPATPESTAQRRLEARSLLRRLNKPPVASIQSSDGDVIDCVHISKQPAFDHPLLKNHTIQMRPSYNPRGMHHDSNITAHAITQIWHQNGTCPKNTIPIRRTKEEDVLRANSIRRFGKKMPRSIPHLNPTNDTDT

SEQ ID NO: 108059 - protein, 236 aa, Triticum aestivum
  unsure (1)..(236): unsure at all Xaa locations
  Clone ID: PAT_TA_2477.pep
MEGGADAFGSSTAPLAWHDFLERMRQPSAAEFVKSIKGFIMTFSNRAPDPEGDSAAVQEFLENMEGAFRAHTPWAGSSEEELESAGEGLEKYVMTKLYNRVFASVPEDVKSDEELFEKISLLQQFIRPEXLDIKPEYQNETSWLLAQKELQKINMYKAPRDKLACILNCCKVINNLLMNASHMSHDNPPGADEFLPVLIYVTIKANPPQLHSNLLYIQRYRCQSRLVSEAQYFFTN

SEQ ID NO: 108060 - protein, 160 aa, Triticum aestivum
  Clone ID: PAT_TA_2478.pep
RATSATGGCRKTIQKNHKDHQQDAANQGEGEVRVGASAGRAKLAEKVEAATSRSHDERKLAHERGRAKVAAAEAQLHREKVAHREAAVEHRLHKHAGVGAASPKPPADGGHCREAHPGSLPSGVSSIFFPWMFSYIRASGVFVLVFYRVPRELWTLWMFL

SEQ ID NO: 108061 - protein, 147 aa, Triticum aestivum
  unsure (1)..(147): unsure at all Xaa locations
  Clone ID: PAT_TA_2479.pep
CIYDRCALLEARAERFEQARTLFQQATQCNPKSCASWLSWAQVEMRAENNAIARKLFEKAVQASPKNRFSWHVWALFEANQGNTDKARKLLKIGHAVNPRDPVILQSLALLEYNCASPNVARVLFRKASQIDPRHQPXVWIAWGWME

SEQ ID NO: 108062 - protein, 86 aa, Triticum aestivum
  Clone ID: PAT_TA_2480.pep
VMRQKSTPRRALTTMPRTVSCSRHGGTTSASAAGATPLPPARRGPVMSASDPIFDAADASAEARRPSSDLTDSGDSWFRVGEGEAT

SEQ ID NO: 108063 - protein, 191 aa, Triticum aestivum
  Clone ID: PAT_TA_2481.pep
MDLRALALAATVLLALAAPAPVLGQGVATSCTASLITSFTPCLSFLTNSTNGGGSSPTADCCRSLSAVVTTSTSCACLILTGNVPLGLPINRTLAVTLPKACNSMSVPLQCKDTSAQLPAPGPVAVSPAMPPLPPMTPEAPEPPSETTLTMPPTSQTQGQTRPQVVPSSAWRRDTASVSVMLLSIIGAMLV

SEQ ID NO: 108064 - protein, 135 aa, Triticum aestivum
  Clone ID: PAT_TA_2482.pep
TFASGQSWQSIYANPLDPCTPYATCGPFTVCTGNSHPYCDCMEGFSQKSPQGWDLDDRTGGCIRNTPLQCTSKKNTINSTDKFHPIARVTLTYEPRSMGNATTQSECAETRLGSCSCTAYTYNSSGCSIWHGELL

SEQ ID NO: 108065 - protein, 161 aa, Triticum aestivum
  unsure (1)..(161): unsure at all Xaa locations
  Clone ID: PAT_TA_2483.pep
MAPPPSTSAPDGGLDPRDVCVVGVARTPIGALLGSLSSLPATKLGSVPIHGALRRASVDPALVQEVFMGXNVLTANLRPAPGPGLPRPLPPASPNKVCSSGMKAVMLAAQSVQLGVNDVVVAGGIESVANAPIYAATAGSGSXFGHGPPIXXMLKXXLWDV

SEQ ID NO: 108066 - protein, 191 aa, Triticum aestivum
  Clone ID: PAT_TA_2484.pep
VRPRVRVLVITANSVAETVSLAPEIIRGGESVRSVFAVLNSRTRIDPDEPEAEQVDGRVGEIELRHVDFSYPSRPDVMVFKEFSLRIRAGQSQALVGASGSGKSTVIALIERFYDPMAGKVMIDGKDIRRLNLKSLRLKIGLVQQEPVLFATSILENIAYGKDGVTEEEVVEAAKVANVHGFVSALPDGYR

SEQ ID NO: 108067 - protein, 86 aa, Triticum aestivum
  Clone ID: PAT_TA_2485.pep
RTRGLLDEATSALDAESESVLQEALERLMKGRTTVLVAHRLSTIRGVDRIAVVQDGRIIEHGGHSELVARPEGAYSRLLQLQNHRN

SEQ ID NO: 108068 - protein, 323 aa, Triticum aestivum
  Clone ID: PAT_TA_2486.pep
PPLSSGSPPGPPPRSGSPAVTPAGGPSTPTADSVAETVSLAPEILRGAASTRAMVGKRVGQPGLDPVVKKAKPVTVVRRLSALQHADVSSPSRPGMGIDKEGNLNLIAGRNRAYVRLVGSGKSPLNALLGRLCDSARGKLMMGRKDIRGFPLMSLMRKLAPMHPVPDRVASPFLGDIGFHEDVAAAEEVVEAAKTANVHAFVSQLPEGYRTAVGERGVQLSGGQKQRIAIARAVLKDPAILLLDEATSALDAESESVLQEALERLMKGRTTVLVAHRLSTIRGVDRIAVVQDGRIIEHGGHSELVARPEGAYSRLLQLQNHRN

SEQ ID NO: 108069 - protein, 76 aa, Triticum aestivum
  Clone ID: PAT_TA_2487.pep
ARQVTDGSPCRGWNWAASVGSGGFDVQGLGQTATAQQGCEQSQPGITQRQTANIPVLDLACVSPHDSAITSCKSAE

SEQ ID NO: 108070 - protein, 130 aa, Triticum aestivum
  Clone ID: PAT_TA_2488.pep
MIRFDGHFEFEDPSTAEPPPPPFAARAISSEQEHTPMVAALLHVISGYTTPVPDFFFPASKEVCTACGMDGCLGCEFFGAGARPAIAPKATVGGPQRRRRNKKTQYRGIRQRPWGKWAAEIRDPRRAVRV

SEQ ID NO: 108071 - protein, 181 aa, Triticum aestivum
  Clone ID: PAT_TA_2489.pep
WPEFQYSEMCFSDRIIIELSEVGVSIEPVPDLAQSEDEDVNAEICRLEGQLHKEVLEKEKLLAKLDRMVRTEKESQQREFSRRAMERLVLIAYEKYMAFCGSNNSSSKSVNRASKHAALSFVKRTMARCQIYEEAGTSCFDEAPFKDLFISATSHRRDPDSASQENNTLPKSVQRSSASDA

SEQ ID NO: 108072 - protein, 357 aa, Triticum aestivum
  unsure (1)..(357): unsure at all Xaa locations
  Clone ID: PAT_TA_2490.pep
FGNEGNRPMPPQTRGDHHAWRTAVGTHGARPHSSVEGRGHFNHTWQNHQTFGTRENTSMPHGVGPRAFVRPMAHLPPTLGYLNGPSYPGPMPPMYYYMPAPPMEAMRGPPRFVQNQPAPQPVLSPEATELRANILAQVEYYLSDTNLERDNFLKSLMDEHGWVPISKVADFNAPCRITTDVHLIVDVLASSSLVEVQDDKIRRRSDWSKWVSSSGATSVQSPSSTASMDNIMGESNTGGFSNKDDSFSSDQKKHPHPQDNKCNIDXAAIKAIXQDEELPNDAHSXSLNKXLSAKTIXESPKSISTFSXIHAHKEAAVKTNDVXIREVNTKIKVPXSQSESGFPXDLPNDPPSFXGGL

SEQ ID NO: 108073 - protein, 193 aa, Triticum aestivum
  unsure (1)..(193): unsure at all Xaa locations
  Clone ID: PAT_TA_2491.pep
MLGGLYGDLPPPTSAAGDDDKPTASVWSSATKMAPPTLRKPSATFAPPTSLLRNQHPRPAAAPKASAVHQQQQQQPPHPLPLASAVTTTTAASFHPALVAVQSTVLEEYDPARPNDYEDYRKEKLKRAKDAEMKKELDRRRREDQERERERELREAEARLREEQSRAXSLNISGEEAWKKRAXMSGAGGGATP

SEQ ID NO: 108074 - protein, 172 aa, Triticum aestivum
  Clone ID: PAT_TA_2492.pep
SGGSLSHALLQTYFTLHALAHAARGPCTEQLELNIPSDLVHLLVGFTHTHTLHIGLIRLRSLHVAGCLLPKFSLSYHSDPSSTSFATKTRTISRGVDVYSGSSTSTYITDTVTYTGTGFHLPVKFAATLLVLVRFSVLVDLLLFSRLAVERTDHHPARDKVQRHQIYGYCTR

SEQ ID NO: 108075 - protein, 140 aa, Triticum aestivum
  Clone ID: PAT_TA_2493.pep
MGLLDQLWDDTVAGPRPDHGLGRLRKYASFSPSSAASATTAAVPSADVAAPAVTRSITILRPPALSVTSPRSESGSGSAPSSPASVPDSPFGTATTPRGESGWSKLRRKGRMAADGMEASPGTPRNPTVYDWVVISSLDR

SEQ ID NO: 108076 - protein, 111 aa, Triticum aestivum
  unsure (1)..(111): unsure at all Xaa locations
  Clone ID: PAT_TA_2494.pep
MGLLDQLWDDTVAGPRPDHGLGRLRKYASFSPSSSASGDDRCRAVGRRGXPAVTRSITILRPPALSVTSPRSESGSGSAPSSPASVPDSPFGTGTLSHLCLLFLSRTTRPA

SEQ ID NO: 108077 - protein, 161 aa, Triticum aestivum
  Clone ID: PAT_TA_2495.pep
MNVAPYHVRATRRFDRIVVRSMGLLDQLWDDTVAGPRPDHGLGRLRKYASFSPSSSAAGTTAAVPSADVAAPAVTRSITILRPPALSVTSPRGESGSGSAPSSPASVPDSPFSTATTPRGESGWSKLRRKGRMAADGMEASPGTPRSPTVFDWVVISSLDR

SEQ ID NO: 108078 - protein, 141 aa, Triticum aestivum
  Clone ID: PAT_TA_2496.pep
MGLLDQLWDDTVAGPRPDHGLGRLRKYASFSPSSAAAGTTAAAVSSADVAAPAVTRSITILRPPALSVTSPRSESGSGSAPSSPASVPDSPFGTATTPRGESGWSKLRRKGRMAADGIEASAGTPRSPTVYDWVVISSLDR

SEQ ID NO: 108079 - protein, 148 aa, Triticum aestivum
  unsure (1)..(148): unsure at all Xaa locations
  Clone ID: PAT_TA_2497.pep
MGLLDQLWDDTVAGPRPDHGLGRLRKYASFSPSSSAAGHDRCRAVGRRGXPAVTRSITILRPPALSVTSPRGESGSGSAPSSPASVPDSPFSTATTPRGESGWSKLRRKGRMAADGMEASPGTPRSPTVFDWVVDQFARPLTVKKHST

SEQ ID NO: 108080 - protein, 171 aa, Triticum aestivum
  unsure (1)..(171): unsure at all Xaa locations
  Clone ID: PAT_TA_2498.pep
LLPDPLTFSFRLAKDAKPANDSNHSTVENVGPSAGENVLRCKDPISAHKMTHMEVQIXRNNTKEIIXMNLXSISCKDVAREKXLPKENSATVLWAGVLKRHTVGRFHHCRRVIHPFSVYFXLVPGDYSXLQSSSVIIDATDVLRARAKAESPDEPILCRGSPFHIHVVGTE

SEQ ID NO: 108081 - protein, 292 aa, Triticum aestivum
  unsure (1)..(292): unsure at all Xaa locations
  Clone ID: PAT_TA_2499.pep
GTRAKGTSVRLFVPGLATAPRGGRLPLIVYFXGGGYVLFRAASEPFHNNAAVLAASVPAAVASVDYRLAPEHRLPAAFDDAADAVRWVRSYAAGSPGRPIFIMGCHNGASIAFRAALAAVDEGVQLRGLILNQAHHGGVERTAAHASAHASRVLPLPANDLLWELALPLGTDRDHEYCNPEAMLAGVGAERLRRLPPCLVLGRKKDPPRDRQRVLVHALRKAGVAVEAQMDGAGYHAMELFKTNCAEEFNAQVTDFVRRHAGDATASTYTLRGAGCDRWIQKRRLLQRRCLI

SEQ ID NO: 108082 - protein, 103 aa, Triticum aestivum
  Clone ID: PAT_TA_2500.pep
CAPNQPVGMVGLTDSMPAEVGTSEPQQMNSSDNAMQEPQSENVADKSADDGYNWRKYGQKHVKGSENPRSYYKCTHPNCEVKKLLERAVDGLITEVVYKGRHN

SEQ ID NO: 108083 - protein, 199 aa, Triticum aestivum
  Clone ID: PAT_TA_2501.pep
MLVSSLAAKIVTCRSHYRKSFIKILALYFDKLNDKNNDAIEEVKKKSKQILTFSHFVPRQELCPEKRMLYYPNLPKVIGSDYLERRLTAIHDNAKDGAACHVFGHTHFCWDSVVDGIRYVQAPLAYPRERKRRINGGQGWLPFCVYRDGFNPEIYPAIWSDYYNKNRREPENTQLAPWVAKYFSKYYGPPVFAKQTESG

SEQ ID NO: 108084 - protein, 75 aa, Triticum aestivum
  Clone ID: PAT_TA_2502.pep
KKKIFFFFFEGDTSKYTPTHQALGNSYKLELKGKKEYRLGSYRIMKFSNSFKLKDIGQMICKVNNIRISCKSYFN

SEQ ID NO: 108085 - protein, 197 aa, Triticum aestivum
  unsure (1)..(197): unsure at all Xaa locations
  Clone ID: PAT_TA_2503.pep
LLSDPSSNYIYDLAAILIHKGSAANSGHYVAHIKDESNGHWWEFDDECVSSLGFHPFGEKPGKSSDKADRKSEGTSTEGSVANGNNSSHHEXHRLLIWEKMFSSTDAYMLMYKRSSKDENGIKSNNIVEASNSSLPRHLMDEIDALNASCVNECGRVPKKKITFWLPYKERPPKKNLITGSTCYPTDSKFLFQRPMG

SEQ ID NO: 108086 - protein, 192 aa, Triticum aestivum
  Clone ID: PAT_TA_2504.pep
PRVRHASVNKRGELVDFLLISPFKFLVDFLVMSPFIVPSDDIPVLDFFSIWFLGMLLLKFWTNLAHWTRDAPFLAHFIDGRWDWKLTRAKDDGFAGLRAKWVLQDILMPITMKLVIVLGVPYVLAKGLFPRFGYSAAVNSAVYHFAWLGSLALCGLCYLAKVFWGALVKLHDSIRDERYIIGQRLQDYTDNS

SEQ ID NO: 108087 - protein, 79 aa, Triticum aestivum
  Clone ID: PAT_TA_2505.pep
QAWSPPAPALAPGGLAWSPPEPALVDVPPCFLRLCFCPSIPPRAPPPPCACRRSYPPPRGAPTPSSSPWRRECGGPSPQ

SEQ ID NO: 108088 - protein, 550 aa, Triticum aestivum
  Clone ID: PAT_TA_2506.pep
GGRGRDSPPGNTSPAPLPLLGRSHRLRSHGRRRRRLAEPKTKYDRQLRIWGDQGQAALEKASICLLNCGPTGTEALKNLVLGGIGSVTVVDGSKVEQSDLGNNFLLDEGCLGQSRAKSICSFLQELNDAVKAKYVEESPATMIDTNPSFFSQFTIVLATQLPESSLLKLDSICRSANIVLVAARSYGLTGLVRVSIKEHCVIESKPDHSLDDLRLHNPWPELKQFAKSIDICDKDPVVHKHTPYIVILVRLAEKWADAHDGQLPSTRQEKREFKDLIRAHMLNVDEDNYKEAVESSYKVSVTPGISDEIRQIIDDSSSEVNFSSSDFWVLVASLKEFIANEGNGELPLEGTIPDMTSLTEYYVSLQKIYQAKAESDCLAIEHRVKSILKRIGRDPDSISRACIKTFCKNTRKLKVCRYRSMEEEFSSPVLSEVKKYFADEDSCFAMNFYVLLRAVDRLAANYSRLPGIFDRLKEAAVSVLSDMGLKGSSLSEDLIAEVCRFAGAEIHPVAAFIGGVASQEVIKLVTKQFVPLNGTFIFNGIDLKSQVLAL

SEQ ID NO: 108089 - protein, 160 aa, Triticum aestivum
  unsure (1)..(160): unsure at all Xaa locations
  Clone ID: PAT_TA_2507.pep
MCRWSSRLLPGVEPPAESMDAKALVHGHGKAAEKPLPEKNIRRGSRGRAVALAKVETEKMSSWIKAWAENEWGTERQSPTGKASAMSAMVVARHGEEVLKPEEVAGRYRATGLAXPKKLLGCFRGIRSTSILRVGGDLFCVVVFLLYILKMCPVFCELSL

SEQ ID NO: 108090 - protein, 62 aa, Triticum aestivum
  Clone ID: PAT_TA_2508.pep
FSSIYVEGSRKRQELVLQAAKIASLNESKQEQESGNYRSGSAAGTVTPFLPKLLGNHLLANL

SEQ ID NO: 108091 - protein, 97 aa, Triticum aestivum
  unsure (1)..(97): unsure at all Xaa locations
  Clone ID: PAT_TA_2509.pep
SLPKRNAIILETSTMCMSRDRIAKRNSDIIXLDDDSHXCERETSRTLEMMGNNGPTLTTQGHSTWALHIASTGANGMAKDXMNXQTXXTHGXXXQVX

SEQ ID NO: 108092 - protein, 151 aa, Triticum aestivum
  unsure (1)..(151): unsure at all Xaa locations
  Clone ID: PAT_TA_2510.pep
PSSRRSAIAMSSSSVAVAAPVEHMVLIKLRPEAVTSGAAAAMVSALQALPTLVPGVSYLHAGPVLRLRSPAADALGPTHLLHSRYATKADLAAYAAHPAHVAAVQAHIVPNALDTTAVDWVNAAESPSPAGPXAAXRLTSRSQGRGGLRQV

SEQ ID NO: 108093 - protein, 245 aa, Triticum aestivum
  unsure (1)..(245): unsure at all Xaa locations
  Clone ID: PAT_TA_2511.pep
FENALTVRIVTLHNTTTKENETLMAIGTAYVQWEDVAARXGRLLLFSFTKSENSQNLVTEVYSKESKGAVSAVASLQGHLLIAAGPKITLSKWTGSELTAVAFYDAPLHVVSLNIVKNFVLFGDIHKSVYFLSWKEQGSQLTLLAKDFGSLDCFATEFLIDGSTLNLAVSDSDKNLQIFYYAPKMVGELERGRSSFPEQXFHVGAHLTKFMKLQMLPAPRMXSEKTNXFAFXFXTLDGGIXXXRX

SEQ ID NO: 108094 - protein, 283 aa, Triticum aestivum
  Clone ID: PAT_TA_2512.pep
RHEGLMYIWDLNNRTCILQDSLASLVTSPDEASTKDSGTVKVISAKFSRCGSPLVVLATRHAFLYDMSMKCWLRIADDCFPASNFSSSFSSTQGGELGKLQIDIGKFMARKPVWSRVTDDGVQTRAHLETQLAASLALKSSQEYRQCLLSYIRFLAREADESRLREVCESFLGPPMGMVGDVSTDANNPSWDPDVLGMKKHKLLREDILPSMATNRKVQRLLNEFMDLLSEYESVAEENVDKMDVTPPAAEAKVDKMDVTPPAADAKVDKMDVTPTEAKDTAA

SEQ ID NO: 108095 - protein, 157 aa, Triticum aestivum
  unsure (1)..(157): unsure at all Xaa locations
  Clone ID: PAT_TA_2513.pep
TSFIHSEIVELACMVYGSMPKHLDGDEFASSRPRCSLCLEDGDLNSSLVLDEAEYFKNAKCFGYDISAQQLPPNYLFWANVWMLVGDVYAEYHRLGSHQAPVLQEQKPEGELRMSNEVAMEVKRLKRKXLGKDKQNCGTCSLIXNCSCQSDRANSXQ

SEQ ID NO: 108096 - protein, 257 aa, Triticum aestivum
  Clone ID: PAT_TA_2514.pep
LKPDVAAPGVNILASWIPTTSLPAGQKQPSQFNLVSGTSMACPHVAGAAATVKAWNPTWSPAAIRSAIMTAATQLNNDKAPMTTDAGTAATPFDYGAGQVNPTGALDPGLVYDLAADDYLSFLCNYGYGASQIKLITSPPAAFSCAGNASKDLISDLNYPSIAVTGLGAGASRTVTREVTNVGAQEDATYTVAVSAPAGLDVKVVPSKLQFTGSVKKLAFQVTFSGKNTAAKAALTGSITWSDGKHTSIAIPRSAAG

SEQ ID NO: 108097 - protein, 121 aa, Triticum aestivum
  Clone ID: PAT_TA_2515.pep
MGALCDYCGEHRSMVYCRSDAASLCLSCDRNVHSANALSRRHTRTLLCDRCASQPAMVRCLEENTSLCQNCDWNGHSAGSSAAGHKRQNINCYSGCPSSAELSRMWSFILDIPNVAPELNC

SEQ ID NO: 108098 - protein, 165 aa, Triticum aestivum
  Clone ID: PAT_TA_2516.pep
MRGATSWKLWLGLELLEWRCVKRSWDCTARGWCWVLRLDCFSLDHFGRCLLDLNEVLALCRGVRAGVCLSKDGALVAPEMVAILRDATRMRSHDFDGLIGRNSDVWLMGCILVALVTGDERLAAGWNTVGSYDDWQKEVLTRLDAALVGTQLEPLAATTSVMLKL

SEQ ID NO: 108099 - protein, 301 aa, Triticum aestivum
  Clone ID: PAT_TA_2517.pep
MPFGSIGAPGSAPNGLDFSSLAQNHALFQSHQEAGRHGYPQLNFASAQSVQAAQHKPQHQNAAEAKSVAGDSSSMPSAGDNERKKSASAKYPSDSQQHSLSFSKPENKSFMHPFLGSSANEPSVRTLSLIGAESSNAFGLGSSKSSSASTAAATCSCSPICTNHVPAAATAEIQLQLHQHHQHQMQQQFQQQQQQQQQQLQQQQQQQLQQQQQLQQQQQQQQQQQQQQHQQHMLQLQKQQQQQQLFQNHLNSRPRSAAPSNASGYSDRLSATNFQNLMYPSSASQGGVQSPLKASSSMRVS

SEQ ID NO: 108100 - protein, 171 aa, Triticum aestivum
  unsure (1)..(171): unsure at all Xaa locations
  Clone ID: PAT_TA_2518.pep
MEVVASAPGKVLVAGGYLVLERPNPGLVLRTTARFYAIVRPIHDELSPDSXAWAWADVKXLTSPQLSRXEAAYKLSIKNSTLHLTCARESTNPFGEQRINFSVAAARLSINDTEKKGALHKLVXIEARGLPLTPEVLLPLPPSCSITFSSVLACGTGPIARPGVATTGMAG

SEQ ID NO: 108101 - protein, 128 aa, Triticum aestivum
  Clone ID: PAT_TA_2519.pep
MLAQPIWADKLRGFMNYRGTAKIRLQVNATPFQAGRLILAYIPQYVHEPRSHTIHLTSLTTITQLPHVEMSLQDTEAELVIPYIAPTTHYSALSGFYDWGTVFCYVYSPLATGTASNTVRYTAWMSFD

SEQ ID NO: 108102 - protein, 165 aa, Triticum aestivum
  Clone ID: PAT_TA_2520.pep
MRELAQAIRRLGEAYERVETAKLEQAAEMERQRLDFARELESQRVQFFLNTQKELSQGKSHISPAAAASHSQVGAATVGGSSRRMASVPDSTSRRMAPFPDARTSSNHHDRYRASDGSRHHHRPALRPHYQYHENNMADSAAASDGEQSDEEEEEEDDDNEEESQ

SEQ ID NO: 108103 - protein, 172 aa, Triticum aestivum
  unsure (1)..(172): unsure at all Xaa locations
  Clone ID: PAT_TA_2521.pep
MSWSDTDAALFAAVLGHDAARHLATTPPHLDGPASSSPELQARLYDLVERGGAWTYGIYWQESRAGAGGRPVLGWGDGHCRDGPAEQARATDRSLARKRALLRLHALYGGGDDDGADYALRLDRVTGVEMYFLASMYFSFHXXAGGPGRALTSGHHAWATVDPHLPGSXXAP

SEQ ID NO: 108104 - protein, 178 aa, Triticum aestivum
  unsure (1)..(178): unsure at all Xaa locations
  Clone ID: PAT_TA_2522.pep
MAMARCLLLLAIVSLAAAEGGGNNSTDSAGQVRLSCGASAPATDSDGRAWEGDSASMFLPSTNAGVAARASYQDPPLPSSVPYVTARVFASSHTYTFLVRPGRVFLRLYFYPADYGNRSASGALFGVTAGXVTLLRDFNASQAALALDAAYLVREFSLNVSSGGKLDVTFAPSPGASS

SEQ ID NO: 108105 - protein, 72 aa, Triticum aestivum
  Clone ID: PAT_TA_2523.pep
FHSIEPTKPRRSIPQEPEASTLEPRAPPPPFGAPPLPEMSAPLPHASSPSPLIRFSWLSSSLPLKSPYYLPV

SEQ ID NO: 108106 - protein, 139 aa, Triticum aestivum
  Clone ID: PAT_TA_2524.pep
ARGLRKQQQVEELESMIRLKCAEAEMFQLKANEARQEAEQLQSIALAKSEKAEQDYASMYLRRRLEEAEAEKQSIFEKIKLRENPRPLATVPPQASSSAATAAPTPGDSSQMMMLSKIQDLLKNVRSMPSGKSDVRQSK

SEQ ID NO: 108107 - protein, 113 aa, Triticum aestivum
  Clone ID: PAT_TA_2525.pep
LHGLSDLKIEYLTRPRAGSLDPRVTPTTRGTWEKAAREHPNRPKVLLLKSVDAAQSELADYTIASEPAECAIQESSIPALLNQGLVASSSVMSKQSTSVLSNMGPSEVSSALT

SEQ ID NO: 108108 - protein, 428 aa, Triticum aestivum
  Clone ID: PAT_TA_2526.pep
MSKAAAAAAAAASLPPPPPEVAHLVEQLQRHHLAPDASLLSSSAHSDLLQAREEVAAERARYLEALAVYAEAMAMVEEYQHATAAGSAGAAKKLNCSPEVYESLEHHLAVAEAVQRLRLPLLSQDGEVHEEEIEKLSTLSRVSFDSTVTSATPSSTSISTNYNNYGSTGSALTAAAAAGGGGSELVEPGAGGVPDRFLGITSDYLYQVQQQQPAMTVDMVEYQRSVAREIEARLEAKCDALADLFAMDERDSSSINQISSARLPERVKLIIEGIEKEESLLLEDLASMDRKFAEHYNVLEQILAVLIQFVKDKKLEHQHQYDDVKKTWLIKRCRTMNAKLSYLEHHLLRDTYTKETVPALHRIRKYLVEATKEASNSYNEAVSRLREYQGVDPHFDVIARQYHEIVKKLEGMQWTIHQVEMDLKPASS

SEQ ID NO: 108109 - protein, 204 aa, Triticum aestivum
  unsure (1)..(204): unsure at all Xaa locations
  Clone ID: PAT_TA_2527.pep
SLGRRSSTTRTMSPDVISMAFVPITSLLTGVPGRGFLNHAVNLYLRYKPPIEELEQFLEFQVPRQWAPEFGELPLALGPQRKKKKDSLPSLQFTLMGPKLRVNTAKVDSGGRPVTGIRXFLEGKKXSRLGVHLQHLSATPRAVPIVVGEAVTTAAGDAVNERAYFEPVRSSLLXHACTAPVQHAGARIDXCAAVVTAAAGSAQA

SEQ ID NO: 108110 - protein, 110 aa, Triticum aestivum
  Clone ID: PAT_TA_2528.pep
PTPFLSFSSVRHHSSLLAALHKQLIGHLSATKMKIGKTTEILKKAAAMCKSKTTRLLILASLQRRRMAAAAVVSHKIHTRIVADRNRVDCHKPLALRTIEKRPVIVHGGD

SEQ ID NO: 108111 - protein, 157 aa, Triticum aestivum
  Clone ID: PAT_TA_2529.pep
KKDHGRDRDRDRRDRDRNRARGRDHDREKDRGLSHDRRRERGRDRERDHERASYERDRAHLKDRDAEYNGEPKHDRSMAEYGKHYGSNQYEQHKSYESYCYQVQGGHGHETESSKRHEHEHYQAQPNTEPEGPEEGEAYEEGDYQYHQAAEEQKTEA

SEQ ID NO: 108112 - protein, 87 aa, Triticum aestivum
  Clone ID: PAT_TA_2530.pep
MPSLPKAAASMDHAVEGAMSATLLSLLGVTAKSEKGAAAADDKVEWLRSQLIGKDVEFDTPFGRRALTYADQTASGRSLSYIEDYLV

SEQ ID NO: 108113 - protein, 319 aa, Triticum aestivum
  unsure (1)..(319): unsure at all Xaa locations
  Clone ID: PAT_TA_2531.pep
MASAATASSSKKLRVLLIPFFASSHIGPFTELAVSLATARPRAVAAAAAVAPAPAPAARARPLLHRNAAGGAPPLVAASPPPPAVGRPPGGVDLRAAAAQADAWRIDVAALSDPLMPPLQAPLIRAQSPDPLVTDVHFMWNAGVCDGLGVPCVTFNVIGAFSTLAMRHLLGRVSSREPEVVTTIPRFPDPEIRVPTVELPEYLRSQRKGDQSTFDRLYAVQGDCFGLAPRAPPDLEEHYCGMYVGNGYAKRAYMLGPVSLRPPSSPGSRRLXGTPTGLTPKPSRSVXVYVCFGSLAHVSDAQLDELPLRLEASGMAFLW

SEQ ID NO: 108114 - protein, 169 aa, Triticum aestivum
  unsure (1)..(169): unsure at all Xaa locations
  Clone ID: PAT_TA_2532.pep
LKHNVXRVKGIIQVSRTIGDAYLKSSEFNREPLLARFRIPGPFHKPILCPEPSIEEHRLCAEDQFVIFASDGLWEHLSNQEAVDIVHCSPRNGIARRLIKAALREAAKKREMRYSDLKKIDRGVRRHFHDDITVVVLFMDPALISRRLYGGPLLSLRGGGSTPTFAQKC

SEQ ID NO: 108115 - protein, 391 aa, Triticum aestivum
  unsure (1)..(391): unsure at all Xaa locations
  Clone ID: PAT_TA_2533.pep
LVKSNIKWPSRWDAYLKMDGAKVHWFSIMNSMMVVFFLAGIVFVIFLRTVRRDLTRYEEMDKEAQVXMNEXLSGWKLVVGDVFREPCCSKLLCVMVADGIQITGMAVVTIVFAALGFLSPASRGMLLTGMIILYLFLGIIAGYVGVRLWRTIKQSTEGWKSVAWLTSCFFPGIVFIILTVLNSILWGKKSTGALPISLFFSLLALWFCISVPLTLIGGLLGTRAASIEFPVRTNQIPREIPERKFPSWLLVLGAGTLPFGTLFIELFFILSSIWLGRFYYVFGFLFIVLFLLVIVCGEVSLVLTYMHLCVEDWKWWWKAFFASGSVAFFVFLYSINYLVFDLRSLSGPVSATLYLGYSLIMAFAIMLSTGAIGFLLSFYFVHYLFSSVKID

SEQ ID NO: 108116 - protein, 146 aa, Triticum aestivum
  Clone ID: PAT_TA_2534.pep
MFLSARNESSESEDIQELINSGLKCNASTPADDMESGRGGARAAGSTSSSSPPPMVLPSEQKARYSTEEDPSRCSCSDSFFGKYFSFLLLMFVTASLVILPLVLPPLPPPPSMLMLVPVAMLLMLLVLAFMPTSGGRGATGPTAYL

SEQ ID NO: 108117 - protein, 232 aa, Triticum aestivum
  unsure (1)..(232): unsure at all Xaa locations
  Clone ID: PAT_TA_2535.pep
HQPAPPQLPRSSPKKRRVHKVQQAEHPKIGSGQGDQISAPAPKLMEAPPTSAIDQTNDAPSLNLNSSSSSSAGSQRQDVIPPAFEETRNTMEVSEAVAAACTARSEAPETGCQRDEFFGLDGITSGSCRSPTGNAPDAGAPRRGLSGPAEFSLLTVVDATGLSTTRAVGPVSSDDXSQGTNIGETVATAXGDTVRLLESPTPPDESRDSGASQSVSAQIVDEYKVDMVADER

SEQ ID NO: 108118 - protein, 228 aa, Triticum aestivum
  Clone ID: PAT_TA_2536.pep
DLKLAPAPLFLRIAPRSSAVVVIHPRRLLLATSAPRRPPCRCWPLPGLLSPTPAPRPGRLSVLIWSLSPRRRWGRSLRARIWRGAGRCIRPCCHPVAGGWLNPSTQPAHQAGVRRRPDGLRRASFQRKAATSDSGSGSGGGATRRSSSSTARRKKAKVVAGLLELSLAVTPSPLTRGKLKLIAEQCDLNASGIFDQVQARAASSEAPASSATSSSSASSVRVLDCPYA

SEQ ID NO: 108119 - protein, 154 aa, Triticum aestivum
  unsure (1)..(154): unsure at all Xaa locations
  Clone ID: PAT_TA_2537.pep
LSPPPPHHGPSSSAAAYYYNHHHPPPPHAYHGPWHPAPQPPPSQMPALTGPPPEFVGHQQALKVKNDINLRKDTIRLVPDAADPDRRLVSFTFDAVTDGSLVIHYFAKEGKDCNFSSVYPDLQTPTKIPFQKGLVKIXQASGSGXDLGSFPDDF

SEQ ID NO: 108120 - protein, 254 aa, Triticum aestivum
  Clone ID: PAT_TA_2538.pep
GDNSLVDMACATLDEEDKQKSVIGSSSEAALNLLPPANNQTAVSVDSTTAKYTPDKHMFSKDSIYEDFSMDDIDLSYENYEELFGNSHIQTEELFDDAGIDSYFEVKEATAVNSDEQPKPKQPAASNALSADSGMSNPAVKEDDSSLCIPVRQAISYSGFTGESIPEEYQDCGVSPMLLMGEPPWLPPGPDGSFAGIRDSAITRYKEKKKRRKFDHKIRYESRKARADVRKRVKGRFVKAGEAYDYDPLDTRSY

SEQ ID NO: 108121 - protein, 241 aa, Triticum aestivum
  unsure (1)..(241): unsure at all Xaa locations
  Clone ID: PAT_TA_2539.pep
MEEGIKEAESSKKAAAAESTATKVGVMADSTFGSIGDVLKLLPTSTVIVYEVLNPIVTNAGACSVANRVVTAALLVLCAFSCAFSAFTDSFVGADGKVRYGLXVTPRGLLPFXGGDDDDTGARDFSKYRLRPADSAHAFFSXVVVFPAVALLXADANTVASSYPALXGAARTSGMALXSWPRRLSSFPSKRIVPPGEPATRWLHNYPAVSVSSPAVWLLKFLGFKFLWSVLMCLLCLRRQL

SEQ ID NO: 108122 - protein, 213 aa, Triticum aestivum
  Clone ID: PAT_TA_2540.pep
LTPPPTRNVSAAPPPCETLTLATTSALPPSILMSDSEASPTPAAAVAAAEAAAGENSPSPARSEELLPVAEKISELNESQSELPGRLRGLKEDLQSWRSNLDTQVQKYKTEISDIKTALNSEIDQLKSDFQELRTTLKKQQEDVTISLKNLGLEDATETDGNKGTGEENTSEGALANMGDLKLEDSTETDGNKGSVEENTSEGALANMGDLKL

SEQ ID NO: 108123 - protein, 288 aa, Triticum aestivum
  unsure (1)..(288): unsure at all Xaa locations
  Clone ID: PAT_TA_2541.pep
MMERRSLMEALVTAAQGGSTDTSVLSMLKYAVLPIAKVFTVCFMGFLMATKYVNILQPNGRKLLNGLVFSLLLPCLIFSQLGSAITLEKLLQWSSRPVNIVVGAVSGSLIGFVVASIIRPPYPYFKFTVTHASAGNIGNIPLVLIAALCRDPSNPFGDSEKCSQDGNAYISFGQWVGAIIVYTYVFKMLSPPPGETFDGEEEKLPVLASEENAMPELGKYPTGTHTSTVPEDEPLLALEGNQKGSTSLGSKILSCARCVVKFLKDKQLLQPPIIASVFAIGIXXXXFX

SEQ ID NO: 108124 - protein, 103 aa, Triticum aestivum
  Clone ID: PAT_TA_2542.pep
RGAFPIFHHPSLPRVSMASPSALKVLAFVCIVAVVGLNLSQPASAASCADCWYDGWCDRLCGLIEYGCHACERIQMRGCSPRCYQGCLATCRSVDASSGSMSA

SEQ ID NO: 108125 - protein, 101 aa, Triticum aestivum
  Clone ID: PAT_TA_2543.pep
MDTENSWIRRTKFSHTVYTRVGSHGVHVAPLGRDVEQRLQRFVSMGKSVTMPIDRGNDETVAALKHTASLPSLRSSLQPNEKKASKQKMSLEIPLSPPAKS

SEQ ID NO: 108126 - protein, 365 aa, Triticum aestivum
  unsure (1)..(365): unsure at all Xaa locations
  Clone ID: PAT_TA_2544.pep
MMNNLKLGVEVVSAHDLLPKEQGTANAFVEVEFDGQKFRTAIKDSDINPVWNEQFFFNISDPSRLQEKELEAYVYHANRASNNKTCLGKVRFSGTSFVSQADAAPLHYPLEKRTILSRARGELGLRVFLTNDPSSQXPSAARQDFYFASTPTTAQEQAVANAIPNPFQDTRINQVRQFQHLPREQRQQRPPPLAGQQYYAQGQGSYGEQQQRSYSAAAGMKTEAPQPQVARMYSAGXQQPVDFQLKETSPTLGGGRIIXGRVMPGEKAGAYDLVEKMQILFVRVVKARELPXMDXTGSLDPYVEVHLGNYKMKTKFFEKNQRPEWDEVFAFPKEVVQSSTLEVVVKXKDXLRDDYVGRVMLDLNE

SEQ ID NO: 108127 - protein, 242 aa, Triticum aestivum
  unsure (1)..(242): unsure at all Xaa locations
  Clone ID: PAT_TA_2545.pep
RALSARGRALPPHTGISSPEDGLLSSCTWDPRIRSPFFYNSGFSVALSKAPAFIAEMQKLRDLKPRAFCGLDAKLGVLLRYVRASSAYLGKSEXPIDCDVTYYRCYTAGEPRANSDVVAAAEMTTLRXHRDAAPCSQHRQFLCGGAWAEDHKCHRFLKVKARYDPDGIFSXEWSDQVLGIKGSPNIVEKGCAIEGLCVCSKDSHCAPEKGYFCRPGTMFSEARVCSTRAAFGDESDDLLDEQ

SEQ ID NO: 108128 - protein, 239 aa, Triticum aestivum
  Clone ID: PAT_TA_2546.pep
VYNRMVAMKRKNLLPSVEGMDAVDYYVGSSSNSHFSDFVQPNPSALTEPLHPRMPLNIGRGRPTRPRLVNQEGSQRNVRARHDSANVSLEPRPASTYTPSSNHQLPFHSATSAFASTAAGRNQAPFSVPTRTLPSGGTGITGRIYHHPMPSRSSSSSVAAAPTVHGSSNSAMFANAGFPAPRAVHGSGAAAAPTVHGSSDSAVFANGGFTAPRAVHGGAVPSYGHPSSTVSSGSKSIFP

SEQ ID NO: 108129 - protein, 439 aa, Triticum aestivum
  Clone ID: PAT_TA_2547.pep
MLPATHDDNSENKHPFHHRPTRPEQEEEDPEEVIFDDSVSVGEGQAASEIKQGEDDDGQAAAESKQEEHRARAAEAAAEVKQQEDERKVMSDMANNRQRKKELEIFVGGLDREAVEEDIRKVFAHVGDVVEVRLHKDLSTNKNKGFAFVRFANKHQVARALAEVKNPMIHGKRCAVAASEDNDTLFLGNICNTWTKEAIKKRLLDYGVEGVQSLTLVPDTQNEGQSRGFAFLEFSCHADAMLAFKRLQQPDALFGHPERTAKVAFAEPIKEADAEVMAQVKSVFIDGLPPYWDEERVKNRFKAYGLIERVVLARNMSSAKRNDFGFVNFSTHEEALACIEATNNTELGDDGKAKLKVRVRLSNPLPKSQAVKGEMSGGFRIGHPGSGFNRPGRGFNRDRAAPRREGFHGDRGFNNHTPGRGARFNSAYSNNSFEASPSD

SEQ ID NO: 108130 - protein, 244 aa, Triticum aestivum
  unsure (1)..(244): unsure at all Xaa locations
  Clone ID: PAT_TA_2548.pep
MTAMELEARDAPVEPLDRLAAPSSSSASSSYASSLCAMCQGRVGQGDAAVGSPAAGSPSPCSASLKYAHRGCVQRWCDLEGVRPQRFVPACSRPPQQAPPPEMLPAVCGDGDLAEGLDGHQGMHYAPSDGPMDGPDTVGCSARRPPAAPGXQPLASAVSLILRVWHLLAVLTIKPAQHCAFSLLTMFILRAAGILLPLYAVMRVIRMIQHGRRQYRLHQLLEEQRRRNASRRSQEQQQLVISIQ

SEQ ID NO: 108131 - protein, 73 aa, Triticum aestivum
  Clone ID: PAT_TA_2549.pep
WDIWYKDARTSVVAVAGRLGQGVGYMVDVEFYCPGVMLSLGKNGGSVYLAFDCFTIGKHSNFLTNKQLPLVCP

SEQ ID NO: 108132 - protein, 340 aa, Triticum aestivum
  unsure (1)..(340): unsure at all Xaa locations
  Clone ID: PAT_TA_2550.pep
MGEMNHQPGAPPPVGVPPPMGMQPMMNAPVGAGAMHQPYEQFNQLNYCVHSNPSWVQVAGLAFLHYLVMLGSTVMLVSIIVPAMGGGPGEKACVIQAFLFXVLSIARQFNTNDFESNHERFVHTMRATQGALIVASILNMILGYSRAWGAFAKKFSPVIMTPVVCVVGLGLFQIGFPQVGKCVEIGLPMLILAIVVQQYAPLYFRHIHDRTTFLFERYSLLLCIGIVWAFAAILTAAGAYNHVSLKTQQHCRTDKSFLISSAPWIKISYPFHWGPPIFTAGHSFGMMGAVLVSSFESTGAHFATARLAGATPPPAHVLTRSIGLQGXIGIFLAGLCGAPA

SEQ ID NO: 108133 - protein, 436 aa, Triticum aestivum
  unsure (1)..(436): unsure at all Xaa locations
  Clone ID: PAT_TA_2551.pep
EPPVVLVGTGLQRVVQKRRDDQRHRLAGTRILSLSRPHRTDGDKHAGEQLSGDSARMEMLFSSLFCDSASSENFSGHPGVEKCPFLRNINGATTFSFSSALPVAARGGKGPIFEDGPGFESAFKLFHGQDGIVPLSGRSYVPDENRSESTDVKPEPALPFNPLAARAATISLSAFGPFGFNFFNGKGKKQNKKPNNLDQSHKKPNKPDQNSMKQKGGNPPSHEAMSDEWLENGQCPLARSYRAMSGVLPLVAKALQPPAGMKLKCPPAIVAPRAALAPHNPREDLAVPQTLAAKADALIKAPEWLAKVHSPGSAARRSMRISPPXGFAAGQASIPVIPMLRKXSTCSRAALVFTVAASTLEQTIGSXRADRLRPKILDEKGKAGAAGPATAVSVMYPDKSGSCSDAEGKAWDPTRAXKMPGSPNAGAPAPTPSMCF

SEQ ID NO: 108134 - protein, 261 aa, Triticum aestivum
  Clone ID: PAT_TA_2552.pep
LFIQLIFFRRGLKCLEALEPHVKAIAEKQHIDYQFTGLEDNECDNDGSSSYQETCSDDRELSFDYEINDRDQDFIASRGSMDLGIGARRTSPTPIKEIKQEEVKLLKAEAAAPQVKPEIITHSAPMFADNFVDQTERLRQIRPSSARHSYKLPTPADDDYPRSAAVHRSHHSAHFFGSKDGAAANLWHSSPPAKDYKASTMHSGPIKLPSNSDFSKKLKRESWSGPIPSKAGSSKPDPKSSMGRPHAMISKSCVHARQPSP

SEQ ID NO: 108135 - protein, 182 aa, Triticum aestivum
  unsure (1)..(182): unsure at all Xaa locations
  Clone ID: PAT_TA_2553.pep
LLRGVAFLSQGQARDRRGASARMAARHSYPPTRATRSAPAPRPPLSRLGESETAAAHPGADPEARRKAKKQNQLWPKTVLRKWLNIRSPDSDFSADEGDTADEAASDSEYEEMCGWERQRYDQDRRMRGLGAQTTDSQMEGVPYGLHRRRKSETLRAQYIDVKELRVCIGTWNVAGKLXXQD

SEQ ID NO: 108136 - protein, 243 aa, Triticum aestivum
  unsure (1)..(243): unsure at all Xaa locations
  Clone ID: PAT_TA_2554.pep
WLWVHCIALYTISGVACFLLYMEYKRVATLRLLHLVRTTSKHSHFTVLVRGIPKSTHESFNSAVESFFTTYHAPSYLSHQVVYKVGKLQKIVTGAKKVYRKFKHFKGTTVDQTCRSVTYRCCLCGVSSNSFQLLPTEEQREGKTLCEKFKLELTXEECAAAFVFFKTPYAAPNCTQXFPRHPILMXWVTSSWPQNLKDXYWANLWLPYKQLWIRRIATLLGSIVFMFIILVPVTFIQGLTQLE

SEQ ID NO: 108137 - protein, 168 aa, Triticum aestivum
  unsure (1)..(168): unsure at all Xaa locations
  Clone ID: PAT_TA_2555.pep
LDPVAXGXPRXPGRXGWPLPRVESQPPQIEXIXGRXPXLGLXPPERPLLPPGRXLWLNPNCFGRPLPLPXYLFPPGSGSREWPAPRPGGSTAGPPGIHGPEPAVRPPSFSNPLGKRRGFPVFINGPLXQTLVSEENPPKYRSFTMSEFFGAFFKRDLASKALLDNFKL

SEQ ID NO: 108138 - protein, 284 aa, Triticum aestivum
  Clone ID: PAT_TA_2556.pep
MGPTTIGSLQSDEYAVDQGVISGPATAIAIVASMVSNVPVVGDFARATEMGARAIGGIAKLFGYSNPPMIDDVQPMQNKAFHAFANVETRVPIDKLCLDPKNEVSISPAIAGVDEEDPLVISDLCCRESYIKAFNWTGAQAVDTLLWSAVVNPHYAFLSGGFRTMPPVTYLTPNFRFWRGSIVYKFRFIKTAFHKGRVLISHDPNGDITGTSDTETTTFSRVVHLEQETELEFAVPYMATSPMLEIVDFASFPLTNSTSAAPAYVYNSRWYNGTITMRIQTNLT

SEQ ID NO: 108139 - protein, 223 aa, Triticum aestivum
  Clone ID: PAT_TA_2557.pep
MKIPFVTKWSHRSSEPAGPSNSAAAQQQQQAPSSPSAPSPPPPVASTEAAGDEFILQEEEYQMQLALALSASASGAEGAGDPDGEQIRKAKLMSLGKGHPVTNSDRGGGDTPESLSRRYRDYNFLDYNEKVIDGFYDVFGLSAGSSGQGKIPSLAELQMSIGDLGYEVIVVDYKFDNALQEMKEVAECCLLGCPDITVLVRRIAEVVADHMGGPVIDANEMIT

SEQ ID NO: 108140 - protein, 294 aa, Triticum aestivum
  Clone ID: PAT_TA_2558.pep
FGTRAALSYGLTVAGKGQEQVLQELDRVLKEYTTFSVKQVDDEAGEVMDTRAVSARPPEEAAGDKKEEIEEQSAAFWTTIAPNVDDYSSSVARLIAKGSGQLVRGIIWCGDITASGLKCGEAVLKKGAGANGKHTQVKPSSLKRMKRARRVTKMSNKVANSILSGVLKVSGFVTSTVVNSKPAQKFFKLMPGEVILASLDGFGKVWDAVEVSGKNVMKTSSVVTTSVVTHRYGDQAGEITQDYLHATGNALGVAWAVFKIRKALDPKGHIKKSSLASSAAHAVAKQSISLQKKK

SEQ ID NO: 108141 - protein, 421 aa, Triticum aestivum
  unsure (1)..(421): unsure at all Xaa locations
  Clone ID: PAT_TA_2559.pep
MGPVLPLACSTRIVLAPRSFCPWLVRRVGAPPRPCPAWPLGSLLCVLFCGWPAPRMSYKLCLKLFVHALYGMSAPFNISCVGLKYASAASASAVLNLLPVLTFFLALLLGLLLLRXTALPPEPGRVSLARRPAVRHPGRVVSLPAWCGLWGVLPPSRATVGGALSSVCLGPLLVECPPGLLNASRLVVCAAGLSVLAALLGPGLKSIVHHPIFRHPSRVDTHPSRSWILGILLQSLATVMFALWTVFQGPLLEEYPSMLLNTSLQIVFATVQSFFMALVMERDFSRWKLGLDVGLVAIIYCGVLVTTLANYLQIWVIGRCGPVFLAMTVPLTLVITIILSLLIGEAVTLGSVISGALMVAGLYNVLWGKRIEQVALCKQGGSGENGSCLDLEEQESGVPVPATRDSIKPVPGSKERTDTSN

SEQ ID NO: 108142 - protein, 209 aa, Triticum aestivum
  unsure (1)..(209): unsure at all Xaa locations
  Clone ID: PAT_TA_2560.pep
EPSNPPDQYEEKKPNPPAPTIPSPXPSNSMTPQPPPPSLARAAAGPRPQIALPPYPDLQPRRRCVLPPVPPPPPPFPPXPPTGAPPHPRPQPETPPXPPSRIPRHRPPHAAADDXEQPPVRVAPPPTGLHRSPPPASAPPQPSSVGVPHLPPPSSARDGRMARDRELTGFLPPTASATTYIRRHSRPGRSPSPPQAMQLRPCECAPHLR

SEQ ID NO: 108143 - protein, 156 aa, Triticum aestivum
  unsure (1)..(156): unsure at all Xaa locations
  Clone ID: PAT_TA_2561.pep
KALWPGVTVQCIGVPVWGGELPGEVEASKEKSASLEALLAXATQKGVELSGELAQANEEKEKFEELSNKATTAHLEPEKQVQTLQAESRIXRGKMEEVENDLQALGVRESSVLDKLKSAEEQLEHSGRALEHATSKKIDLESLYQSLLEDTEKKLQ

SEQ ID NO: 108144 - protein, 312 aa, Triticum aestivum
  unsure (1)..(312): unsure at all Xaa locations
  Clone ID: PAT_TA_2562.pep
PRAEFGSPGRISEISAAGKLQTHNCRFLVLDEVDQLLSCNYREDMHRILEHVGRKPSTSSSSHILGPLARRSERQTILVPATVPFSAIRAARSRGHDPVLVRAKSVXPLDSITVPRPMLSQGDPNSDSPTMSVNQAAVDSLPPSLEHYYCTTKAHHKVDTLRRCIHALEAETVIAFMNNTKPLKDVVFKLEARGMKAIELHGDLGKLARSTVLKKFKAGEFRVLVTNELSARGLDIPECDLVINLDLPTDSTHYAHRAGRTGRLGRKGTVVSICEESEAFIMRKMRKQLGVAIKPCEFTEGQITVHKEEDVE

SEQ ID NO: 108145 - protein, 186 aa, Triticum aestivum
  Clone ID: PAT_TA_2563.pep
TRIVRSGMVSAVQQEPRMGASILRLFFHDCFVNGCDGSVLLDDSSTLTGEKNAGPNANSLRGFEVIDAFKSRVDAACPGTVSCADILAVAARVGAYLLGGPSWGVPLGRRDARTTTQAAANSNLPSPSSSAATLISAFASKGLDSRDMVALSGAHTIGAARCASFRSRVYNDSNLAPLDAFSVRFT

SEQ ID NO: 108146 - protein, 305 aa, Triticum aestivum
  Clone ID: PAT_TA_2564.pep
RTEQVVVVAAGLVYRGGLDRFKKAQALEPFSVQQSGSGTKSVPTAVKVQPAPLVPPQSSHLGPSQSQHASQSAGSSMAGQEAAGAPRPAGTQFGGGQSTWQPPDWAIEPRPGVYYLEVMKDGNAIDRINLDKKRHIFGRQVPACEIVLDHQSVSRQHAAVVPHKNGSIYVIDLGSVHGTFVANERLTKDSPVELEVGQSLRFAASTRAYVLRKNTAAFFPAQSLPSDVSLPSPPDSDDEDAVVAYNTILNRYGVSKSDVPLKRKGSSGDASASAVNDDSQAVGRPSKRSRRRRVSFRDQVGGELI

SEQ ID NO: 108147 - protein, 200 aa, Triticum aestivum
  Clone ID: PAT_TA_2565.pep
MAGLFWHLSLPESRAIKLIKRLGAEVNPNQKRILCMNKVDLVDDKKDLLKVAKEFEDLPGFERYFMVSGLKGKGVKDLVQYLMDQAVRRPWDEEPATMTEEVMKTISLEVVREKMLDHIHQEIPYVIEHRLMDWKELKDGSLRVEQHFIAPKQSQRQILVGKNGSKIGRIGIEANEELRSIFKRDVHLMLQVRVAKKRSS

SEQ ID NO: 108148 - protein, 525 aa, Triticum aestivum
  unsure (1)..(525): unsure at all Xaa locations
  Clone ID: PAT_TA_2566.pep
MATEQLNVLKALDVAKTQLYHFKAVVIAGMGFFTDAYDLFCIALVTKLLGRIYYTDPALNEPGHLPANVSAPGNGVALCGTLAGQLFFGWLGDKLGRKSVYGFTLILMVLCSIASGLSFGHEAKGVLGTLCFFRFWLGFGVGXDYPLSATIMSEYANKKTRGTCIAAVFATAXLGILFGTIVTIFVSSAFRYAFPAPPFYIDAAASIGPEADYVWRIIVMFATIPAALTYYWRMKMPETARYTALIAGNTKQATSDMSKVLNKEISEENVQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDTIAPTGV

SEQ ID NO: 108149 - protein, 209 aa, Triticum aestivum
  Clone ID: PAT_TA_2567.pep
MSARAPPPPTMPESDWAVRRIRKELKLLWLDPPAFCRPGPAPVTDLFHWEVVIDGPDGSPYAGGTFPVDVAIPKKYPMKPIKLTFKTKVYHPNIGPEGRMALDIFGEWWSPAITISTALLSVVSVLYDPLLDLPVRRDAALQYRDQRGLFEQKARRWTRRYASAPVASFCAAAAGKEVLEEAATSGAVACRRSCGAGKWRFFGARLLAI

SEQ ID NO: 108150 - protein, 114 aa, Triticum aestivum
  Clone ID: PAT_TA_2568.pep
MASSEGAASLLCIKLVVCLCFLGLSQGRGTAKPPFTLRNLPPLEKASSFPAMRHDSYDYIVVGGGTAGCPLAATLSLKYKVLVLERGGSPYGNRNIFYMENFHIGLSNTAPDSS

SEQ ID NO: 108151 - protein, 594 aa, Triticum aestivum
  Clone ID: PAT_TA_2569.pep
MASSSKGAAASSLCIKLVACLCFLGSSQGRGTAKPPFTLRNLPPLEKASSFPAMRHDSYDYIVVGGGTAGCPLAATLSLKYKVLVLERGGSPYGNRNVSYMENFHIGLSNTAPDSSSQAFVSTDGVINARARVLGGGTCINAGFYSRASSSFVQDVGWEEDLVNESYPWVEDKVVQWPKIAPWQAALRDGLVEAGVSPFNGYTYDHVSGTKVGGTIFDANGHRHTAADLLAAGDRNNLRVLLHASVHKIVFDSQQGRLRPRAIGVQFADEDGRLHQALLNNNRDSEIIISSGAIGSPQLLLLSGIGPKNDLKNHNIPVVLHNKYVGKGMADNPMNSIFIPTKSPPRQSLIETVGITEAGVFIEASSGFGQSEDSIHCHHGIMSAEIGQLSTVPPKQRSLELAREYAHNKLSLPKEVFQGGFILEKIDGPLSTGHLVLADTDVKNNPAVTFNYFSHPQDLSRCVYGIKTIEKILKTNSFAHLTPDDDAGYEIERVLNMSVRANVNLIPKHTNTTESLEQFCKDTVITIWHYHGGCHVGKVVDQQHRVLGVSGLRVVDGSTFSRSPGTNPQATVMMMGRYFGVKILRQRLGRAAGV

SEQ ID NO: 108152 - protein, 166 aa, Triticum aestivum
  unsure (1)..(166): unsure at all Xaa locations
  Clone ID: PAT_TA_2570.pep
RYPPHRSSIKPERARVNSTARARINQIGVAARAAPPATTPRIDPAAGGGARARAAERGPGATPPPHRRCRTSGACAAPAAPAPEEDALFIDLLHEAPLSGHREPRSIVSGTLYCILLVGYAAVSVSAPWIFLRXQGMIPPMLCNSNVILXLXKSNFQQYWXQQVXK

SEQ ID NO: 108153 - protein, 137 aa, Triticum aestivum
  Clone ID: PAT_TA_2571.pep
VPVRDASFARPPPLVTSTLPFPFPSCSPPLPSPPRSAEPPQFPAPPPSLTRSYLYRPIQNPRRKILSTNPSGVRVLPAEAAALLHCSSLVTSGLGSRVVGMGTGEGRGRRRRKLEGDDSDQEYVLEEEEEEEEVFQI

SEQ ID NO: 108154 - protein, 209 aa, Triticum aestivum
  Clone ID: PAT_TA_2572.pep
MAETVDFASGDGEAWRAALGAYDRRLAALDKPDLLDADSFYRHDLPLLLHGRDPDPYLAKPELVQLMQWKLSRGKWRPRLMDFVKSLDDKVVESASRKAFAALPDLSKAITELTVLKGVGPATASAVLAAYAPDVAPFMSDEAMVAALGNVKEYTLKQYLAFAEKLQAKAEELSVGGESLTPSDVERALWSSAIASKPPKAPAGGKRKR

SEQ ID NO: 108155 - protein, 274 aa, Triticum aestivum
  Clone ID: PAT_TA_2573.pep
PASKSIGSSLEVSDSRLSTDHFQQKEACRRRASPLISVEYSNGWDTMSGGGCGSSGEVGDSFRFNLEEVECATQYFSEVNLLGKSGFAATFKGILRDGSVVAVKSLNKTSCKQEESDFLRGLKTLTMLRHENLVGLRGFCCSRGRGECFLVYDFMVNGCLSHYLDVNEGAEASVLDWPSRVSIIRGIAKGIEYLHSKKSNKPSLVHQNISAEKILLDHHFAPRLSVPGLHKLLADDVVFSALKASAAMGYLAPEYANTGRFTEKSDVFAFGIVV

SEQ ID NO: 108156 - protein, 180 aa, Triticum aestivum
  unsure (1)..(180): unsure at all Xaa locations
  Clone ID: PAT_TA_2574.pep
CFLFSSRRCPPRVGPIGRVIGPQPPGVARRRTHAAPPHLHFYFHDTXTRAAASAMRVAGPATVPLQALFGAVYVMDDPLTERPELGSAAVGRAQGVYIGADQTAMGFLQVMNLVLTSGPYNGSSLTVLGRNNPLADVREMPITGGTGAFRFARGYAQARTHTMDLKTGDANVEYNVYVMH

SEQ ID NO: 108157 - protein, 59 aa, Triticum aestivum
  Clone ID: PAT_TA_2575.pep
MAGRPGYVTLPIISVLAAIGYVYYTAVFLAIPAWLGLATAAGVANVAAYTTLALACVAA

SEQ ID NO: 108158 - protein, 228 aa, Triticum aestivum
  Clone ID: PAT_TA_2576.pep
MSLGYAEKLSYREDVGTVGMPEKFDSPKLLQGKIEELAVMVQKSKHLVVFTGAGISTSSGIPDFRGPKGVWTLQRAGKGVPDASLPFHRAAPTLTHMALVELERAGLLKFVISQNVDSLHLRSGFPREKLAELHGNSFKEVCPCCKTEYLRDFEIETIGLKDTPRRCTDKNCGARLKDTVLDWEDALPPEEMNSAEEQCRAADLVLCLGTSLQITPACNMPLLSIKNG

SEQ ID NO: 108159 - protein, 140 aa, Triticum aestivum
  unsure (1)..(140): unsure at all Xaa locations
  Clone ID: PAT_TA_2577.pep
SHYKPPRAHHCRVCSXCILKMDHHCIWINNCVGHENYKIFLVFVLYAATASFYSLALMIGGAVHSVPTDEQSGIDSPRKSLVICGVFVGVMTXALSILLVWHVYLILHNKTTIEYHEGXRAMWLXKXVESLQPPSKSGQA

SEQ ID NO: 108160 - protein, 196 aa, Triticum aestivum
  Clone ID: PAT_TA_2578.pep
TKQKKKVSHFRSSSRPQFRVSVSPVSPPSSLIPNRTASPSHRSQSDHPQNPNPHSPPSTAASHGGGGVRWLRGRKHFGGDRRRWGLPVTRQRSRWCRPVPVGMATSSSAGGGRAAGGAPGLKTYFKTPEGRHKLQYEKTHSPSVLHYNHSSGGKTVSEITVAYLKEKPVGQGSTPNQRRTVHFGFVLLASGGGPLV

SEQ ID NO: 108161 - protein, 115 aa, Triticum aestivum
  unsure (1)..(115): unsure at all Xaa locations
  Clone ID: PAT_TA_2579.pep
CASVSGGPPPPPPPPAPPLPPTPXAKGSGRGQRAPTSLPRAGERRQGGVAVGISGEAARGEVRMARRSTAEGSKWRCWARCSSRRRAEVGGAAHPGPRGSRSRPGEAALAMAGIC

SEQ ID NO: 108162 - protein, 74 aa, Triticum aestivum
  Clone ID: PAT_TA_2580.pep
APAFLKEVARSAHRPPTQRAGVPGAMAHDPWGHRFSPACLTSLLSLGRVAAYCLDEAGHDPGKCVRPELIERGG

SEQ ID NO: 108163 - protein, 97 aa, Triticum aestivum
  Clone ID: PAT_TA_2581.pep
PLPKSQKGNDAIFVVIDQFSKVAHFLPVKETITASQLANLYISRIVSLHGIPKEISSDRGSIFTPKFWDSFQEAMGTHITWSTAYHPQSQAQVERVN

SEQ ID NO: 108164 - protein, 127 aa, Triticum aestivum
  Clone ID: PAT_TA_2582.pep
EQTITVAKSNASMREWNGRYRDDQRGGLPGSSAEWEEGGSVDVVDHRGISSGLGVAGQQGRAAGVERTDGAAVRRTGARGRGRRKMPFRSTRRVPARFVDVDEVVEDDGEDGRGLRRRRARWAPDAW

SEQ ID NO: 108165 - protein, 215 aa, Triticum aestivum
  unsure (1)..(215): unsure at all Xaa locations
  Clone ID: PAT_TA_2583.pep
PDALRTGAIEYEKFLETGDPEFAWKPPQDEWKSIALGYTSGTTSSPKGVVLHHXGXAYLMSLSGXLXWKMNDGAVYLWTLPMFHCNGWCYTWTLAAICGTSICLRQVTAKAIFSAIANQGVTHFCGAPVVLNTLINAPPADTILPLPRVVDVMTAGAAPPPSVLAAMSKLGFHVSHTYGLSETYGPSTVCAWKPEWDILPDDERARLQARQGIRY

SEQ ID NO: 108166 - protein, 122 aa, Triticum aestivum
  Clone ID: PAT_TA_2584.pep
MFWNPRLSIEMFFKNEGKFSNRATSSISSTAVTGEISKMAAPVVGNSVSEFQSGFSDMRSDMAARVSFKYGCTRGVAGAPFFFVNGFLQPGGGSPIDFSTWTSILEPLVAHHGQTIEMFTSV

SEQ ID NO: 108167 - protein, 132 aa, Triticum aestivum
  Clone ID: PAT_TA_2585.pep
RHEAPIYLQPSLSSRHNQALSGRKGTHTTYLQRLGVNGEEPAVHDPLRGPELRGRGATGAVRRQGFLAGAGAERHGRRAAARRLRVHHAGAGVLLPGEQAGVLGVRDGRMPRVRVLRRGGRARGHGIGRAES

SEQ ID NO: 108168 - protein, 187 aa, Triticum aestivum
  unsure (1)..(187): unsure at all Xaa locations
  Clone ID: PAT_TA_2586.pep
LSVSPPVAYLTIPPAAPSQNLPLPASTKPPKPXTCPLPPPAPPWAPPPTSPTTWISPPTSPPTWAPPPPTTPPSTSTSPTSSPARPPNTSTSPRPRTTSRSTRNPPPTATAAGAAAAATPPPPRRRTSCCPSSPAYSWRRTSTTSSSTTSPTTPRSSRRSSPSSRSSPIPSSTPPPTTATTAPSPRA

SEQ ID NO: 108169 - protein, 378 aa, Triticum aestivum
  Clone ID: PAT_TA_2587.pep
CRFTRLPPAATIIPTAAADDPSADACRRRHEITVIGDNVPAPITEFDSGVIPLDILKEMRRARLPGPTPAPALARPLALLNQDAVAIAKTGSGKTLGYLLPGFMHIKRMQATARSGPTVLVLAPTRELATQILDEAVKFGRSSRIASTCLYGGAPKGPQLRDLERGVDVVVATPGRLNDILEMRKISLNQVSYLVLDEADRMLDMGFEPQIRKIVRDIPSGRQTLMYTATWPKEVRRIADELLVHPVQVTIGSVDELVANKAITQHVEVVTPSEKLRRLEQILRSHDSGSKILIFCTTKRMCDQLSRTLNRQFGAAAIHGDKSQNEREKVLSQFRSGRSPILVATDVAARGLDIKDIRVVINYDFPTGVEDYVHRIGR

SEQ ID NO: 108170 - protein, 182 aa, Triticum aestivum
  Clone ID: PAT_TA_2588.pep
PTRPEERENLQQRQNAIDQLVAEKDSLTKKNEELAAELESLKEQLQARESSDQQQGSGFQQSHSGMAHPRSMPKRKRQSGDEDVDEHELMEDLSVIDNPDQGLNTELEATRKEISDIHSKLIEVRLFSVDIRYSKHPITLCEILYIKKVDTRSLYSRGSLILVLLESCLESMLSSCSHTCNA

SEQ ID NO: 108171 - protein, 165 aa, Triticum aestivum
  Clone ID: PAT_TA_2589.pep
IPDFDFKLIGRFTDLSTTGGRNIALKNIGQLDDRPFLAACRKKLPAEEAREKAKEVHRVWQGHIQNPEWNPFKTVTVEGIPKEIIDVDDDKLQGLCAAWGEGVHKAVVSCLVEIQESGRLGDRNIVPEVWNYKCKRKATHSESIEYLFGQVKRLSDAKSRTRSAR

SEQ ID NO: 108172 - protein, 136 aa, Triticum aestivum
  Clone ID: PAT_TA_2590.pep
DAWAVSSLASAFSHLSLPSTSAPHPPPLLRLPTTRRAARLVLFASGADAAEPVLEAEAPAADDGPEEVLAVEAEEDALSGLALRKFVKQRLPGGFAAQRITGTGRRKMASARVVLQEGTGKVFINFRDAKEYLQAN

SEQ ID NO: 108173 - protein, 238 aa, Triticum aestivum
  unsure (1)..(238): unsure at all Xaa locations
  Clone ID: PAT_TA_2591.pep
ATRPRPPSGHTISLPASALASSSAASSFPPLPPPPPPPRLLPRLPHLRATRRGAPCVTPGAGEQVREPVGEAAAGGPSGPEPGRAAAGVGAGAAEDAAAPQELPGGSAAXGSTATGRRKMGSARVRPSGEGTGKVFINFRDAKEYLQANPMWVEYCKXPLVTLGFENNYDVFVKVQGGGLSGQAQAICLGVARALLKISPANRVPLRSEGLLTRDTRVVERKKAGLRKARKRPQFSKR

SEQ ID NO: 108174 - protein, 224 aa, Triticum aestivum
  Clone ID: PAT_TA_2592.pep
MAAPPTPTLVLLPEWGAGHLMSMLESCKRLLLRGGRAFSITLLVMRPPTAQATSQVEEHVRREAASGLDIRFHRLPAVDPPADAAGVEDFIARYIQLHAPHVRDAVAGMPCPVAALVLDLFAAPMVDVARGLGVPSYVFMSSTGAMLALTLHLPVLHRVVTVGFDELDGELHVPGLPPVPPVPGPCPVVDKKSPNYTWFLRLGGSFMDATGIIANTADGLEPGP

SEQ ID NO: 108175 - protein, 198 aa, Triticum aestivum
  Clone ID: PAT_TA_2593.pep
FGTRGGRNVFCADSWVAATGTDRASTHPIGMMAAVMNAVLLQASLEKIGVETRVQTALMMQEVAEPYIRRRAIRHLEKGRVVIFGGTGAGTGNPLFTTDTAAALRASEINADVVLKGVIGDDEYGCPPRSNGSAPFEHISFRELAARGTSKMDMTAITCCEENNIPVVIFNMLEPGNMSRAICGDQVGTLVDQSGRIT

SEQ ID NO: 108176 - protein, 162 aa, Triticum aestivum
  Clone ID: PAT_TA_2594.pep
MASNASLLAVIMACTLLGGHTCHGARHLADTTPAAAPPAAAAVPGLPALPTMPTLPPMPAVPTVPAVTVPAMPTVPTVTVPQVTLPPPMPAVPSVPKVTMPPMPAIVVPKVTMAPMPAVVVPKVTVPPMPAIPSMPKVTLPPMPSIPTVNVPMPFLAPPPSA

SEQ ID NO: 108177 - protein, 242 aa, Triticum aestivum
  Clone ID: PAT_TA_2595.pep
MLTNGGSVAGCPGDVSAHHAFGPHVADASIKHRLLTRTTTTRGDPPLKKLQKKFMSFATEVEKDADNTSDCERLYKAFLQEINTFELPLLKSKAVVDANLREKESFNELQVEIQRQILQAQTDIEDLKKQLEQSKIERQHKEECEAIRKLISSQPPRSETEKLIANLEKEIANLEAESAACTRTLELRKKQFALLLHVVEELQISIEDEQRNIADELRAATEEPKLSIEEGSGGASDAMAVD

SEQ ID NO: 108178 - protein, 113 aa, Triticum aestivum
  unsure (1)..(113): unsure at all Xaa locations
  Clone ID: PAT_TA_2596.pep
RKAPADGSKYCRPSSAPPGPPPGAQPPGRHGRGDPGPGAAASGGEGPGDGPGRGGRGIGSRGRPSNRRGVGPNGSGVAXGGSRAAGAGGAEWGGGSSGGEGGRGSGRGEKRPG

SEQ ID NO: 108179 - protein, 140 aa, Triticum aestivum
  unsure (1)..(140): unsure at all Xaa locations
  Clone ID: PAT_TA_2597.pep
SARPCSSPGRPAHPPPSPPCPPAAAPASAARPPPPAASPPSPALPRRPXARPPPPGPAAAPSSSGPPSPPAPAAPAPGXATSSATPRRRPTRAASRCGPCSSRRRPASAPPCPPCRPSSGPWSAACSPPPATCPPTPAPL

SEQ ID NO: 108180 - protein, 137 aa, Triticum aestivum
  Clone ID: PAT_TA_2598.pep
LPPDVALTSYLAALSIEESGISEGLAAIKADRAAESISHRSAQLHGGTEDELSLKDSLAAVRNAPQAAARIQNAFRAFSFRRRQHMDARLKDEYGMTHDDIDELAAASRLYYQHHVSKRQFCDKAAVSIQKKYRGWK

SEQ ID NO: 108181 - protein, 155 aa, Triticum aestivum
  unsure (1)..(155): unsure at all Xaa locations
  Clone ID: PAT_TA_2599.pep
MPRYYCDYCDTYLTHDSPSVRKQHNAGYKHKANVRNYYQQFEEQQTQSLIDQRIKEHLGQAAAFQVGAPFNQHLLQYPGNMPRPRLPILPTPMMQHGYPQHQQPGGPFARPPILPVPGTPGYPGAPTMPXQHGGPPGFNAYAGGTSPGASVHYNV

SEQ ID NO: 108182 - protein, 69 aa, Triticum aestivum
  Clone ID: PAT_TA_2600.pep
NEIHGQITLAYQPVDPQINSVPIISIQAALLVLGKADVVGLGAVGPEDAEMALELGAGLAVLVVEVEQE

SEQ ID NO: 108183 - protein, 188 aa, Triticum aestivum
  Clone ID: PAT_TA_2601.pep
FLVVPFSALRTDYRPYESRRRFAASYDLFLADRALLPMLPRLLGKSFYSTKKAPIAVDFTRAGWPEQVRKVLSSTFLYLRTGTCSGIKVGRLDMEEEEIVDNVMAAVEAAVEKVPKKWENVRALHLKAVDSVALPIYQVVPELGMKIEVRVARLEAGVGAGGGDCCSWDWQQVQGQEDEGAERCQWWS

SEQ ID NO: 108184 - protein, 119 aa, Triticum aestivum
  Clone ID: PAT_TA_2602.pep
RVGPPQAAASRRGRRRREPPNPQILRRGASNSAPRSSLGPAYGSRCSRGPVASSPRPPPPPAAAAGTPPPPWTPEAAAAAAGGAGTAAAAGAGAADAARGWSGATRRSTSTTRRARRRR

SEQ ID NO: 108185 - protein, 378 aa, Triticum aestivum
  Clone ID: PAT_TA_2603.pep
LRQLEINPTKGNKSWSSPAAAAALGLGGPPRGSHPARPIPSAPSSKLTTETGAEISVSTLDLERGGAAMASPQVLPFLCAVLLLAGTAAARRHAPPQAGAAGQSTYTAPSCREHTASLLDFGGVGDGNTSNTAAFRKAVEHLSQYSGEGGGGGMLYVPAGRWLTAPFNLTSHFTLFLHADAVILGTQDVTQWPVIDPLPSYGRGRDHAGGRYASLVSGSNLTDVVITGNNGTIDGQGATWWSKYKSGKLKYTRGYLIELMHTDGVFISNVTLVNSPAWNIHPVYSRNIVVSGVTILAPTKSPNTDGINPDSCSQVRIEDCYVVSGDDCVAIKSGWDEYGIAVGMPSEHIVVRRLTCVSPTSAVIALGSEMSGGIRDVR

SEQ ID NO: 108186 - protein, 151 aa, Triticum aestivum
  Clone ID: PAT_TA_2604.pep
LSSGARLWHAVSLQPIGAKELPGLKVGACDCVNPCWPHCAQTSCSVMSMTKERVCRGVPTERSKTRAPKLSGVEARALSATQLTILGFGRTAASDEPGASGATRRRSRRSERAAGIATAIVCSLDELQGKLGRRVGPGDTIYTETDICWRG

SEQ ID NO: 108187 - protein, 223 aa, Triticum aestivum
  unsure (1)..(223): unsure at all Xaa locations
  Clone ID: PAT_TA_2605.pep
HEDGLCARQQRVHQENFSAAEALVKQIPLLAASQGGAMRKVAAYFGEALARRVFRFRPQPDXSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVLEMHRLLAQTGALEK

SEQ ID NO: 108188 - protein, 106 aa, Triticum aestivum
  Clone ID: PAT_TA_2606.pep
MSGVWVFKNGVVRLVENPGSERTSTVRRKALLHTPSGQVVSSYATLEAKLTALGWERYYEDPALYQFHKRGCLALISLPRDFNHFSSVHMYDVVIKNRESFRVVDA

SEQ ID NO: 108189 - protein, 115 aa, Triticum aestivum
  unsure (1)..(115): unsure at all Xaa locations
  Clone ID: PAT_TA_2607.pep
ELKHTTDGTQWRKIDREFKDFAADARNIRFALSTDGMNPFGEQSSSHSTWPVTLCIYNLPPWLPMKRNNIMMQLLIQGPKQPGTNINVYLRPXFDKLLHRWGKLVVVFWNDHNKK

SEQ ID NO: 108190 - protein, 473 aa, Triticum aestivum
  Clone ID: PAT_TA_2608.pep
MAARRRLHPPLGAELSRSHPRWVMLDRFVHYKAYAGEAVAEEVMDGTQSAISSTCTNISIAVSLRVAEPPAVSRLYLHWPERFMTASLSQVSQPFIIAAHGRSILFQAQAPFVGDSCPAFYYYPMDYFLYTASDSEKSPCLMRLPPCFDGGDKNPDVDLYFHPYRLQQLRSMWRDDIGLLCRGKGEFVVAQLTFGGQLCVLHHKPGEEQGDMNWSVENMPLPDGDDIPNLLRGSWQTDAVVPYGDCYLCWADCYLGLFFVGVIDKRTKPPCYVPLPDGLDSNRLCVDPGYPDPARRVCVSESSMINLICVGDHAGCSVCASSCSAFTITVWTLTNLREKKWMKCFTMEDSKFSAALDFDKRLPHVLPEFPTISLVKPDVVYFRLNGGNKLFWLIEIDMKKEVLGSTSLYIFEEEEEEKCSIDMAHWRSFPGYSFVPSPFTRYLDQHAIRSLELSEKLQNIRLEQAKEKIFVEE

SEQ ID NO: 108191 - protein, 49 aa, Triticum aestivum
  Clone ID: PAT_TA_2609.pep
KSKIHTCRMMLPAFYISTSTWIMSLLQNLFKLTNLLIYANMNVTHYMTG

SEQ ID NO: 108192 - protein, 139 aa, Triticum aestivum
  Clone ID: PAT_TA_2610.pep
KWKSSIDAQMAPLDKRTVHRLMNHINLFPTWLQSSSSKPKNILTCGSSAVSHQHMVKSIFTSKSALLTQKCTRTAKPYRVTIAGILSAQDRQLSRRRIRRGLLTSATPCSSLYHLRVCAHAAQRRAIYARNPLDSPGQP

SEQ ID NO: 108193 - protein, 315 aa, Triticum aestivum
  unsure (1)..(315): unsure at all Xaa locations
  Clone ID: PAT_TA_2611.pep
MASLSVPPVLTPPRDDAVALHKAFKGFGCDSTTVTNILAHRDSAQRALILHEYKAMYHQDLYHRLATELSGNHKNAMLLWVLAPAGRDATILTQALSGXITGRRAPAGVTRPTAPSPPQGPRHPCRATPPRHQAPHLAAPACPAPTQIIPSTPGLPRNEGPEVDPAAVTDDPRDLFTDPRAGTDERAFIRIFSERTWAHLVSVANAYQHMYARSLEKAVKSETTGNFQFGLLTILRCADTPAKYFAKVLHKAMKGLGTSNAALIXRVAVTRTEVDMKYIKAEYHNKYKGSLAEAIHSETSGNYRTFLLSLVGWDR

SEQ ID NO: 108194 - protein, 95 aa, Triticum aestivum
  Clone ID: PAT_TA_2612.pep
GAAQYCIFFLHSTASKCPLNYMHSITQFSFRLLALGCSQFTSTLESRLMTIQWQNGTLRGQEVYISGIVDSVRVFCPQIHISQMGACHKPTTICT

SEQ ID NO: 108195 - protein, 322 aa, Triticum aestivum
  unsure (1)..(322): unsure at all Xaa locations
  Clone ID: PAT_TA_2613.pep
GLHAAVGNAVADDKQIVFATGSMQLINALVYALSPDSNSGSTASVVATTPYAPLYGTQNAVLVXDSREYTWAGNTSLWAKASRNPTTKEDGIEFVPSPNNPDAVLHQPVVGGSSAILDHAYFWPHFTHIPAPSDEDVMLFTTSKLSGHASSRFGWALIRDEKVAKRVNNYILQNTMGASRDTQLRMLSIFKAILANLHGKEDIFAFGHDVMTAKWRKLGAVVSRSRRISLQNIPPQYCTYFDKIREPSPAYAWVKCEREEDSDCSDVLLKAKIITRSGVWNDASSRYTRISLIKSQDDFDLLLERITEFVDAELTAAGSNSM

SEQ ID NO: 108196 - protein, 161 aa, Triticum aestivum
  unsure (1)..(161): unsure at all Xaa locations
  Clone ID: PAT_TA_2614.pep
CCLGAPEPAGRAPNVHEGDADDGILKLFSRKVLAVILKVLSLLRLFTRHEQQLENVHPHTAAVPSNQPNLQIVKEDRVNPCLERLERLESMCNQLSRKPPEIPQDKDRAIQDSFDRIKSIEFDLXKTKKVLHATVIKQMQMAETLESVTESGHHRRRKFCT

SEQ ID NO: 108197 - protein, 56 aa, Triticum aestivum
  Clone ID: PAT_TA_2615.pep
ARPACRGAPACPSPPAPPAQPAWGCFRPCRRRRRRRDHTTREYVVQSVCTIALEDF

SEQ ID NO: 108198 - protein, 172 aa, Triticum aestivum
  unsure (1)..(172): unsure at all Xaa locations
  Clone ID: PAT_TA_2616.pep
MHHTGERNALVHGGGTFRYQPPKLALPRACDGDLDHHGCIAKFNXSAKWFFPLLSEACDYMRSLLKKSSIIFVDMFAIKYDLVANHXNHGIEKPLMTCCGHGGPPYNYDPKRSCMGDSKDLCKLGDKFISWDGVHFTDAANSIVASMAISGEYSVPRMNLTSLVKPAKAKAA

SEQ ID NO: 108199 - protein, 144 aa, Triticum aestivum
  Clone ID: PAT_TA_2617.pep
MIPSRSHGYLLSRDAAPTRSGKETGLRVRQRRRRVAGDGRPFTPPPALAASPPLVRLHPHAPSTAPRPTPPALLPRPVRSAFAAAGACGAVRLRPCSGLRRSARPSCVGGSPSVGRPLGRLPLLAPCVSYPPPRVPFARRGRGS

SEQ ID NO: 108200 - protein, 153 aa, Triticum aestivum
  Clone ID: PAT_TA_2618.pep
FVIGAEKCSPLLRLSEERMISRIGVPFEPCNGNNKYVQVKREAGSLPSTITSEWDSEGHLCSSVCNHVEIAMQALCALYRQRKLAMGDAREESRARTLAEFLLDGDLQGPMRRTVAELENHDATNPLFLIQVTISCSGQLYDIFRKKEDPYFC

SEQ ID NO: 108201 - protein, 194 aa, Triticum aestivum
  unsure (1)..(194): unsure at all Xaa locations
  Clone ID: PAT_TA_2619.pep
VNDVLVGATSAALSRYFFRKSGANNTKICLRSILLVDTRPTTSLQICLLIGNVATRLDAPSIIWRDIHLHMSDDRNKSYLHVXMGESFIKMFGLKAGAFIFGRMFANTTLAXYSQVAEQIELYGHPVVFXAPSVYGAPQGLLVQCQSYNSTIMVSLSVDEEIIPDYIELMDDFVESFGRIKDGASRLSTSIKQE

SEQ ID NO: 108202 - protein, 188 aa, Triticum aestivum
  Clone ID: PAT_TA_2620.pep
CSEGSGRYTWSDGTSFRREWRTGMRHGQGKTLWPSGASYEGEYAGGYIYGEGTYTGQDNIVYKGRWKLNRKHGLGCQTYPNGDMFQGSWIQGEIQGHGKYTWENGNTYTGNMKNGKMSGKGTFTWKNGDSYEGNWLDGMMHGYGIYTWSDCGYYVGTWTRGLKDGKGTLYPSGCRAPAGDELYIKNLR

SEQ ID NO: 108203 - protein, 128 aa, Triticum aestivum
  Clone ID: PAT_TA_2621.pep
DTRRKMTVEGRVSGGGDGGGKDKFPVGMRVLAVDDDPTCLKVLENLLRRCVSDVTTTGQAATALRMLRENKDQFDLVISDVHMPDMDGFKLLELVGLEMDLPVITKANLLNPLLLFVNDALKGITAGE

SEQ ID NO: 108204 - protein, 224 aa, Triticum aestivum
  Clone ID: PAT_TA_2622.pep
GNERIVITEFVSNGTLREHLDGQHGLILGFSQRLEIAIDVAHGLTYLHLYAEKPIIHRDVKSSNILLTEGFRAKVADFGFARIGSTDPGQSEIQTDVKGTAGYVDPEYLRTNYLTVKSDVFSYGILLLEILSGRRPIEVNRGGREKITVRWAFERYNKGNVQEILDPMLTESVNEDILNKIFDVMFQCVAPTRADRPHMKEVVEKLWKIRRDYAKTQNRAEGSL

SEQ ID NO: 108205 - protein, 250 aa, Triticum aestivum
  unsure (1)..(250): unsure at all Xaa locations
  Clone ID: PAT_TA_2623.pep
FGTRASCSLADVNGLEDRPLAIPKADLIPRPPADHKLEDQILLAQITKFSCGGYAVGICFSHLVFLAPRPAQFLTAVGEMARGLPEPSVKPIWSRDAIPNPPKPPLGPPPSFTAFNFVKSTVEISLDSIKRVKDQVAAETAQRCSTFDVVTAIIFKCRAAAIGSAPDAEVRLGFAAGTRHLLGGSLPSPDGYYGNCVYPGGLARASKEVTEAXLVEIVTAIREAKDALSARFLDWLGGGAKDSHYNVSLD

SEQ ID NO: 108206 - protein, 389 aa, Triticum aestivum
  Clone ID: PAT_TA_2624.pep
MKLAPSPVSPGLAADGKPFPRSGKELKRKQEHDSTTASSESSKLKHFITGSPGHDDLNDSFDEQFGLKTSGSGKELKRKQEHDSTTASSESSKLKHFIIGSPRHDDLNDSFDEQFGYLKTSGSHNEQGGGCASGILVRSTNNDVNLLKDSCFDPQVSVERIHENLRSLGYPLPTKYCRGMRLINHCAEKFEYVDGTWRNVQKELSKEVALNLSCSVVSLASFNGTTRVFACTGILIECTRVLTSASLVRSDDENKIDDNLRIKVYLPNKQYVEGNLKHYNLHYNVAVVDIMPCPGVHTANLYHEVQFEPSCKVVALGRTFVGGALTAACGMLTDEPSKFDCTELLTSTCKIKKVGIGGPLVDFDGHFIGMNFYDEGKLHSYLGIPFLNA

SEQ ID NO: 108207 - protein, 197 aa, Triticum aestivum
  unsure (1)..(197): unsure at all Xaa locations
  Clone ID: PAT_TA_2625.pep
GLAVVSLSPSLPALQPPSRFATVCPVAAFLQLRALFPRRXGLALGPGGIKPCVSSFGADQFDDSDPTERVKQGSFFNWFYFCINIGALVSGTVIVWIQDNSGWGIGFAIPTVFMALAIASFFSASDMYRFQKPGGSPLTRVCQVVVSAFRKWHVELPHDTALLYEVDGQNSAIEGSRKLEHTSELEFLDKAAIISST

SEQ ID NO: 108208 - protein, 171 aa, Triticum aestivum
  Clone ID: PAT_TA_2626.pep
MASAAALLLQLFFLLLLSLSAAQPGFISLDCGGADDYTDGFGIQWTSDAKLVFGGQATNLPVQNQLQKQYSTLRYFPADNSKYCYTMNVRTRTRYLVRASFLYRNFDNSNVYPKFDLSLGATPWSTVIIDDADTPVVEEAIILAAAPTLSVCLSNASTGQPFISTLELRQF

SEQ ID NO: 108209 - protein, 265 aa, Triticum aestivum
  Clone ID: PAT_TA_2627.pep
SPTSRPPASSSVLSPHPRRPPPPPPAPPAPPGAPPLPPAGGHALPRRPIRPPPAAAAGSAGGGRPTRRARRAAPACADWPPRPARPEPHSPRVREARHVHPDRNPNDPQAARKFHQLGEDIPSALVAPAQRQALLMQHGKSGISTDGIIDPAAIFAMLFGSELFEDYIGQLAMASMASLDNFDEDEQIDTKKLQDKMQAVQKEREENPALVLKNRLHLYVQGNKEEFVRLAEAEVSRLSDAAYGLVMLNTIGYVYSRQAAKELGK

SEQ ID NO: 108210 - protein, 141 aa, Triticum aestivum
  Clone ID: PAT_TA_2628.pep
VYFGLKIYLSDQLLGTCKEARLLVNVAEETDLKHPISFTYKWLPPADDKDEDRRQPKGLNFLHDANLPVIYKQAFNIYWTRVSLSLHELDIGASTLHAYRRGGHRGQTCPEIFVGVMDVSIRILVLDTSIFMHFFDMYCDL

SEQ ID NO: 108211 - protein, 288 aa, Triticum aestivum
  unsure (1)..(288): unsure at all Xaa locations
  Clone ID: PAT_TA_2629.pep
MDRDPMEAPTSTTAALVMPKTAPASDKKLPSRFRRVCVFCGSSAGRKAAYQAAAVQLGQQLVERGIDLVYGGGSVGLMGLVSRAVHGGGGRVTGVVPRSVLPRELIGETPGGEEVKAVSGMHQRKAEMARRADAFVALPGGYGTLEELLEVITWAQLGIHEKPVGLLNVEGYYDSLLDFIDRAVDEGFVSPAARRIIVAAPTPGELLAALEDYAPAXRTAGGVKLSWESSVGHHGLLRRPSRTSPASPGRRPVQLTNKPPNPKIKFDKHTHTHIRLLDYISINIQTKT

SEQ ID NO: 108212 - protein, 103 aa, Triticum aestivum
  Clone ID: PAT_TA_2630.pep
MEVNQSLLPKVQFNLELSEKERSDRANVVLPFEHQGKGEPIRIYDGRRSLPEAHQDPNLTTAALLDETEALKSANPKGEIHYLRDSDDERPDSDEDPDDDLDI

SEQ ID NO: 108213 - protein, 311 aa, Triticum aestivum
  unsure (1)..(311): unsure at all Xaa locations
  Clone ID: PAT_TA_2631.pep
ASYIAPSLASEFRQLAPMTVAAAGAGRRYALLLGGEXDSDYARKAHGGYRNVFFRALRSGEPDEAWDCYRVIDGEFPAAEDLGLYDGFVVSGSPHDAHGDGAPCWVRRLGPRRPAGRAPGPPPLGPAAGLRARRRAPRGPAAGSPSGWDRFANARTGCCXFGAGMGFLPVEPPRSASIIEVHQDEVWEVPPGGKVLAYSDKTRVEMFAVGDNALGIQGHPEYTNDILLNLTNRLVNNSTIDGCVGEDARRTAESGEPDREFWTGLCKAFLRGSGCTGGGGAPRPPPQGPAPELSCSHHVAHFPATASPIGL

SEQ ID NO: 108214 - protein, 173 aa, Triticum aestivum
  Clone ID: PAT_TA_2632.pep
FTRPVMPALFRALDDYAVDNRGDVGSWVREAAMDALERCTFILCKRDAVAVRAAPAAEDESQPSDMDANAISTTCQLCDSAIAQGLVAGIAKQAVEKIDKIREIAVRTLQRILYNQEQFVPSIPYRKLLEEIIPNNSDLEWAVPTVSYPRLVKILQASCYSRPVLSGLVISTG

SEQ ID NO: 108215 - protein, 167 aa, Triticum aestivum
  Clone ID: PAT_TA_2633.pep
PTRPPYVRLGKASSSTGLLGRFNRMAGALPSSVFEAERPGCRFTVQQRIGTYFYKGVLYGSVGFVCGIIGQGICNMIMNAKRSVKKTDEDIPVPPLIKSAALWGVFLAVSSNTRYQIINGLERVVEASPVAKGAPPVAMAFTVGVRFANNIYGGMQFIDWARWSGVQ

SEQ ID NO: 108216 - protein, 108 aa, Triticum aestivum
  Clone ID: PAT_TA_2634.pep
GPTPLTVLGCLRSLRLPVNSTAASWRSCTTSLKVIMCLLILSLTVNSTTADCGCCISLAAKGCCSTCIFAGGSDFACKNTCCFPCILEDSVVAKMDEMGVASKMEGLY

SEQ ID NO: 108217 - protein, 206 aa, Triticum aestivum
  unsure (1)..(206): unsure at all Xaa locations
  Clone ID: PAT_TA_2635.pep
CAAEYLEMTEEHSEDNLAARAEAYLSQSVLXTKALKSCEELLPHXEELGIVARCMDAIAARSSATSRSWFRPLAVRGPRRVPRVMLAWAXEDLRTEALEGCLVSYAKATLPGLSRSMRWRRASAPVSSEVEQRDLLEAVVASLPADKGSGSVVTAKFLVALLRTAHILRASDAARAAIERKAATQLEQATVEDVLIPRVPGAAETL

SEQ ID NO: 108218 - protein, 98 aa, Triticum aestivum
  Clone ID: PAT_TA_2636.pep
MPKIALGHRREASDPGCLRAVLGELVLTFLFVFVGVGSAIVGGQAVAAGGDTSAALIAVALGHALVVAVFATAGFHISGAHMNPAVTLSLAVGGHITL

SEQ ID NO: 108219 - protein, 456 aa, Triticum aestivum
  Clone ID: PAT_TA_2637.pep
MATTVQPHSPDPTAITTTPAPPPPPSPPRQENPTAAGEGVEIAALDEQPAAVAVADKGKTAPGGGKLVAEAMRKCAAPRSSRYHGVTRLKWSGKYEAHLWDNTSQVEGRKRKGKHVYLGSYVTEENAARAHDLAALKYWGITQPTKLNFNISDYAKEIEIMKSMNQDEFVAYIRRQSSCFSRGTSSYRGVTRRKDGKWQARIGRIGESRDTKDIYLGTFETEVEAAEAYDLAAIQLRGVHAVTNFDISNYSEEGLKKLEGSSEVVNLEDQSEVTKLAVTNLDISKHCEDGLKKLDGASQIVNLEGQSEVTKLSVTNFDISNCCEDGLKKLDGASQVANLEDQSEVTKLAGPYFVVCHRGDDGLLPLDRSSEGPSLHLHPVVTEVAGLLSSASLPVNFFSLPFSLFSDRQSLLPSPFLVDDESVFSSSTFPDTFLSPRFFPSLVANSIIYQLQSRIV

SEQ ID NO: 108220 - protein, 311 aa, Triticum aestivum
  unsure (1)..(311): unsure at all Xaa locations
  Clone ID: PAT_TA_2638.pep
NPPLLLRAQGSQPRLRGLEEEGTASARGFLKRASARAMGNSCVTGSSSTSNHGQSLKSNGEKASDNSCVTGSCLSNQGQSQESNGSETTFKWRIDGFSSLLDKGWTSSSVFNIRGFDWYMVLNLRDRKSGDKNEYVSLELVLFLAPEILHTVVEASFKFLIYDQSYGKHLEQHQVSQNFQAPSRVSGTSFMIPLATLKEQSSGFLVEDSCVFGIQFIKVVPVKGSSKHRQNLKANVARAIGNSCVTGSSQSSQGHCQESNGSETTFKWRIDXFXSLLDKGEGWTNFQCVXHXGXLTGTWMLNPRTERXATK

SEQ ID NO: 108221 - protein, 87 aa, Triticum aestivum
  Clone ID: PAT_TA_2639.pep
RTMPRNGRGSMYPLPYSGLTRFSNWYSTGARTNQLTGHHVLSQCNILLTRDRGSSTGSPPPPAGTATRRRRWGSALRRITKIDKRQD

SEQ ID NO: 108222 - protein, 244 aa, Triticum aestivum
  unsure (1)..(244): unsure at all Xaa locations
  Clone ID: PAT_TA_2640.pep
SNKRHDEQHAVVRCASSGALQTVSDAKQSNGQIHGKSVMHTVRGGVFLFGQAISCLVNTPKHRISSTAAINYELGRSRTTLTYNGEKLTVASRGVLDGAPSGEPSDAYRDDKFPEAGLXDESGSSCRLPHSNNGTELSSAPDHTCTISLSEGQSPDVYLPGLIIHIVPIKNGTSPLPKTLVTRHKNKSYKAFIANRRDFMDLVVTPRMFLDHLPWRCHYAMQRVIETRKRNQPILNSCSGEDSV

SEQ ID NO: 108223 - protein, 67 aa, Triticum aestivum
  unsure (1)..(67): unsure at all Xaa locations
  Clone ID: PAT_TA_2641.pep
LNQKFMQHLETNPDHECLKGLFDWRRPGRRTCPDSLKPCIFYLSIFPRXTAFRQRRLVRRWIAEGYC

SEQ ID NO: 108224 - protein, 405 aa, Triticum aestivum
  unsure (1)..(405): unsure at all Xaa locations
  Clone ID: PAT_TA_2642.pep
MEAQWLAEYPHQAADNRPRKRPRLAWDAAPQLFPPPKAIPMLYCGQELINGNFTTAFLPPPPIYYAGPPRNLSPPWRPDDKDGHYVFTLGENLTPRYRILSKMGEGTFGQVLECWDLENQESVAIKIVRSLQKYREAAMIEIDVLQRLGKHDFTGRRCXQIRNWFDYRNHICIVFEKLGPSLYDFLRKNAGRSFPIDLVREFARQILESVTFMHDLRLIHTDLKPENILLVSPDTIRVHDYKIPIRPPKDGSVFKNLPKSSAIKLIDFASTTFDHQDHNYVVSTRHYRAPEAILGLEWNYPCDLCRVGCILIDLCSREALFQTHENLEHLAMMKNVLCPLPKHMIARADRRAEKYFRRGLMLDCPEGAASLESMKAGWKLPHLQNLDMQHVXHSDWDLIDLLPRA

SEQ ID NO: 108225 - protein, 200 aa, Triticum aestivum
  unsure (1)..(200): unsure at all Xaa locations
  Clone ID: PAT_TA_2643.pep
FTRPEIPSTRSRRGIFNKAILERCLKVYKEKLEGLRLPVPVEKLQQIHEVANGEAKLLFDKQHFGKHHAVQSILKLEDEITKVYKNFLLANEYQSSKLCEARFSECEDQMDHLQVLKLPSMAKFNAGFFYCNRTFVMECVGPAKERYDHRMSKMLLKSRALFIKEYNNKLFNXWLVTFALVMVVLGRFVIKFFLLEIAAW

SEQ ID NO: 108226 - protein, 105 aa, Triticum aestivum
  Clone ID: PAT_TA_2644.pep
IMGLITCASSLLAGIMIAVLLPLSEVLAVMFLHEKFDGPKGIALVLCLWGFASYMYGEKVQQKKAAAQKSELQQQQQAREGGGPGGREPAGRRGQPAKVRGRGRK

SEQ ID NO: 108227 - protein, 67 aa, Triticum aestivum
  Clone ID: PAT_TA_2645.pep
LARDHGTPQLWHISTSGSLCLDHIGFKFIPLFVSKIFVSSSLGRFACIEHIYRPGSLCPSPRVRPRD

SEQ ID NO: 108228 - protein, 203 aa, Triticum aestivum
  unsure (1)..(203): unsure at all Xaa locations
  Clone ID: PAT_TA_2646.pep
SASLTREETSESTSSSSSTTIAFCFVCSGLASSLASASFFAGPGSCSLAAGPSVAGAPSXANSISVSLSAAAPPASSANVNFLPEGVSAGGSSGSMSSRGISSLMTSPGISSVTAAASIFSSEWSARSISVSLSAEPPPASSANLPVSPGALPDFLTDVSLVVRVPISSLASESLESALHTTSGVVGSAERGSDEQGRVAGAL

SEQ ID NO: 108229 - protein, 220 aa, Triticum aestivum
  Clone ID: PAT_TA_2647.pep
MGSSSGLVVWRGRPVNPKKHGGVRASIFIHALVLLSNAANIANIMNLVTYLRGTMHMGVAEASTTASNFFAALQMFSIPAAFLADSYIKRFYTVLIFGPIEILGYILLAVQAHVPSLHPPPCSPTGAQTCETVRGSNLSLLLLGLYLIPIGDGAARACLPALGGDQFDTADPVEQRQETSFFNWYTFAVSSGGFVGLVLVVWVENRRGWDIGFTLCALCV

SEQ ID NO: 108230 - protein, 283 aa, Triticum aestivum
  Clone ID: PAT_TA_2648.pep
DARKESGSDIVIVARTDSRQALSLDEALWRARAFADAGADVLFIDALASREEMMAFCAVSPGVPKMANMLEGGGKTPILSPLELEEIGYKIIAYPLSLIGVSMRAMEDALVAIKGGRIPPPSSLPSFEEIKDTLGFNRYYEEEKRYVASPAQSSFGSGNYDYTSEASSSGDTKSRTEKSQEPIIDILPQLYDPGSAGGRGPSSGMWSRTLRLKITGRDGVQKIDARIPAGFLEGMTKVIPGLAGTNIMERLRNAPMDSDNPQNGQILLDFEDGMGDRIQVFIA

SEQ ID NO: 108231 - protein, 106 aa, Triticum aestivum
  Clone ID: PAT_TA_2649.pep
AEKCLACWSSNIAHGGTSNSMLLHSLTSQPPQGRRSTLTATPPSSSTSSTDQLLPHATAPQALLCLLTIGGPGGSRRRAVPRPDPWPHQRPELRGVRAGKISKVAA

SEQ ID NO: 108232 - protein, 161 aa, Triticum aestivum
  Clone ID: PAT_TA_2650.pep
PPRMRIRRPSRHPTGSAAPSSTSKELLRRSPRLSRLLHPHSAALTCSTGTATSSPTPRTKPRPTRRHQRGCTLIASHLLLNLTSRRRRCSILHPHGAATLKPAPRATSPRRLSPSVRPLRRRRSYQPDLLLLLQLSLTHSRCCYCSGSRSIARSPSCCCCS

SEQ ID NO: 108233 - protein, 336 aa, Triticum aestivum
  unsure (1)..(336): unsure at all Xaa locations
  Clone ID: PAT_TA_2651.pep
LRXILPETPRPVVHTFCKILTPSDTSTHGGFSVLRRHANECLPPLDMAMPTPTQEIISKDLHGSEWRFKHIYRGQPRRHLLTTGWSTFVTSKKLMAGDAFVYLRSETGEQRVGVRRLVQKQSTMPASVISSQSMHLGVLASASHALKTNSIFVVYYRPRLSQSQYIVSVNKYLQASKTGFTVGMRFRMNFEAEDVPVKKFFGTIVGDGDLSPQWSGPVWKSLKVQWDDSVAICNGPERVSPWEIDSSDASSPAISALLQSSAKNKRPRETNENFDLPSQEPTQEFWLSGMTQQHERTYVGSSDPNRISGYHQILWPSSXPAGYGAMSSSSVCQTPL

SEQ ID NO: 108234 - protein, 140 aa, Triticum aestivum
  unsure (1)..(140): unsure at all Xaa locations
  Clone ID: PAT_TA_2652.pep
XEHPXARPGGPGPGSXRGPRSWKNRRGLQPQPGPAADKRPLPEHQSPREAPARAAKNQGKTLDNRRKSMADSCPRIERKSRNFELEKGGGIRGAAACRVEMAMGGEEAETLGLERRGRGGGGRFGVRLGGRRRGGGGGRR

SEQ ID NO: 108235 - protein, 259 aa, Triticum aestivum
  unsure (1)..(259): unsure at all Xaa locations
  Clone ID: PAT_TA_2653.pep
CLENESEPHISSCHGPSPALVGAAPGVHGLGWSEEGGCVHPLXVSFYDPRAQQAAGMPTCYTKPHQVLPIDGASGLCRRRRVKEQRPHLQPAAVARAILFRGSQRYTRSLANSSFEFIENAKEWFATIMDESLRAGSGKATSLLQQIMKEGAPGAPVSLISPAKSSGTSSLTNAGAPVSSVCPTLNMTRDAENYGISSVTSPGPEKSQEGACGGFNPRKNPRAELATIDEYLDSKRQRTTGTFGEASMVPVNEVWAEAH

SEQ ID NO: 108236 - protein, 120 aa, Triticum aestivum
  unsure (1)..(120): unsure at all Xaa locations
  Clone ID: PAT_TA_2654.pep
VRCMAASQVAAIVASCRTSREISQGRAQIXPVFLPPPPCLAQPEERGNGQAAGGGGARRRGVGRLRQRVVWASGTLERGRGGGALDDGKQWQVREIESDAAAGAREAAGGPQGSGPERRR

SEQ ID NO: 108237 - protein, 131 aa, Triticum aestivum
  unsure (1)..(131): unsure at all Xaa locations
  Clone ID: PAT_TA_2655.pep
MVLPMSRATRLVPELPLLRRGRRAQVADDGELAVPAHFRCPISLELMKDPVTAPTGITYDRESVEGWLARXAXTCPVTGGPVRLADLVPNHATRRMIQDWCVANQAERVPTPXXPVAXXDXXXXLAAVSTA

SEQ ID NO: 108238 - protein, 159 aa, Triticum aestivum
  Clone ID: PAT_TA_2656.pep
LISLAIMQMPSSGPVPGPTTNLNIGMDYWANTASSSPALHGKVTPTAIPGAVAPTEPWMQDERELKRQKRKQSNRDSARRSRLRKQAECEELAQRAEVLKQENASLKDEVSRIRKEYDELLSKNSSLKDNVGDKQHKTDEAGLDNKLQHSGDDSQKDTN

SEQ ID NO: 108239 - protein, 123 aa, Triticum aestivum
  Clone ID: PAT_TA_2657.pep
MNTTQKVDPTESAAKIAQQASQFKRWGRRHPFVRYGLPLISLTVFGAVGLAHLIQGSKEVTKEKEDMEWEVVEKTKALSRTGPVEGAYKPKKLSLEDELKALQQKVDINSYDYKRIPKQNENK

SEQ ID NO: 108240 - protein, 350 aa, Triticum aestivum
  unsure (1)..(350): unsure at all Xaa locations
  Clone ID: PAT_TA_2658.pep
PLSRHPCRPGGTAALRVQYSPEEYGGARARGYMYHCIAMXEISRAXSGSVGLSYGAHSNLCINQLVRHGSPAQKXKYLPKAXSSGEHIGALAMSEPNSGSXDVVSMKCKAEKVDGGYVINGNKMWCTNGPSAQTLVVYAKTDITAGSKGITAFIIEKGMPGFSTAXKVDKLGMRGSDTCELVFENCFVPQENVLGXKGKGVYVMMSGLDLERLVLAGGPIGLMQACLDVVLPYVRQREQFGRPIGEFQFLQGKMADMYTSLQSSRSFVYSVARDCDNGKVDRKDCAGVILFAAERATQVALEAIQCLGGNGYINEYPTGRLLRDAKLFEIGAGTSEIRRMIIGRELFKED

SEQ ID NO: 108241 - protein, 145 aa, Triticum aestivum
  Clone ID: PAT_TA_2659.pep
MPHGNPFGCYDNQQFQLLIIGGTDMFPLVTNGHVQDSLILPEVERPTEPNAENFVAPASQIWISAASREPSQSGSSNALTAQSAGFEVCDELRPMGQSLSMCESTRKNVANGTADCRSNGKDYREKVLKDNLKDERKRVALTRMG

SEQ ID NO: 108242 - protein, 146 aa, Triticum aestivum
  unsure (1)..(146): unsure at all Xaa locations
  Clone ID: PAT_TA_2660.pep
AACCEEXVGRWERSLGXDGSWEVDVCPELQSLTGDVISQTAFGSSYLEGRRIFQLQTEQIGRFMAAVSKIMIPGYMSFPTKNNRRMHQINNEIESILRGIIAKRMQAMQEGESTKDDLLGLLLESNMSDTDENGQSTLGMSAHEVM

SEQ ID NO: 108243 - protein, 274 aa, Triticum aestivum
  Clone ID: PAT_TA_2661.pep
RIKNENSLLSKTMRLFSTNYRLLITGTPLQNNLHELWSLLNFLLPEIFSSAETFDEWFQITGETDQQEVVQQLHKVLRPFLLRRLKSDVEKGLPPKKEIILKGGMSQMQKQYYRGLLQKDLEVINAGGERKRLLNIAMQLRKCCNHPYLFQGAEPGPPYTTGDHLIETAGKMVLLDKLLPKLKDRDSRVLIFSQMTRLLDILEDYLIYRGYQFCRIDGSTGGQDRDASIDAFNKPGSEKFVFLLSTRAGGLGINLATADVVILYDSDWNPQADL

SEQ ID NO: 108244 - protein, 92 aa, Triticum aestivum
  unsure (1)..(92): unsure at all Xaa locations
  Clone ID: PAT_TA_2662.pep
MVIPPPDRAARIVGFLKPNLLRMDFSNKFVTAQVIHTPTTTVPCSVSSREKLLRSHMXSTGDVSAVAKIGKLLGERLLLKXIPAVSIHMKRE

SEQ ID NO: 108245 - protein, 121 aa, Triticum aestivum
  unsure (1)..(121): unsure at all Xaa locations
  Clone ID: PAT_TA_2663.pep
PLRSRSAGSRAPCRTRRRWAKPAVLVAXEKLGEAGLDVLRQFADVECAYGMSPAELLAKVAQFDALPLRSGTKVTREVXEAGRGRLRVAAGRVGIKEARGANAHATLARRRPVLPKFQLGE

SEQ ID NO: 108246 - protein, 221 aa, Triticum aestivum
  Clone ID: PAT_TA_2664.pep
PSPSPSPNPPPPPLASKAHHHHQQATTSLIHPSIRPTPDRAKKDPRNFPIEDQGRRICCRSTQQAYLASCFFISSLGQLRLVGGSNPHGVVPPAAGPGAADQRHQLLLLAPGRAAGQLGPATGRHHRRHQHGSIQPPPRVSAGQSASATDIASKDATPPSAWTPPPSAATAASYSNHISNHYHHRMNALLKPIRGVPIYHHHPSFQQLQHQHMAMAYRSSG

SEQ ID NO: 108247 - protein, 269 aa, Triticum aestivum
  unsure (1)..(269): unsure at all Xaa locations
  Clone ID: PAT_TA_2665.pep
DDEEGFFLPSGQASAPPPSAAGDTLEALKSLVQSASVAERNLLADASRIAERCGRTCKGKAECRNAVADGLRALGDDPAVFESRSEKTPSYPAGEHEYTAGEHGDGARLIVEVHFRSEDEHARSTFAYRASTKAHPPLFVGTSDRLGKIVSVVAEAARQSMKKKGLHFPPWRKPEYMRAKWLSPHVRTGDKAAATPSPAASATATAVSAASFSGEFELLFGMNRSGVSPTPGEKITVXVVSPWRPTEEXAASKKQQPRAKVVTGLAAVL

SEQ ID NO: 108248 - protein, 57 aa, Triticum aestivum
  Clone ID: PAT_TA_2666.pep
LTAHEYYVHVYVLIGAKLAYTSGERYLEAGEREARAVVAAMGAQEIKYFSQAKLGRR

SEQ ID NO: 108249 - protein, 143 aa, Triticum aestivum
  Clone ID: PAT_TA_2667.pep
STHAPVRLPASSLARQRSEMARLSSIPISLLLLASLASAAASAAAVGQEEGGIKIRVRYPTKEQSRWLNRWAEKHQAQGSGEGFRIRPATDEESAFLNRMSARGAEKTGGRAGYDGRIEFGDDHPKNRCGCLPLSSSHVQGER

SEQ ID NO: 108250 - protein, 133 aa, Triticum aestivum
  Clone ID: PAT_TA_2668.pep
MAKHLYKTPIPSTRKGTVDRQVKSNPRNNLIHGRHPCGKGRNSRGIITARHRGGGHKRLYRKIDFRRNQKDISGRIVTIEYDPNRNAYICLIHYGDGEKRYILHPRGAIIGDTIVSGTKVPISMGNALPLSAV

SEQ ID NO: 108251 - protein, 99 aa, Triticum aestivum
  Clone ID: PAT_TA_2669.pep
VGRRGRRRQSLQWRTAAKRKAAPEATSAAARDGIATPAADTGLGAGASWAETTEKAATDRMATRARALDATVEAAIASVGGSDERRTRRCDLWRRRGME

SEQ ID NO: 108252 - protein, 150 aa, Triticum aestivum
  Clone ID: PAT_TA_2670.pep
PPRVRLHRRGVGLRPSPRPAHLPPPLPPHPTPSPPSLFLQLPHRSGMALTRPSTGYEGGGDMAWRWWPLGSLRLRRHTTVGVPRKRSGPSPPRARGRSLVILRAGSQRGARRQQADRRRGLPTGMEEQAMARRPPVGEQRGPSSRLRTHC

SEQ ID NO: 108253 - protein, 56 aa, Triticum aestivum
  Clone ID: PAT_TA_2671.pep
SDPTMSLKIKRGLRERIVESVSEAMAQLEIEDSSAADLKKKELALKRLITKAMSSR

SEQ ID NO: 108254 - protein, 124 aa, Triticum aestivum
  Clone ID: PAT_TA_2672.pep
DVCVPLSILAECISVSKQLLDASPLTCLVIAHAGDGNFHTIILFDPSQEEERREAERLNHFMVHTALSMEGTCTGEHGVGTGKMKYLEKELGMESLRTMKRIKAALDPNNIMNPGKLIPPHVCI

SEQ ID NO: 108255 - protein, 267 aa, Triticum aestivum
  Clone ID: PAT_TA_2673.pep
HGEHITIRKRTARPSRNDRPEQLADPETTTDTDRNMAALFNVLRKKKKTRLENLVLNRMSFAQTVENIFALSFLVKDGRVEMNVNDDGHHILSPRNAPAAGAIASGEVKYNHFVFRYDFKDWQLMKGIVAEGEELMVHSPPSLSTSGGNTQAEMPTRSMPGGNNQGEVPAHGTPGGNEDPATPVHGTSGGNSEPEMPAHTTSIRKHCRNRGLVTQARQDETTAMEDKRQTDAQDEVMRTVVKREDMEMAKDRQEVVQTYKRKRSDRH

SEQ ID NO: 108256 - protein, 345 aa, Triticum aestivum
  unsure (1)..(345): unsure at all Xaa locations
  Clone ID: PAT_TA_2674.pep
MGSVAGDAVRLAYPPVRRDESVVDSYHGAQIPDPYRWLEDPDSEETKEFVAAQAELAESVLAGCADREGLRREVTRLFDHPRHAEPFRRGDKYFHFHNSGLQAQSVLYVQDDLEAEAEVLLDPNTLSKDGTVALSTYSISEDGKYIAYGLSESGSDWITIRVMRIADRQLMSDKLSWVKFSSISWTHDGKGFFYGRYPAPGVELDAGTETNINLNHQIYYHILGSDQSEDILCWKDPENPKHSLGASVTEDGKYIILGTYDGCDPVNKLYYCEISSLPHGLEGFKXETKEMLPFVKLIDNFDAQYXVVANDGDEFTFLTNKNAPKNKLVRVNIKNPRGAWGCSSS

SEQ ID NO: 108257 - protein, 86 aa, Triticum aestivum
  Clone ID: PAT_TA_2675.pep
VNFGSAALVGGPAQGYLVYDLREAGPAQSELPKLTSQELLTGRDIPVEDKFEVLVWRSRIPPYCDYAVTYEKQKNHVAVRKRQRKS

SEQ ID NO: 108258 - protein, 96 aa, Triticum aestivum
  Clone ID: PAT_TA_2676.pep
VVSAHLGSGQQVDGQVVHSCCSCVSRFLAADLQFCRYTMIAAGVGRNHSMVITDKGSALYTDKLGTSSLRSGTKVSPLPCLVTKATNVVCGADFTI

SEQ ID NO: 108259 - protein, 86 aa, Triticum aestivum
  Clone ID: PAT_TA_2677.pep
LPLFLRQPPPLLGNSPQASTPPPQHRDVGPGGDVRRRYSCSSSSPPPATSPTSPHHGLPSSPWHGRSPCVCSVREEEGPREQPTRP

SEQ ID NO: 108260 - protein, 126 aa, Triticum aestivum
  Clone ID: PAT_TA_2678.pep
SFRTAKASLSTSLGSFTLPSSASHRVILAAGSIPPRPQRLDTLLNDRWLVLRLRVVYDSSLCHEESQEVAAVPAAGPGGGGGQRRRVLPAAFAHDQREREHVGHGVPVAVRRVVVGQPPGARRRGG

SEQ ID NO: 108261 - protein, 566 aa, Triticum aestivum
  Clone ID: PAT_TA_2679.pep
TRIQRNHAAALRRPSKGGISSVPAPTPALCSSSTEEIEAHLSTATISKKQLKKDTRKAEKAGKASQRRRQRQPQAEEAVPVAANYGNVPLEDMEAKLIPAWAWAASGERDVPAATPSALIRLSAHTLRPVSQKMAFVVLGLRMSTVQCVPVVSAGAGSGTQMLFFATSLSKEIIVDVEGVVTLPKEPLKATTQQVEIQVRKVYCINRAIPTLPINLEDAARSEAEFEKAEQNGEKLVRVLQDTRLNYRAIDLRTPANQAIFRIQCHVENKFREFLFSENFIGIHSPKLIGGSSEGGASVFKLEYNGQPACLAQSPQLYKQMSICGGFGRVFEVGPVFRAEKSNTHRHLCEFIGLDAEMEIKEHYFEVCDIIDGLFVAIFKHLNENCQKELETINRQYPFEPLKYLEKTLKLTYEEGIKMLKEAGTEIEPMGDLNTEAEKKLGRLVKEKYGTEFFILYRYPLAVRPFYTMPCYDDPAYSNSFDVFIRGEEIISGAQRIHTPELLRKRAIECGIDASTIASYIESFSYGAPPHGGFGVGLERVVMLFCALNNIRKTSLFPRDPQRLAP

SEQ ID NO: 108262 - protein, 168 aa, Triticum aestivum
  Clone ID: PAT_TA_2680.pep
HASVSLSFPCLLLQQRPPPRPGRRGARHRLHFAAAPPHSIHPFAAPRPIHHNYHESLAAPHATNLNLFFLLAAVHPNLAAVHLCYCPQLSSSLSNLLMQMPSTSCCSSLLTPLLLPLLPLPRCCSASFSSPRCCYSFSLRPCCCFFPNLAIALLHLQLAAAPLNLFSS

SEQ ID NO: 108263 - protein, 139 aa, Triticum aestivum
  Clone ID: PAT_TA_2681.pep
TDDAEKQIRGRLKADLGLTPMREDNGGALLPRTGEGLALRPKSGSRPDMNNSQQDLVAAGFVPSYGDGLLAVRKSSSTPEFQDSDNNNIASVWLRRRWNLKPDAFAVPLPILLLDSLPKPLFDSLPKPIAAWRNKAARD

SEQ ID NO: 108264 - protein, 119 aa, Triticum aestivum
  Clone ID: PAT_TA_2682.pep
LLIQDDVGGLEVFKDGMWIPVHPVPDAILVILSDQTEIITNGRYKSAVHRAVVNADRARLSVATFYDPPKSQKICTAPQLVSKDHPQKYRDVVYGDYVSSWYSKGPEGKRNIDALLMEQ

SEQ ID NO: 108265 - protein, 180 aa, Triticum aestivum
  Clone ID: PAT_TA_2683.pep
MAATRACLVALVVALTFLSLAGRPSAAPASAGSLAQRRRAGGSLLGRRLKPPVAGWQVYPNLYSDSNTRLFIYWTRDAYQSTGCYNLLCSGFIQTSNQITIGGSISPMSTYGGTQYDIDILVWKDRAGGNWWLQVGGDYVGYWPSSIFSYLADSASTIMWGGEVFSPDAGQTSTHMGSGH

SEQ ID NO: 108266 - protein, 305 aa, Triticum aestivum
  unsure (1)..(305): unsure at all Xaa locations
  Clone ID: PAT_TA_2684.pep
SRVRAIDQLEVQFNQSDGGFVVVSAQEDSSTLNSDVHGQVVHSTSLTLFSNKWMRLTHEVKSGQSGKLECLSVKAIINKHLVVCCQAESPASMEDFPLWKFEDQVETLPTKDAALAFSGQKLIQVEEPDTQVDLVLDSTGPXALVGELFVVPVTILSKGHAVHSGELKINLVDAKGGGLLMSPGEADESESHHVELLGVSTASGDEVSKEEVDNIKKIQYSFGVVSVPMLVAGDSWSCKLEIKWHGAKSLMLYVSLGYSLDSSEDASLHRLNVHRSLQVEGKIPMIVGHQFLRPFRREPLLLSRI

SEQ ID NO: 108267 - protein, 207 aa, Triticum aestivum
  Clone ID: PAT_TA_2685.pep
MEGLAEAGSGGHLAPLLDVHGGGGGGGLDAALLRRLYAGHFLARWGARMWEFSVGLYMIRVWPGSLLFAAVYGVVEAASVAAFGPMVGTLVESLTYLQVLGLWLLVQSSSFIVAGVSVTALLVYDDLKVTSFPVFLALVVVTNVSGALAALSTLAGTILIEREWVVVICGGHPPAVLTKTNSMIRRIDLSCKLLAPVLSGFIISFVS

SEQ ID NO: 108268 - protein, 252 aa, Triticum aestivum
  Clone ID: PAT_TA_2686.pep
MKGVTIGYVACNKELIGVFSLSDSCRTGSAEAIKELRSLGIKSVMLTGDSTAAATHAQNQLGNILAEVHAELLPEDKVRIVDELKARDGPTLMIGDGMNDAPALAKADVGVSMGVSGSAVAMETSHITLMSNDIRRIPKAIKLARRTHRTIVVNIVFSVTTKLAIVALAFAGHPLIWAAVLADVGTCLLVIMYSMLLLREKGSGKVAKSCASSHSRKHGHGTSHHCSDGHHHEHVSAGKHSSCHDHHHEHDH

SEQ ID NO: 108269 - protein, 275 aa, Triticum aestivum
  Clone ID: PAT_TA_2687.pep
MRPWAWVAAVTWMAACSAAAAHGEQPLSMIAVERTTLAVDDAAHVKASPAVLGLEGQYSGWVELDFFHPDPSGDDWIGVFSPANFSAAICEPENKRQYPPVLCTAPIKYQFAKFKNDGYSKSGKGYLKLQLINQREDFSFALFSGGLLKPKLIAVSNKVTFLNPKAPVYPRLAQGKSWNEMTVTWTSGYDIKEAVPFVEWGEKGGRRFLSPAGTLTFDRNSMCGAPARTVGWRHPGYIHTSYLKDLWPDSMYTYRLGHRLPNGTRVWSKSYSFKA

SEQ ID NO: 108270 - protein, 216 aa, Triticum aestivum
  Clone ID: PAT_TA_2688.pep
AAAFPAAHAWAWPSPPIPPPRATAMAAGGSGGGGDIGADSERRLKKAMDKLYHFPKPKPSPSPGSKPSSSSTPSSWRAGKAADAGRRFGVVRGSRLPPQMAAMSAMSPPPPCRPWDRRDLVRRLSSFKAMTWFAKPKVVSPVNCARRGWTNVEPDIITCEACGARLLFSSPSSWTPQQVEKAASVFSLKLDTGHKLLCPWIDNICDESLALFPPTP

SEQ ID NO: 108271 - protein, 152 aa, Triticum aestivum
  Clone ID: PAT_TA_2689.pep
AGAARTSGSAGRRARPARGSRRSRRCGRRKEADGAARQMAWAEVESATGAFSSRVIGHGGFSTVYLASLSSARLAAVKVHCSSERLHRAFRQELDVLLSLRHPHIVRLLGYCDERDEGVLVFEYAPNGDLHQRLHGGDDTAPLPWSRRVAIA

SEQ ID NO: 108272 - protein, 93 aa, Triticum aestivum
  Clone ID: PAT_TA_2690.pep
RPIPPLLTHGDDQRRIWNHRERRPGGARAGRKRRDSSGDEEEGRARGAGEGWGWTGEGRGGCTRMLGFMGGDRGREQRVRAAARVRADAWADR

SEQ ID NO: 108273 - protein, 64 aa, Triticum aestivum
  Clone ID: PAT_TA_2691.pep
FFHLPTRLILLDLVVDEYLLMQVIAQLFMRLTKGYFIFIFSSILLKYRVGGFCMALSQFPSDVP

SEQ ID NO: 108274 - protein, 179 aa, Triticum aestivum
  Clone ID: PAT_TA_2692.pep
CTRVPVSGEDDDNVVQEKGEVKFDAQNSGQQSFQSMNLSEKVEEDRKTTEENKSTKEMLFYESSVPASGDEDNVVQEKREEGDVSVENSGQPPFQSKIWNEKEEDDKSTEENKSTKETHSRGSYFPESSVPASGDEDKKGEDQFSVHNLGQHSLLSDIGDKKEHGITMEKKKSAEDMPP

SEQ ID NO: 108275 - protein, 100 aa, Triticum aestivum
  unsure (1)..(100): unsure at all Xaa locations
  Clone ID: PAT_TA_2693.pep
SCPXSSWPGPCLHEQRRGSMLPHPTEDGKLGVDNGSPRPSDLSPVPFFWSRPPSSTCSSSPPRLDAGEASLPSKRSLDLMKKTAVHKTPIMDMDPSCCAG

SEQ ID NO: 108276 - protein, 146 aa, Triticum aestivum
  Clone ID: PAT_TA_2694.pep
FIMAGPTAYFRSAEMSPQEFIEIVHAYWNTKLQTTLVHALEPYSKQVKRCIEIALNCVDADRHKRPSIGEIINVLNEMETAIQVPGASMNHTGSSMNKINSDQEREFLIRDAQETLDYVHRGQGNTSFEDCRQTHIAELEEQERKD

SEQ ID NO: 108277 - protein, 210 aa, Triticum aestivum
  Clone ID: PAT_TA_2695.pep
MDEEEHEVYGQEIPVDGDMEGADVDMTAAGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHAYPYRSYGAPYFPPYGYGRVPRFRRPTRYRPYF

SEQ ID NO: 108278 - protein, 54 aa, Triticum aestivum
  Clone ID: PAT_TA_2696.pep
PFSAQIMNKNDEKLTSNLKQTSRENISSYGMKKVVLRCFNIETFKNSKGVGRII

SEQ ID NO: 108279 - protein, 56 aa, Triticum aestivum
  unsure (1)..(56): unsure at all Xaa locations
  Clone ID: PAT_TA_2697.pep
MATSTKLVALGFVGLVSIGFTNAXRMLASSSAGGGGGGSGGGGSSSGGVGSGWGHG

SEQ ID NO: 108280 - protein, 249 aa, Triticum aestivum
  unsure (1)..(249): unsure at all Xaa locations
  Clone ID: PAT_TA_2698.pep
MSATCAADLAPLLGAAAMNATDYLCNRFADTTSAVDSTYLLFSAYLVFAMQLGFAMLCAGSVRAKNTMNIMLTNVLDAAAGXALFYYLFGSAFPFGXRPSNGFIGKHFFGLKDMPQTGFDYSFFLFXQWAFAIAAAGITSGSXAERTHFSSHLIYSPLPTRYASPLACPSSWALGAWASAAPTCAPRRSSSPVIASAPAPAARTVXRGIAGFWGALIEGPRIGRFDHACRSVALKGHSASLVVLGTFLL

SEQ ID NO: 108281 - protein, 59 aa, Triticum aestivum
  Clone ID: PAT_TA_2699.pep
MSVRRRSESMEGLFLFDERNDRRSDVENSEDERRRLSIGGSLKKKALNASSKLTHSLKK

SEQ ID NO: 108282 - protein, 188 aa, Triticum aestivum
  Clone ID: PAT_TA_2700.pep
REATNTHPAAGKENPKVRGRPPRKLTGEPIRAARRRPTPGAPGAGEPAHRPAAAATLQPVPPSARVARPQIQPRPSDLAAPSPISESRARTNTWPPVEGEQRHRSSASARCTAVSPGTAPRSDPRRRPAPAPPEQEDDEAPPPPATAGLCPAAPTGGGEGGGGERGRRPAGFRVAPRSPRGSDVGGGD

SEQ ID NO: 108283 - protein, 183 aa, Triticum aestivum
  Clone ID: PAT_TA_2701.pep
MEGGKKQHHHFVLIHGARPGAWSWYRVATALEAAGHRVTAPDMAGCGASPGRGEEVASFEDYSRPLLDAVAALPEGEQAVLVAHSFGGQSLALAMERHPEKVSVAVFVTATMPAAGKPMTYAFNQLSQGKGPDFFMDCALGSAGDPRNPDKTFLFGPKYMARRVYQLSPPEDLTLGIAMVRPS

SEQ ID NO: 108284 - protein, 219 aa, Triticum aestivum
  Clone ID: PAT_TA_2702.pep
MGNTGPAGLWPSSPSSPLFFLVLPGSLSRSPSLSVFHQLQVAVALVNPRRSSVDAPLAAPELLFLLLASSASSKSPRRHGPLAPCPIPIAPRLSSLCFVQRRTMPRSTLVDRAAPGLPPFQPLQGPRPSPSAAPCAEAQPMARSGPVHPQPISSDGPRPRVRSPWPFPFVCWASLQIRPEMCFFSQNVLANFPENAAFQKSPCTSCISLLTNGASYVKT

SEQ ID NO: 108285 - protein, 86 aa, Triticum aestivum
  Clone ID: PAT_TA_2703.pep
MAAAAPPLAAALLAVLLALAAPAAAEIRSTAIRADPRTIIPLDEFGFSNQGVLELNVTGIAFDPPASPDLDLSQFGFFLSTLDAWV

SEQ ID NO: 108286 - protein, 417 aa, Triticum aestivum
  Clone ID: PAT_TA_2704.pep
MSLPIPRVARAHQGPDPSCRWQLNSRVGEPATPLPPPPPGEDTAPLLQKPSLFVFSALLGGFGPPRRGLVRPVPENLGEKCLVSARLVGGRRVPGAAASAMEAVAMSPSSVSSHNLDAASTSDDMPSSQEGLLFSDSLKDLRNLRSQLYSAAEYFEVFYTNNSHRSTVVTSLKDYAVEALVSTVDHLGFVSYKVDNLVNEKADEVNETEFRVSSVEQRVKICQQAIDQEGRSQQSLLIRAPQYHRRYILPGADIVESAIHPVSEPTRYSRQHTGRKMRKSQSAMSTPVSRQTTMRSVRSQSPTVRETHHRSRSMSPSRKARAKSPSPQVVNLNPKETRAGSPIPTAPNPLARSATVARRPPLDPKHFRQTSMQVQSDYENQKEREKRSSKGRGFLKSLLTRRRWRNDESLYNYLDEY

SEQ ID NO: 108287 - protein, 113 aa, Triticum aestivum
  unsure (1)..(113): unsure at all Xaa locations
  Clone ID: PAT_TA_2705.pep
SPSWACPAPPSRPPAPXPPRPRGADGPAVRRVQDHPRGLRPAPRAPHAPPRPVRPPPRGAPPRPRGPRPVPPPADRPPPPGALPGRAPRAAPGPAGRPRRRRTAAAESARVMR

SEQ ID NO: 108288 - protein, 112 aa, Triticum aestivum
  Clone ID: PAT_TA_2706.pep
MKWVVRCVSCGQEGHRARSCPTRVFICSLCNEEGHKAKKCPQKGQKSSEMKRKSNVRCVRCGLEGHRRKTSIIDHNTSTQVVTCFRCKEEGHCAKRCPRSPRGARCRRQRQS

SEQ ID NO: 108289 - protein, 293 aa, Triticum aestivum
  unsure (1)..(293): unsure at all Xaa locations
  Clone ID: PAT_TA_2707.pep
MEAANPNPTVVLHACLGVGHLIPMVELAKLFLLRGVPVVIAVPTPPASTADFFSSTASAVAGLEAANPSIAFHHLPPPDYPDPDPHPFLQMLDLLRLTVPSLLAFLRSLPSGAALVLGLFCIDSLDAPAQTGVPAYIYYTSSAGDLAAFLHLPHHFATTEGSFRDMGKAPLRFPGVPPIPASDMPHTVMDRADPICTIRIGHYGRIPEARGVLVNTYXWLEXRAVGAXXEGVCXPGRPTPPVXYCIGPADRPDFGGRAQRRSRRRLSGLGPQPEPAGGCFLLAFGANKWGARC

SEQ ID NO: 108290 - protein, 101 aa, Triticum aestivum
  Clone ID: PAT_TA_2708.pep
AYKRRLMRNVEGKREHEKPVSLAAGVYCSTPRSRARTQYKPQSRSRVLRICAARTWVNCSCASPRSALRATLAPAEPKGTRSAGPIGARGLVPRQSKKVLL

SEQ ID NO: 108291 - protein, 181 aa, Triticum aestivum
  Clone ID: PAT_TA_2709.pep
ATSYPAGYAMAAAVEMQHLKHSGDHFSFAPFRKSFEEVGIGADQVPSDQLGRSEHQQHAGQEQQPHRPDLATTAVPATAFLVSRPTNPISATVPPPLQHTSVVLDHDQFHVPAIFLHHDKFQNMQQQQQHQQKIDRRSAGLEELVMGCTSTCTKGETSIPHSQETEWPYPYWPPDNQDHHG

SEQ ID NO: 108292 - protein, 104 aa, Triticum aestivum
  Clone ID: PAT_TA_2710.pep
MNPDRKTTLELSVRAYAETRHGPVVNPETGTAFDSLDEAYEFYNLYSWECGFVVRLAKSRMNVRRKRCMQEILCACADKPMRKNSRSSRCGCEAMIRLLRPNFT

SEQ ID NO: 108293 - protein, 170 aa, Triticum aestivum
  Clone ID: PAT_TA_2711.pep
MDLQQVMEHQLFDDGAVPSCMISPLEADNGFTDELPSLQLPDLDLDFDIHEFSAPATAPAKAASSGGSGLVGSGSGSHKKLNHNAYERDRRTQLNQLYSTLRSLIPNADHTKKLSIPTTVCQVLDYIPKLQKQVEDLKKKKQELSTAKCRERLQRVKDNTCRIVSATPLD

SEQ ID NO: 108294 - protein, 217 aa, Triticum aestivum
  Clone ID: PAT_TA_2712.pep
PHERRRLEKKKGYPHSFRAQTENIRGKSSNKAILEDMGDDSKNRHTLSEQVSEDGNGSSGQQDADGTGCNSQAEDLTVSQRSASLSISMDDSTCDPNKEKLGSDGMQRSSSGTQANGHLDEDPVSSDNSSQAISKNADKKISLLGHGHHGKQVVELLLANGGEEAVHQFCQRWRHVFVEAVHPRYLPSGWNIKHSGRRDFGDFSVYKPSNQEPQPVD

SEQ ID NO: 108295 - protein, 308 aa, Triticum aestivum
  Clone ID: PAT_TA_2713.pep
PASLPEDEDAVISDKDLNKRGSKSPNKELVDNSQDKHEDNAQPSDDSIDAVDEEAHLPPSSSPTKNTDDSSSEDEEEEEDNDKENIYPGIKKNDLASHQQPRRTLASDSRPDAAVLKDFLDVEAEEEDDSDDDMARFKDNEEDDGDDENEVLTALIAAGFEEEEVDHEKRNALHQKWLQDQDAAETNNFIQRLKYGHQEQKVLMEEDEDDIEDCEDESENERSHDLTPNIVRQNSEKAKQMIAKMFTDENDTYEHSDDEEIEEHLARQRISKREVHSTSFISPLEDDSSREMFSLIKKLNIAPQAPGK

SEQ ID NO: 108296 - protein, 178 aa, Triticum aestivum
  Clone ID: PAT_TA_2714.pep
DPCPMEEPAAAGPDWSKLPPDVLTTVLGDLEFPDLFRTADVCTAWRATARALRRLGIYSRPQTPCLLYTTAAAGPRAAELFSLADKKAYRARLPDPPIGERNIIGSSHGWLVTADARSELHLLNPATGEQVALPSVATIEQVSPVLDREGNLERYHLSLHGDDSQPYGVDNSAESLSE

SEQ ID NO: 108297 - protein, 211 aa, Triticum aestivum
  unsure (1)..(211): unsure at all Xaa locations
  Clone ID: PAT_TA_2715.pep
DNPAGLLAIAEETLAEFLSKATGTAVDWVQMVGMKPGPDSIGIIAVSHNCSGVAARACGLVSLEPTKVAEILKDRPSWYRDCRCVDVLQIIPTGNGGTIELIYMQTYAPTTLAAPRDFWILRYTSGLEDGSLVICERSLTQATGGPSGPNTPNFVRAXEVLPSGYLIRPCEGGGSMIHIVDHVDLDAWSVPEVLRPLYESPKILAQKMTIP

SEQ ID NO: 108298 - protein, 265 aa, Triticum aestivum
  unsure (1)..(265): unsure at all Xaa locations
  Clone ID: PAT_TA_2716.pep
NFAVVGAPALNLTYLQGLNLTVNPPINSSLHDQLVWFQKLKPSLCKGQGTDCFGSSLFVMGEFGGNDYISFLLSNRTVEQARPYVPQIVDSISRGVERLVQHGAKYIVVADIFPIGCLPGALTNLASPNKVEYDRHGCLKRVNRLARYHNSLLRQQIKMLRYKYPHTKIIAAEYYKPFLAFLDMPGHFGLNSSTTLLTCCGAGGPPYNYDXATQGCGLPGVTACAIPSQALHWDGFHLTDPAXTAVADGWLHGPYAAQPLANGAR

SEQ ID NO: 108299 - protein, 164 aa, Triticum aestivum
  Clone ID: PAT_TA_2717.pep
MAVSSPSSAPEKKRKWLQSNRKVIDRYLREARAILATAPDTGGGDAVAALGLIDAALELSPRMEAALELRARALLALRRYREVAEMLRDYIPSCGKSCSGEDASSSSSLSSCSSGDLGTISRAKLLSPERHRSDAAETDTGTARSFRCFDVSELKRRVLAGLSK

SEQ ID NO: 108300 - protein, 92 aa, Triticum aestivum
  Clone ID: PAT_TA_2718.pep
KYRDGEWQGLVSCIDRSVWPSARLVIFLLMTATKLSIHQAERELIIRTLYHLLIDKPHVPDDSGIQKEIICLHVWEVQGRPTIFCIMLQGPL

SEQ ID NO: 108301 - protein, 273 aa, Triticum aestivum
  unsure (1)..(273): unsure at all Xaa locations
  Clone ID: PAT_TA_2719.pep
RGRVDINGFEMDTFEFLNIMQVHGFPXVMGVLTHLDQFKDVKKLRKTKQRLKHRFWAEIKEGAKLFYLSGLIHGKYTKREVHNLARFISVIKPIPLSWRMAHPYLLADRFEDVTSSESVRLNRKCDRKITLYGYLRGCNMKRGTKVHITGAGDFSLSGVTSLADPCPLPSAAKKRGLRDKEKLFYAPMSGLGDLLYDKDAVYININDHLVQFSNTDDNNASKKQGKGNDVGVALVKTLQNTKYSLDEKLDQSFINFFGRRPAAQSEDSDMTGN

SEQ ID NO: 108302 - protein, 54 aa, Triticum aestivum
  Clone ID: PAT_TA_2720.pep
QMKQTDHLQDTDLTPCTEQRFGHKLLTIISCNTCRRPIEHRDQELKVTNQTMES

SEQ ID NO: 108303 - protein, 409 aa, Triticum aestivum
  Clone ID: PAT_TA_2721.pep
CRFGTKHNIPPRTHTTSISSPLPQNPSCPQVSSSAMAAAENAGDVAAGESRKLFVGGIPSSAQETELRGHFARFGAVRSIVVMRDKESGHGRGFGFVEFEDEEAAAKALGDGERPKHFICGRLVDVKRARARPPRNLGEQPVHQHQHQHQLEQGPVQGHQDAGDSTEASSDSMSYASKKVFIGGLRDNITEEEFRAYFEAFGTVTDVVVIYDSLTSRSRGFGFVTFDSEEAVRKVMRQSFHDLKGTRVEAKIAIPKDAQYYRNGRGRGSRTFGGRGPVGFDGSTYQPYNNRHGFYNGYMPQPVPTHPYYHGLYFGMGGNPYANAYPNHAVMANVPNMVARRPVYSPYPPMYPGYGFAYRSGYAGAAPSVQYGVNGGRDYMNDQDSMDVQELDSTATIATKFEYMKLGSQ

SEQ ID NO: 108304 - protein, 216 aa, Triticum aestivum
  Clone ID: PAT_TA_2722.pep
GPSLSRSSCSSMSSFLLSLRRSECLSRGIQRGNGLGDRMGGGTSSGSKKRRRGSGSGGGGAAEPPQQPPRGGEVTQRKGGLLPDSWGSATPLDRQNGHPQFGAYTGVNVLRSKPPHRPPSRLLAVSSAFPVHPNFGMGYGERGDARYGEFQTPIVRSPSSSTTYGPPHYAHPRVTLPLFAPEDSTRLRGHHDRSRSADSTSMNSDDPEDVGLVLKL

SEQ ID NO: 108305 - protein, 223 aa, Triticum aestivum
  Clone ID: PAT_TA_2723.pep
SAAAAAGREAVKHFGFDPPRAAEVGGAKAPNGVAPTAAATVMHHAQWNAHFGHPLPTNVRRSFRKKTPKVVQPLLCEVCKIQCDTMEVLLIHKTGQKHKKNLQKLQDAITPQPAKPPNSGVAANTAPPAAAAATADGVVPAVQPKKNKSSNASPADLEVKKRRVIEAGAAHGEMKICTACNVVVNSQKVYEFHLAGQKHKANVQKQQKRQQQQQQQVQLQHVA

SEQ ID NO: 108306 - protein, 627 aa, Triticum aestivum
  unsure (1)..(627): unsure at all Xaa locations
  Clone ID: PAT_TA_2724.pep
QRIARCTGAQIVPSIDLLPSQKLGYCELFHVDKHIEHSVTSGNKTKKMLKNMMFFEGCAKPLGCTVLLKGGSMDELKKIKHVVQYGIFAAYHLALETSFLADEGATLPELPLGSPLTVTLPHKRSTVDNSISTVPGFTINISNSQQATDSFEHLDTDIVISIDPGGTAVVEPPVDSDCLTSQRPTXHSFGPLCTSGCSFNSSNGDKLEKVTATADSVSMSSITTHDVPTDPSHIYSTVEKKCVYSGDYHADYPTSSDGKAVRADSINTNHHQSTSAVSTNITNYSNLKEPLEGSNALPNVRIVNANNLLVVQPMSSPAMQNQETSQGHDVTSNKTEIVPSDHQSILVSLSIRCVWKRSICERSQLLRIKYYGNFDKPLGRFLRDYLFDQGYQCRSCDKPPEAHVHCYTHRQGSLTISVRKLADVVLPGERDGKIWMWHRCLKCPWXSDGFPPATXRIVMSDAAWGFXSLVNFWELSFSNHAAASRVASCGHSLHRDCLRFYGFGKXVACFRYHLLSHQXHVHPKLYFTHRPVGWVLIRVGEVIDRAKVLFDEVSRTLHLISEKKAHCSSLNVECTNYIAELESMFRKEKLEFEVRCLLIPHSCNISIKVELNCNSNTWKKKKKNKKK

SEQ ID NO: 108307 - protein, 202 aa, Triticum aestivum
  unsure (1)..(202): unsure at all Xaa locations
  Clone ID: PAT_TA_2725.pep
MAGRGLLAAGLVLLAAVAPAYAADYTVGDSSGWASGVDYSTWASDKTFTVGDTLRVXRYGASHNVRGGGVSRTTSACSATNSIQSFXDQSPQGHADQVRLPRYFIGGGQCSLSLLGMKLAAFGSSPRSCTPSTPMAPPXVAPLTPSTPSVTLSKSPDSITTRACATTFKNRGXVGRASDVEARSVMGSLVGAAGLVGLALMG

SEQ ID NO: 108308 - protein, 197 aa, Triticum aestivum
  Clone ID: PAT_TA_2726.pep
PAWACRPCSPGPAFVLSWHQPRGPNGSVSGLACPQGPEAPLCRSLVAWGAGSCPDSLTASAAFWAALLGRNTCLIFVRGRPWHVRARGLGLPQPRHGPYLWAGAHAWFASVLCRGMLLCLPWSTQCRVFRSTRGHARPRARCMPLVERAFVLPGGPPPWMSVAQGAIPVILQGSSLKNSLQVNWLPQWMFLAQKAIS

SEQ ID NO: 108309 - protein, 227 aa, Triticum aestivum
  Clone ID: PAT_TA_2727.pep
MSKTPGKTPRTPRRILESYTIKGSDGVIRPGDSVLMKAPDTSKPPYVAKIEEIEAAGPRGANVKVKVRWYYRPEESIGGRRPFHGEKEVFLSDHQDVQSADTIECKCNVYSFRDYTKLSAVNPEDYFCRFEYKSITGSFVPDRIAVFCKCEMPYNPDDLMIQCEECSDWFHPACIGKTIKEAKKLENFTCEGCVAENGNGNGVKNENSHESTGESDEKQVQSKRRRR

SEQ ID NO: 108310 - protein, 178 aa, Triticum aestivum
  Clone ID: PAT_TA_2728.pep
RAPGNGARSRRTSGHRPCRPGSTREGARRGQARRPRRSCEGVPRVAERGVGGARSSPPRARARRRHGHMACWIDAAASWLKLRCQGCSGPGCHPVELSFCSSRPLWHVSPLIIQEKFYWQTSGGQGDDATELSSSEIPALNAWILGNNCGIIGLTGTGKWRTELAIVRSLILPTSLHT

SEQ ID NO: 108311 - protein, 308 aa, Triticum aestivum
  Clone ID: PAT_TA_2729.pep
GVLFLPSGGLLATAGGTTVKIWDVIGGGRLVHSVVRPVKTIFALALGKMGATGETRLLSAGSDGYVKCFDYGELKMTHSMRYPKELLSVACSPCGTVLVAGSSKGDIFVRRRKKNATEEVEEEVVSSEFAWTMPKPEKQALKPSYYRYFLRGQNEKAKQGDFVISRPKKAKFAEHDKLLRKFRHKDALVSALAKNNPRSVVAVMEELVARRKLVRCIGNLDVAELGLLLDFLHRNATLPRYARLLLGVANKVLEMRAEDIISEDGGKLRGCIRNLKRMVVEEIKIQHTLQEIQGMISPMLALSASRLK

SEQ ID NO: 108312 - protein, 404 aa, Triticum aestivum
  Clone ID: PAT_TA_2730.pep
TLLPLSANASSKLYIVYMGEKKHDDPSVVTAWHHDILTSVLGSKDESLKSMVYSYKHGFSGFAAMLTKTQARTLANFPEVISVKPNTYHMAHTTRSWDFLGLGHNKSPQQTAPRRKANYGEDIIVGVIDSGIWPESQSFDDNRYGPVPARWKGICQTGTAFNASSCNRKIIGARWYSEGIDAMHLKGEYMSPRDFSGHGTHVASTIAGGEVHGVSYAGLATGMARGGAPRARLAIYKVLWGPNTAASDASILAAIDDAIHDGVDVLSLSLGRGAGHEFPGTLHAVLRGISVVFSAGNDGPAPQTVTNVAPWVTTVAASTMDRAFPTFISLGNKEKLVGQSLYYNSTLNNDVFKELVHAGSCTEEWLASSNVTGKIVLCYAPREAPSMLPRVELPRTINRTVSAG

SEQ ID NO: 108313 - protein, 157 aa, Triticum aestivum
  unsure (1)..(157): unsure at all Xaa locations
  Clone ID: PAT_TA_2731.pep
IKQLHEMCLLPIAIQSTMAPLSSQIRTPLPPCDLCEPPLKDELGRASTFAFSKFGKCFDVLFVNAQDGSLVVAFRFKLFTDLVRTLKNKLSLSAADGEQRGLGVGRHRRLRCERPLVPNSCSPGDPLVLERAATAVELQLLFPLVGXVRGRGENTXX

SEQ ID NO: 108314 - protein, 216 aa, Triticum aestivum
  Clone ID: PAT_TA_2732.pep
RGLLYLHRDSRLRVVHRDLKASNILLDHEMNPKISDFGMARIFGGDKNQENTNRVVGTLGYMSPEYAMEGLFSVRSDVYSFGILILEIITGQKNSSFHNMEGSLNIVGYAWQMWNSDKGEQLIDPLIRASSSASASREALRCVHMALLCVQDHAGDRPDIPYVVLALGSDSSVLPMPRPPTFTLQCTSSDRDGFRGKAGDESYSACDLTVTMLQGR

SEQ ID NO: 108315 - protein, 309 aa, Triticum aestivum
  Clone ID: PAT_TA_2733.pep
RHSAPLRSSKQTQAAAERRRDARMHAKTDSEVTSLAPSSPARSPPRAANNNAGSGGGGGGVMRGSVYYVQSPSRDSHDGETTTKGATSVHSTPALSPMASPRHSHSSVGRDSSSSRFSRGGAHHKDKSAGRKGAPPGKGWQEIGVIEEEGLLDEEDQRRPMPKRCKYCLIFVGGFAVLFTFFALVLWGASRSRETNGMKQSITFENFIIQAGTDASLVPTDMATTNATVKFTYKNTGTFFGIHVTADPFTLSYSQLNLAAGDLKKFYQGRSGRRTASVNVKGNKVPLYGSGPTLMAQPAGGKGGAGKVI

SEQ ID NO: 108316 - protein, 380 aa, Triticum aestivum
  unsure (1)..(380): unsure at all Xaa locations
  Clone ID: PAT_TA_2734.pep
MEPHPRSSPPSHLPRSPPCSTKQIQAAAERRRDARMHAKTDSEVTRLAPSSPARSPPRAANKNPNSGGGGGVMGGSVYDVQSPSREWHDGATTTKGATSVHFPPALSPMLVPXAPPTSPVAADSSSSRFSRGGCRPQGQXPGRKGAPPGEEGQEIDVIEEEGLLDEXDHRRPMPIRCHVLPSSLWDGYVVLFNFLALVLVGTPRRSQNGRMIAMKSITFENLHRSXGRAAGKVAAGRMVMATTKPTVTFTXKETVTCVVIQVTADPVALSYSQLNLAAGDLKKFYQXRSGRRTASVNVKGNKVPLYGSGPTLMAQPAGGKGGAGKVIPVPMVLRTTVRSQAYVLGALVKPRFTKEVECKVVMNPAKLNKPVSLEKACKYS

SEQ ID NO: 108317 - protein, 116 aa, Triticum aestivum
  Clone ID: PAT_TA_2735.pep
PLLGIVFTSVSQSCQSIGQSVGHSVSQSIRAVRSVSVSVQRRVARASDRRPSASPPGANRASFRARALGQPFERRLDEVLGASPICLQQHQHRAFPHKPLLSELHVPRLPPGPFAR

SEQ ID NO: 108318 - protein, 312 aa, Triticum aestivum
  Clone ID: PAT_TA_2736.pep
VTGNGVEVGASLESEERGKSAATFECNICFEMAGEPVVTSCGHLFCWPCLYQWLNVYSNHKECPVCKGEVTEANITPIYGRGNSCSDAEKAVDEGKQPGLTIPPRPHGNRLESFRQQFQHLRPMSRRLGDAHGILSSWRRLLDQQIMSSVSRFEGPSEPAVHETGDIAPHTGRLSRLTTRMRARRLLSEVDNSPDAAFVAPDSGLPGNSAPDAPRDASGPVLPEGFDLLQRLTLIGIANTERLATAMSDLRRIATPGQHGASPSLLGALAPPGLLRASPSSADPLRPVGTAVRPHVPSPFHGSVLTWNSLRP

SEQ ID NO: 108319 - protein, 174 aa, Triticum aestivum
  Clone ID: PAT_TA_2737.pep
FGRRYDNSAHASGSQGRYRRENKNNRRTSGSSRLDDDTEASGEDWDTDDGRDSMVCFDKERHIPDEHPRRFDSMRHDRSSSSHRQNYMPGASRSPSRTPKNAVSVSDDSEDDVSDSEDDEVWGADYKEETSSSAPKVNFSNYKSSSEEDTGDNWMRGGRTSRTKKNTDEDWDSD

SEQ ID NO: 108320 - protein, 93 aa, Triticum aestivum
  Clone ID: PAT_TA_2738.pep
MELQEESSDVGALVSAPSRNLSSSSSTFVSANQSPFFTPRSLSACRPEHAHVEHNNSPTGIALKIGDILSSDTLVQRGQLPSSANIRLLLDDA

SEQ ID NO: 108321 - protein, 242 aa, Triticum aestivum
  Clone ID: PAT_TA_2739.pep
MKEVVLHVYDVTNSDSEKTNNTILQINRIFKDRIGLGGIFHSAVQVYGEEEWSFGFCENGSGVFSCPVSKNPMYTYRERIVLGETECTIATVNRILRELSRDWPGHSYDLLSRNCNHFCDVLCDRLGVPKLPGWVNRFANAGDTAVVVAENTAVKFRQAKTEIVNASRVAYRFMAGLTSKNQASQESPGEQNRGSPTFQGTWFKNVVSAGAKPSTSGSTPSQEADDAPPLQRQQSAEQPIRL

SEQ ID NO: 108322 - protein, 144 aa, Triticum aestivum
  Clone ID: PAT_TA_2740.pep
IPAAAFAALAPTTSPRRTSIRRQWRSQTRDGHGLGGRICSTSAPGEERSRPSPPLCVVPLDGRAVPREARARLLRRLKVHEGPRCWRGAGDLTNSTTHTLPPFMLRPASAGPARRDFRFFLSHDAFSKPLKESGVHVSLSNTSL

SEQ ID NO: 108323 - protein, 219 aa, Triticum aestivum
  unsure (1)..(219): unsure at all Xaa locations
  Clone ID: PAT_TA_2741.pep
PVDISEAILRENAEAILATYLHLTVQGLVSTYQLALASLPDHNYPHRLMAFLGSSLGNFSPEDCQGYCEQVGEALDPGDYSVLGGDXCNPADVVGAAYNDAQGVTAEFNLNMLRHLNWRFQGNFALDNFSHRAVFNQQKSQIEMYLRSGTKQTVRLENLDLTVDLQAGETILTEISRKFSLHANNPNAIPRQLADHGLEPLQVWTDDQQWFAVILSRVN

SEQ ID NO: 108324 - protein, 222 aa, Triticum aestivum
  Clone ID: PAT_TA_2742.pep
RIYYTKCFVSVDSIDNIFRSILTAQKITEEQHNQLEKYINTIEDFCRMFMPKFESINDSLMSDEEYSEKVYKEFSSPRYDSNEQNEQRYKYNYKYSKVGEMYIMNSMASLFHQMHSIGESIKFLYVKKKSDEYIKELCENKLMVTIESEFNVCRERLRELRKTNIYISPKVFDGLYEKYLMSDYQEEDARLYADYRESNQGQEYFAPNDDCYLPLVDDGQYS

SEQ ID NO: 108325 - protein, 159 aa, Triticum aestivum
  Clone ID: PAT_TA_2743.pep
ANGNAVSLGAPPMKPGTATKPIASGGGSSGPSLGSGQPRAERPGAGNAGANVGPIAANPVASSAPPKPKPTPSSPAKPDPLKCVSQCKPSYPSILQGEEGSATVLISVNDSGGVTSVTITNAHGNSEVNRQALLAARKMQFTAPASGQSKSVPVVIHFT

SEQ ID NO: 108326 - protein, 109 aa, Triticum aestivum
  Clone ID: PAT_TA_2744.pep
SPEPVSDSFPMDYEGEGLPEQPEPWSTGGLGDRDEWELAPPAGEACYRQPELEGLLHSLYSARSVLVTSGEGMGKTYLVRQVWERLLSDGVTCQYFEPATPKTLLMAMA

SEQ ID NO: 108327 - protein, 72 aa, Triticum aestivum
  Clone ID: PAT_TA_2745.pep
TETIYLDDEPPDRLEGYINPMTFISGQLTIDDPTMLRLEQSAIAFAPIRNAGGFVTLDHAPIETAIPGYRAR

SEQ ID NO: 108328 - protein, 194 aa, Triticum aestivum
  Clone ID: PAT_TA_2746.pep
RIGGMWSLILAIFIWPFRPNQPLRQMVANNYSILGNYLRAMAAANFSPDDPQAQQLVVKLRQNLLKSRQTLVASQRGLWGQSKLRELLLVLIEHTERLNKCLMLLNEIVNFHNLPQLQTVEILMEDAFNALGEVCLDLGQMVLGKRRIPNTNRLQLLVQALQQQKKLQRQALTEDFNDYNSLTTGTQLVNHLEN

SEQ ID NO: 108329 - protein, 61 aa, Triticum aestivum
  Clone ID: PAT_TA_2747.pep
ELGTRGSGRKSWGAKKLEANRSNSWRCNHRGNNHLPSKECQPLRIGFISLALIAKYVHTTA

SEQ ID NO: 108330 - protein, 82 aa, Triticum aestivum
  Clone ID: PAT_TA_2748.pep
MAPQPTATTTLAVVGDIHEQWELADHQALQAIGVDLALFVGDFGNESLPVVSLIASLPIPKATVFGNHDAWFTASDWGRKKC

SEQ ID NO: 108331 - protein, 113 aa, Triticum aestivum
  Clone ID: PAT_TA_2749.pep
RARYPGIKFLATEDIQQLASLPRATSADLARAQTHNLNPRLRQNLQALITRAYSQIYQGDRRQEWGKVKEFYLWQLPLVLRQTGIYTMAAFGIFCFASAIAWWYSWRDPQSRP

SEQ ID NO: 108332 - protein, 306 aa, Triticum aestivum
  Clone ID: PAT_TA_2750.pep
LTEAGLELTLATTGRLSTPTTSVVGNALIVDIPNAILALPDSDGLQQENPTEEIALVSVTALPDNIVRIAITGVNVPPTVEVNATDQSLVLGLSPGKGVADEEDGNDAIQVVVTGEQDEGYAVDDATTATLTDTPLRDIPQSIQVVPQQVLEDRQIIRASEALQNVSGVQRGNTVGGTSEIFNIRGFQQFGGTLRDGFKFRDNFSIPDTANLQRIEVLKGPASVLYGNLDPGGVINYITKQPLSEPFYEVAMQAGNFGLVRPTIDLSGPLNSQRTALYRLNAAYEGGGNFRDFDTEVARFFISPVV

SEQ ID NO: 108333 - protein, 121 aa, Triticum aestivum
  Clone ID: PAT_TA_2751.pep
MRILLVEDETDLGMAIKKVLVSEKYVVDWVTDGSQAWDYLENQWTEYTLAIVDWLLPGLSGLELCQKLRTQGNSLPVLMLTALGEPENRVEGLDAGADDYLTKPFVMAELLARLRALQRRS

SEQ ID NO: 108334 - protein, 86 aa, Triticum aestivum
  Clone ID: PAT_TA_2752.pep
WRWVIPSAFWPSGHLSSGERNSKGATLCSCSDTRCIKNYDMAEFLKLELLKETGFVHMRICDGVGSFLQLSGLLAKFALVRETAKA

SEQ ID NO: 108335 - protein, 183 aa, Triticum aestivum
  Clone ID: PAT_TA_2753.pep
VDLGMQSILISGACSPQSLVKVVNFDNVIGTIGNDIIIGDDQENILDGGKGDDSIVGFQKNDTLMGGHGNDTLNGRAGNDLIIGGADKDILTGGMGNDLFDYTNLKDSQLGLSWFNVNLSKVDVITDFTRGEDKFLVQSAPTNNGFFSPAVRHLSVNSILGLGATVLGLATLGQYDAAQITVG

SEQ ID NO: 108336 - protein, 116 aa, Triticum aestivum
  Clone ID: PAT_TA_2754.pep
MATSRRVSRVSSLIKREVSQMLLHEIKDDRVGTGMVSVTEVEVSGDLQHAKIFVSIYGSPEAKASTMAGLHSAAPFVRRELGQRMRLRRTPEVSFLEDRSLERGDKILNLLNNKPQ

SEQ ID NO: 108337 - protein, 266 aa, Triticum aestivum
  Clone ID: PAT_TA_2755.pep
PPVITWTSETAVIHGMPPDYSPPDVGTAVQFYAPEFREFIMEVFERCVQQGEPFDVICQLQVPDGRRPWIRAIGEAERDAQGKVIVVQGAFQDISTLREAQERFQLISKAANDVIWDWNFATNQVWWNDSITDLFGYALLDMEPGLESWTLRIHPDDKERVLHSIYQVIDGEENYWECDYRFMKSDGQYANVIDRGFVTRDGQGKATRMVGSMLDITERMAMEQRLRESQKMEAVGHLTGGVAHDFNNLLAVILGNAEMLAELVTD

SEQ ID NO: 108338 - protein, 40 aa, Triticum aestivum
  Clone ID: PAT_TA_2756.pep
SSVPGDPFDRMIIAQAQQHNFSVISKDENFKKYNVNLIWE

SEQ ID NO: 108339 - protein, 162 aa, Triticum aestivum
  Clone ID: PAT_TA_2757.pep
LSFFFFLGKLMTKIYRCKLTLHDNVFFASREMGILYETEKYFHNWALSYAFFKGTIIPHPYGLVGQNAQTPAYLDRDREQNLLHLNDSGIYVFPAQPIHWSYQINTFKAAQSAYYGRSVQFGGKGATKNYPINYGRAKELAVGSEFLTYIVSQKELDPLKST

SEQ ID NO: 108340 - protein, 179 aa, Triticum aestivum
  Clone ID: PAT_TA_2758.pep
YSTGHAPCDDVYVYYLDAPLTKKVSANECGIVQISLGSIPHTGSTEVTLIGVGPATVSSFPLMAKADAPKCSNGVATNIPAEGKARYVPNAETGNQSLVWTGQTPFTQYDITFPIPKERKLKSNACGVATISSSSSYPSTGTFRMGASPTVHNFATVTGVNAPPGCKNNTLLLPVGFPN

SEQ ID NO: 108341 - protein, 111 aa, Triticum aestivum
  Clone ID: PAT_TA_2759.pep
NPIAHAEMLAIQTACRRLGHWRLNECTLYVTLEPCPMCTGAIIQARLGLLVYGTPDPKTGTIDSVFDLAASAASNHHLQSLGGVCQEQCREQLQDWFAQHRARKKQQSLVS

SEQ ID NO: 108342 - protein, 233 aa, Triticum aestivum
  Clone ID: PAT_TA_2760.pep
RCGNPYCQTTSRLWGLPLLRLDMGRVYDGSMVGRSEANLRNALKTAESISPAILFIDELDKAFAGGAGSGDSDGGTSSRIFGSFLTWMQEKTSPVFVMATANRVDRLPGEFLRKGRFDEIFFVDLPSSEEREAIFRIHLHKRRKDTSRFDLGELARTSDGFSGAEIEQAIVAAMYEAFAQEREFNQLDIIAAIKSTLPLSRTMVEQVTALRDWARQRARPASASVAEYQRLEF

SEQ ID NO: 108343 - protein, 79 aa, Triticum aestivum
  Clone ID: PAT_TA_2761.pep
MTLLDLSVGQLAFVEKILLGNHGQGLVNRLEAMGIIPDKPIQLLRKAGLGGPLHLRIGSTTEVAMRRSEAQLVQITLGE

SEQ ID NO: 108344 - protein, 83 aa, Triticum aestivum
  Clone ID: PAT_TA_2762.pep
MIITDTAFKGGVGKTTSSIHLAAYLNNKAPTILIDGDLNRSALLWASHEKLDFPVVDEREGLKAARNYEHIVVDTPARPEIKK

SEQ ID NO: 108345 - protein, 171 aa, Triticum aestivum
  Clone ID: PAT_TA_2763.pep
ALAQAKLLEQEREIRQQLIEQNKALMTATKAAEDANRAKSDFLATMSHEIRTPMNAVIGMTGLLLDTHLNTQQQQFTETIRSSGEALLSLINDILDFSKIESGQFKLEIHPFEIQQCVEECLDLVAPQAFAKKLDLVYQIEPQVPMAILGDLTRVRQVLVNILANAVKFTT

SEQ ID NO: 108346 - protein, 142 aa, Triticum aestivum
  Clone ID: PAT_TA_2764.pep
MVEGFSRRSEFTLARGGDITQGNSLTNGLDWGFKQLTRLCSLAVVVILGWIAWVVFTDARPAIAKFGWEFIVSQQWDSSGQLFGGLPYIFGSVVSSFIALIFALPLGLAVAVMTSENLLPAPERVPIAFLVELIASIPSVIL

SEQ ID NO: 108347 - protein, 223 aa, Triticum aestivum
  Clone ID: PAT_TA_2765.pep
QVYSDFNIINFTAGNTVAQMAGWFKKPVESLADLRGLKMRIPGLGGQVMAQLGVNVQVIPGGELFLALDRGTIDAAEWVGPYDDEKLGLNKAAKYYYYPGWWEPGPSLDVLVNQSQWAKLPPEYQAIFQEAARSANLLMLSRYETFNSIALKTLLDGGTILKSFSPEILTVAQETSRALLAEFASKDAQFKEIYQQWQTFRSQMFSWNAINELSYTKFVEKAP

SEQ ID NO: 108348 - protein, 165 aa, Triticum aestivum
  Clone ID: PAT_TA_2766.pep
NQKLRGIIWFRMAYYTPVITSIVVAGIAWKALYASNGILNQILALLGFSDGIPWLTSPNLALWSVMVVTVWKGLGYYMVIYLAGLQAIPQELYEAGAIDGADGWRQHWDITIPLMRPYCFLVGVLSSISALKVFEEVYIMTQGGPHNASKTVVYYVYERAFQDPK

SEQ ID NO: 108349 - protein, 211 aa, Triticum aestivum
  unsure (1)..(211): unsure at all Xaa locations
  Clone ID: PAT_TA_2767.pep
VISSGNTLPTAANITLPTAGSTESQGGTPQPDLEAFEGMLVKFTDTLTITEMFNLDRFNEIKLSQGGRPQQFTQFNDANVAGYGAYREEIGARTITYDDGLSVQNAEISNLDGFGSSFSTASDIRMGDTINNLTGVLSYQWAGNASSGATWRVRSAVDGTNQFTKVNDRPVTPENVGGSLKVTGFNVLNYFKTIDLXSESTAIGQDPRGAD

SEQ ID NO: 108350 - protein, 163 aa, Triticum aestivum
  Clone ID: PAT_TA_2768.pep
IFIPTADILRELAQFAPWEVDVITLSGSGEPTLAKNLGEILEGIKKLTGKLTLVLTNATLLNDAQVREELSLADKISVKLDGLWPDQLQRINRPIAGIELEQILTGIQTFQQEFTGELSVQTMVLQPWDQTAESRYLELLSLIKPTEVQLNRPTRPKPLQREL

SEQ ID NO: 108351 - protein, 156 aa, Triticum aestivum
  Clone ID: PAT_TA_2769.pep
MDKLESIYAFTQVVREGSFAAAARKMNLGRSTVNKMVIALENELKVQLLHRSTRKVTPTPTGIAFYEKSVQILADLEEAELSVSQLHGEPKGLLRVNAPMTFGTMYIAPLVAKFMALHSQVEVQLTLQDRFVDAIAEGYDLLIRIAQPLESASLIL

SEQ ID NO: 108352 - protein, 131 aa, Triticum aestivum
  Clone ID: PAT_TA_2770.pep
SSVPGDQCFPAPREEFLRTWCHQSGHQAIAYQEDGILRGYGVLRPCRVGYKIGPLFADTPEVAEIIFLALKAIPTAENTIYLDVPEPNQAAITLATKYSLQVVFETARMYTGQAPSIALDKIYGVTSFELG

SEQ ID NO: 108353 - protein, 108 aa, Triticum aestivum
  Clone ID: PAT_TA_2771.pep
GSPGLLFHAREQMLSFTAELRQKLMQPPTSPLAAFDLAKMVDGNLDNSAQLWLVDYLQYHYWHGHHQRPWLEILEKARKYLAAYVQPRLVWETTFLALYRLENSGDRR

SEQ ID NO: 108354 - protein, 178 aa, Triticum aestivum
  Clone ID: PAT_TA_2772.pep
AIRKSKKAETGWKKNPQNTLPSLAENYLGSIPTDLILTLPSIDISTVHPLTMDENIGLSLGIEQFNRQDFYACHNTLEAVWLEANPSEKNFYQGILQIAVAHYHLGNHNWRGAVTLLGQGIRRLKGFRPDHREVDIESLFRSSVLLLENLQTITPENLPQWLESAAAEQLTPQIEIKS

SEQ ID NO: 108355 - protein, 164 aa, Triticum aestivum
  Clone ID: PAT_TA_2773.pep
FVETTGETPGQLRLAYAFSLPPFISSSEIQGAVAKVIAVCENLGHQLEEACFDVTSLIEPFAQIWKAGVGASGIPLPLLESVNQWLGETSGTAGDYLRGVRNMQVISRQIVGFMEQYDALILPVFNHRPPKIGEWTHLSPPDVVQKNIEWIAPCPPANAAGLPA

SEQ ID NO: 108356 - protein, 132 aa, Triticum aestivum
  Clone ID: PAT_TA_2774.pep
MGTFTYERQVYLADTHGAGVVYFNQFLQMCHEAYESWLSSEHLSLQNIISVGDFALPLVHASIDFFAPAHCGDRLLVNLTITQASAHRFCCDYEISQAESAQLLARAQTHHVCIALPERKKAPLPQPWQTAI

SEQ ID NO: 108357 - protein, 76 aa, Triticum aestivum
  Clone ID: PAT_TA_2775.pep
MDNATITAIATGLLVVVGIAQIGILTSQNRQTRLALVSEYWKRWHNSKDYWGRIIFVGRELDEYYQVLNQKELREL

SEQ ID NO: 108358 - protein, 148 aa, Triticum aestivum
  Clone ID: PAT_TA_2776.pep
MLISRAPVRISFFGGGTDYPEYFLQHGGAVLATAIDKFSYVTASPFLSHLFDYSIRVSYRKVELVKNPSEMEHVVFRECLKFCGLEKDIELHNVADLPAFTGLGSSSAFTVSLLQALHSFKGEFIRPLDLAYEAIYVERHLVKDKVGC

SEQ ID NO: 108359 - protein, 142 aa, Triticum aestivum
  Clone ID: PAT_TA_2777.pep
MKIIAVTGYKGGVGKTITSIHIARYLADKGKVLLIDSDPNRSVEKWAARGEKQPLFKVKNEKSAPAHIAGNDFLVLDTPARPDSNELKEISQEAHLTILPCVPDAISLDPMLQMFHDLFPGTVYRVLITIAPPYPSKSADEL

SEQ ID NO: 108360 - protein, 145 aa, Triticum aestivum
  Clone ID: PAT_TA_2778.pep
IFFITSHVVILLRLQQKKAIATVNDDRQVQTQNKISILNNFINLYSFPELVELSLFYQDPNLIIEFMFLQSWKSLEGTHLKDKYLLETLLGIGGFGAVFLSKTVGHDGAIAKVAVKLMVWDSKREKEQTQELELATTLKHDRLIN

SEQ ID NO: 108361 - protein, 174 aa, Triticum aestivum
  Clone ID: PAT_TA_2779.pep
NLAAYEITVSNLAVTDPENPNFSIPSGEQRSKGVEFDIAGEILPGWNIIASYAYTDARVTKDDNLEPGNLLEGVPFNSASLWSTYEIQAGDLQGLGFGLGLFYVGERQGDLNNSFQIPSYLRTDISVFYRRNNWRAAINVNNLFNIDYIEATQRRTRVDPAAPLTVRGTISVEF

SEQ ID NO: 108362 - protein, 130 aa, Triticum aestivum
  Clone ID: PAT_TA_2780.pep
EREVGFMVLAGAGAEIDTSTANGRLFFAVFAALAEYEAELISERTRAGLQAARARGRMGGRPRKMDRVMLQMLMEAMKNPEACAKAVAQKLNISTATLYSYVNGDGTPKEAGLRLLRKAHGEQQESEGPR

SEQ ID NO: 108363 - protein, 68 aa, Triticum aestivum
  Clone ID: PAT_TA_2781.pep
HDIDEALFLADRLVMMTNGPHANIGEIMTIPFSRPRDRDRIMEDPTYYQLRNYALDFLYNRFAHDDVA

SEQ ID NO: 108364 - protein, 128 aa, Triticum aestivum
  Clone ID: PAT_TA_2782.pep
IALRQDSLGEDQLRILSLFKRSQQRWITLFGGIISLGLLWLVYYYAPIAYPWVTDLPQIRLAGVGLAAIAYLMANLFLQVPLSVLGVLSTSQSKFTETIPLEPNQIEQQFTIPGIKLRQIPLVPRISS

SEQ ID NO: 108365 - protein, 146 aa, Triticum aestivum
  Clone ID: PAT_TA_2783.pep
VIVGASALLGAGLPNSFGLGMIALRVFLIVLGVTALSLGLAFALPGHIELIAVIFVTNLPLLFASTALAPLDFMAHWLQVVASLNPLTYAIEPIRYIYLNGNWGLDSTVLTAPWFSLNFAQVLGVLVLFDGLVLLLIQPLLKRRFL

SEQ ID NO: 108366 - protein, 248 aa, Triticum aestivum
  unsure (1)..(248): unsure at all Xaa locations
  Clone ID: PAT_TA_2784.pep
FWDRIKSLLNFXQNKPADKINQLLQDRYHGIIPPEELQDKITAGEREALAQQLSEGGEMNLDAIRTEGSGAELDAKLNQIVAIGGENLDGSGSGTLNFSSPYVFGGGLVGLLVLVWCLQSLNTWSNLREKLMGQEGVYYQILEKFGKAKPKVSESDLFLYNKALVELEKQAKKAISIDNDKFSSNEFLVFAKIRYSFNNDVGDYQGLKTYLQTLQSAIKAQASNLTLGQVESSCRGKKQQQFYDFCHQ

SEQ ID NO: 108367 - protein, 350 aa, Triticum aestivum
  Clone ID: PAT_TA_2785.pep
VRTTILERRPVTLVAKAMDIILDSYSRSMKMVGGAAGVRRTSEQNQQSSFQPVEDSRVVSQEPPDAWVGPVINTDSASGVESRQSQSNSGVEHGIANLAAHVDRSSLNTSSDSDGITNTSRAVSQATSSSQISDATGKRPQVVGEDSQPLASGTSMQHGTHVASVAISPIEMVQSVFVLVEDEMMGDPAYLIAVIMEFLRSLSKAGLKAPPDLYVMMTALLACSNRYAEIALFVSNKILEPSRELAMQLIDLGRHHSLTRKLGVDMLRERCLHHDYVAALLQDGYYLEALRYARKYKVITVQPSLFLEEAVAKNITPNLAAVLSFFAELTPSFKTTSDYSRYRHILSEMV

SEQ ID NO: 108368 - protein, 103 aa, Triticum aestivum
  unsure (1)..(103): unsure at all Xaa locations
  Clone ID: PAT_TA_2786.pep
PDRLLPHAHCRPTYSGPGRGGDTSLSWGKPATPHWRVLTSASTRLDQSAQKSTRTAYLLHLLLLLLSRILLFVFGFGPXEWSGPSEAGIDSTELEISWIEGGN

SEQ ID NO: 108369 - protein, 206 aa, Triticum aestivum
  Clone ID: PAT_TA_2787.pep
SGLDHGATRADRFCSSLISSDCSPVSMSSPSKTLMMRGKKAKVVEGNAQLLCSDALTEVFHRLPARTLASCRMVCKSWMSLLSDVHFVHEHLNRSQQKLLLFANDRANDRSLAMVLADANGYMYQLSRPLVAQTLFVHNSCNGLLCLGDSKGAVELLNPTTGESLVLPKPMYTAGSSQFSSCNWHCLGFCPSTKQHKIAHFYPGAH

SEQ ID NO: 108370 - protein, 96 aa, Triticum aestivum
  Clone ID: PAT_TA_2788.pep
SMMMKVSPRVSVHVCLCSTRHGKECPHYNNKRGDSATADSPEKMKPEQAAHNKMTTATSSPSPVVGLRGVVSSLVAFFIVVSTVSLLFDRGHESQV

SEQ ID NO: 108371 - protein, 127 aa, Triticum aestivum
  Clone ID: PAT_TA_2789.pep
CPRVRFTAKTKGSYGVDTGNLFFAEVAYTRGEVGLTVNSCCILEPSSDHGLCYGCCGDVKHPNDGNAYACGRRNISYCFQNGAPDLPLDYFVDRYYEDSDEEVERLRSQFKEVVKEELKPLPMPLVV

SEQ ID NO: 108372 - protein, 254 aa, Triticum aestivum
  Clone ID: PAT_TA_2790.pep
SVVAAEVANNRTGVRHDGNILTTGGDDGVVAVWRFVKDGIRRLLRMEKALCAHTAKITCIYVSQPYSLIVSGSDDCSVILWDLTGLVFVKQLPRFPASVSALHVNNLNGEILTGAGVLFAVWSVNGDCLAVVNTSQLPSDLILSVASTTHSDWQDTNWYVTGHQSGAVKVWKMVHCTSDEAANNKNKSPTTTYGGPGLDVQTLEYRLILQKVLKSHKHPVTALCIPPDLKQLLSGDAVGRVPSWSLKDDSFKGS

SEQ ID NO: 108373 - protein, 333 aa, Triticum aestivum
  Clone ID: PAT_TA_2791.pep
PLSPHDPRPAPHSVHPARSPPPRAPHTTPPPRPMAPAAASQTPGRPPWRRRAAVRWSDEVSGWLARDGTTAASTAPPRARRRALPLMQPVQPYPVPRRRPPAPPPAPGPAAQPPGVPPGGRPASPPRPPVSVKPPTRALPVPSPPWALYHHFYARLASAFPAVVVPASPCSARCGPPPCPTKALSAVPRPSSSATPPAYPSRAAPAAAPAPPCTPSWPRGSASGTPPAPAPPSASPRAVPRPPRAPGRPSPEQVGAAGHPRTRCSSRWDMLDKSLAMALPEGRHQWTTRTPARWARTRRRWTPSLPRWGRPPSRRRTSSATPTSSTAKHCAPP

SEQ ID NO: 108374 - protein, 383 aa, Triticum aestivum
  unsure (1)..(383): unsure at all Xaa locations
  Clone ID: PAT_TA_2792.pep
NIQKVTANVKEKMSAATEEVKESFGLXKEETSSFRDGSHGTSNHGKTEASSHSDDKSQDVTSAYMLFDKLRSTFSSASPVVSGAFAKLKDTRVSTLAKQGYEIVKDELSSSSSRKKKNHIRQAYSAAVEKSTRTDIVIVPTKKSVVGEKWEAIKNKMRGHPVYKRVNEYTKPVVTKVNEYTKPVVTKGQEVAEDVRERWETSDHPVVQKIQDINETIFEETATAASFREIRRRDPSFSLSDFIGDVQEMIKPVLTAYSKGDLKTLKKYCTKEILERCEGERKGYASQGMFFDHKILHISDADVRETKMLGSAPIILVMFRTQEIHCIRDKEGQVTEGGQDSIRTVYYQWAMQLMDSDELPEEESYYAVWRLREMHQLGVKALI

SEQ ID NO: 108375 - protein, 226 aa, Triticum aestivum
  unsure (1)..(226): unsure at all Xaa locations
  Clone ID: PAT_TA_2793.pep
CRRPAPRHPPLPPAVAQARRGLSPTHGPVGRLGRILRCRSSPGPQARPALVRHPAPPTLSVTSYTCFFGVIQFLIIAAFFERDAGRMXVFHSGFRTSSTNPLTPGFIASGVAFAVQIWCIDRGGPVFVAVYQPVQTLVVAIMASLTLGEKFYLGGIIGAALIITGLYLVLWGKSEERSRIGKEAAVMAAASAGSSGGGEREVRSAKLASSITQPLLPPSSTTSDNV

SEQ ID NO: 108376 - protein, 201 aa, Triticum aestivum
  Clone ID: PAT_TA_2794.pep
YSPRQDNTLVRPESLDQPHGKPHDTSAGAAPYELPAPDQPEMKEREREAEPPVSSRQDNTEASPESLDEPHCQLEDTCSGAATPQLPVPELGRMDIDSCEAEATIIPDINIPLELPAPYQPEMKPDECEAELPVSSRQDNTEASPKSLDEPHCQSEDTCTGAATPQPPVPELGRMDIDSCEADATVIPDINIPLESVEPDN

SEQ ID NO: 108377 - protein, 193 aa, Triticum aestivum
  Clone ID: PAT_TA_2795.pep
MKHNLSVVRSRIRQLRAGAPRLGRPPRIRAARGQKSVTSRNQEEPIRACMNYVGNHSLCSATEAKVSDRSEQPKAKISVTFVDKDGDETVINVPIGMSMLEAAHENDIELEGACEGSLACSTCHVIVTDVDYYNKLEDPEDEENDMLDLAFGLTETSRLGCQVIASPELDGIRLALPAATRNFAVDGHVPKPH

SEQ ID NO: 108378 - protein, 71 aa, Triticum aestivum
  Clone ID: PAT_TA_2796.pep
MAPRQVGIVKSFNDEKGFGLITPAGGGADLFVHFRNIQASGFKSLKEGQQVTFVAVQGQKGMQANEVITEE

SEQ ID NO: 108379 - protein, 173 aa, Triticum aestivum
  Clone ID: PAT_TA_2797.pep
EHHEVVLHCDLKPSNVLFDEDMTAHVADFGIARLLLGDETSVISATMPGTVGYMAPEVGSLRKASRKTDVFSYGIILLEVFTRRRPTDAIFVGNLTLRQWVFETFPADLVHAVDGDLLRGPSSSRHLEVFLVPIFELGLLCSCDSPDQRITMTDVVVKLKKIKVEYTKWSATQ

SEQ ID NO: 108380 - protein, 159 aa, Triticum aestivum
  Clone ID: PAT_TA_2798.pep
SSRIRVPTQRRQPQAGAQPHILAQVLPSEKDCEELDVQWPSGVVRAATPPVWRPRLGFNSPSFSAYLVIILGSDHVSSVPSSSTAAQGNRGRRRVRPTASLSGSTKGAPCLGLQQVCSARRLQPQASPGGGQINLIPPFFATQIDHTYSTSMSDLLFTN

SEQ ID NO: 108381 - protein, 205 aa, Triticum aestivum
  unsure (1)..(205): unsure at all Xaa locations
  Clone ID: PAT_TA_2799.pep
AAAAYSWPELRFDLPPRRRYHFADQFRSPCSSSSAGNFLKGARGSPDGSSFLTSSDDNSLRMSYLPEDAYSAAAEHTAEAAVGGQDSYGASLXVNEGEPVYDFCWYPYMSVSDPATCVFASTSRDHPIHLWDATTGELRCTYRAYDAMDEITAALSISLNSTGSKLLAGYNKASSVVAALRPGGDFVLYALRNGGDGPPRKIPLA

SEQ ID NO: 108382 - protein, 269 aa, Triticum aestivum
  Clone ID: PAT_TA_2800.pep
MVSGGCVGTEGGAEPEESAAVAAEEQVMPATAPARARELVVGYALTSKKAKSFLQPKLRGLARKKGIQFVAIDQKLPLSDQGPFDVILHKLTGKEWQRRLEEYRETHPEITVLDPPGAIEHLLNRQSMLQEVSKLDLADCHGKVGVPKQLFVNTDPLSIPAAVMRAGLSLPLVAKPLVAKSHELSLAYDAASLTKLEPPLVLQEFVNHGGVLFKAYIVGDAIRVGRSSPLPFGVGRVLPVYAGVFRFPRVSCAAATAEDADLDPHVAEL

SEQ ID NO: 108383 - protein, 441 aa, Triticum aestivum
  Clone ID: PAT_TA_2801.pep
MAACNGLFVYHILGLASLVAVFYFSLLGEVDLRFPGLLPSPGASQFSHDASVPVVERGGAQLFLGGRPFYINGWNSPSLVDQGEDAAILHHVPPRLHPHLRKGRPVFRIRAPSPGHLDAARDSAREPRVPDVVGAVPGRGRRQGARRPARGAPGDQPVAFRREDAERALRVGCKKSVYGLVHDSAKRGGAGAGAIVWQLAAEDMEEYLGRDDPTILAWELMNEPRCITDPSGNTLQRWIEEMAGYVKSIDGGHLLTVGTEGFYGPTSPPEKLSVNPGHWFNNYGLDFIRNSKISDIDFASVHLYPDTWLLHANLEEKLKFVTQWVSSHFEDGDTELGGKPVVLTEFGLSHLVKGFEQSQRDAFYKSVYDIVHASAKRGGAGAGAIVWQLAAEDMEEYHDGFAIVPSETPSMQKLLTEQSCRLAALRHGEEEAKRILKAVCG

SEQ ID NO: 108384 - protein, 189 aa, Triticum aestivum
  Clone ID: PAT_TA_2802.pep
MADPAPPAPARGDFTRSVKLKYVKLGYHYLITHGAYLAVAPLPGLVAAHLSTFTLHDLADLWQGVLHHSLGSLLACLAFLVAACTAYLVTRPRPVYLVDFACYKPDDARKCSRARFMDCTEKLGTFTDDNVEFQRRIVERSGLGEETYLPEAVLNLPPNPSMANARKEAELVMFGALDQLFAKTGVKPK

SEQ ID NO: 108385 - protein, 435 aa, Triticum aestivum
  unsure (1)..(435): unsure at all Xaa locations
  Clone ID: PAT_TA_2803.pep
MEGEAELEAEAKGKRGGGKVRIIEAPPRISMEAVNGAMGSDELPERISTSEDTELEIEQAKEMGEEAEERDEVAKLEIEEAEGMEEKMQTGMFFNIYCRALESNLSRLVSSPCKDATSLSPMHFTHSTTNRTSYAEFATSTLQIYSIKVTEIKGTPELKWPLRVYGMVAARXTVDHNRNILFLRQRNDCQILTPENPFLQLTGPSRAIAAIDPVDFDIKLKVKGRMKSKDRVLMHQTSKYSCNEAILLDDSCRIVLRCAKLEKTVQATIVGVRVINWRKKKWPFRHGGLVIAKAHSKPVKPENEALLQDQVMDDISDGYFEGEVSCVGDRSSALKHEDEVVLQDQVTANNWDGCLDLSRHVVSVELDGKLEVIIRALSSNGFITKHGHVFFPAQESKISRGICDLASYKVEVTVAWSLLVRDKQFISREGCMDDD

SEQ ID NO: 108386 - protein, 171 aa, Triticum aestivum
  Clone ID: PAT_TA_2804.pep
MLRTVLRRGEAAMRQAALAEGSTGNLLRLSVAERERSRRRRRDPGRDEFFVPTPESLKWLDSVTLPMILTAAAVALFTKLLMMEHEDTDQERRERKIKNSHPEQGTVRMLSREEWDEIQEVRPRTPFESKLARPHARLRTGERVRLEDAKDWAVDVLTDAFTRAEESAKRK

SEQ ID NO: 108387 - protein, 76 aa, Triticum aestivum
  Clone ID: PAT_TA_2805.pep
MGSDGKLGSGSAAVCCMCGDHGLLPELFRCDACSVRSQHTYCTDWYPKAEAYGTCNWCLRAGQRKRRRRRAPFLAR

SEQ ID NO: 108388 - protein, 389 aa, Triticum aestivum
  Clone ID: PAT_TA_2806.pep
APGRSNRPSSTASGRPVHRPRRGPLHLPTALRRRPPRHRGLRRRGPPPHPPPRPAAPAHHHPPPPAPTAPPRPPPLLSPAPPTRAVGGSCRAVLRSWRVCCVTGAAGGGAAAPLAASALLSPLWPPKSTVKTASGAKSGVLSDAASAVLTRLGARKPAVEPAAGAVSLGDDLRGFAAVTVFVGRIPRPLPCSGEVPLGGGPLGSVSWNGFVPRAARPRSRSRSPKLVAGSPEGIPGHVDGRLREAKMNHPKGFTVDGRGNIYVADAMNMAVRKISDTGVTTIAGGFSSRGGHVDGPSDDAKFSTDFEVRYIASSCSLLVIDRGNQAIREIQLNFDDCVYQYEAGFPLGVALLLAAAFFGYMLALLQRRVLGMVSTEDELQTPMKASIAS

SEQ ID NO: 108389 - protein, 219 aa, Triticum aestivum
  Clone ID: PAT_TA_2807.pep
MEKGASESSPLDCARCGKPASLQCPKCAQLKLPREAAAFCSQDCFKAAWASHKSVHTKVYSLTSQLSQEGWKYCLKKGRTRTMELPRFDWTGPLRPFPISKMRLVPDGIEKPDWALDGIPKIEPDSDLQKRVEIKTPEQIERMRETCRIAREVLDAGARIIKPGITTDEIDRVIHEETIARGGYPSPLNYHFFPKSCCTSLMNHLPWESRCQKTEDGDM

SEQ ID NO: 108390 - protein, 178 aa, Triticum aestivum
  Clone ID: PAT_TA_2808.pep
EAEVLRLDSSIIGLSKVFGQVALLAWSMAYNKCFKTTSARKILSALQFITAVVMLSDVLFVQGVYRKVGISDSLYTIVFSGLLEGLMFFKVLPFSVLIASLCPSGCEGSVMAFVMSALALSIIISGYLGVALAEFMGVSGDDFSALPVCLLIEAACTVLPLFCSSWIKERKGKEKKEE

SEQ ID NO: 108391 - protein, 261 aa, Triticum aestivum
  Clone ID: PAT_TA_2809.pep
MADSMADSMVASFWGPVTSTTELCEENYARSSYIAEFYNTLSNAPCILLALIGLVNALRQRFEKRFSVLHISNMILSIGSIIFHATLQHVLQQSDETPMVWEILLYLYVLYSPDWHYRSTMPTFLVLYGAAFAVVHFFVRFQVVFKLHYIGLCLLCIPRMYKYYIQTKDLAAKRLAKLWVLTIFLATVCWLVDRIFCKKLSLWVINPQGHAWWHVLMGFNSYFANTFLMFCRAQQRGWEPRIIHLFGFLPYVKIQKSRKRE

SEQ ID NO: 108392 - protein, 277 aa, Triticum aestivum
  Clone ID: PAT_TA_2810.pep
IYNGGEARSAAVNPPLPPAIIGRKRKGDQTTGLLFFPLIISQMKKQKMANGPSHDKNKVFASLTRKDVSDIDPSYKIFLENLIEDGSAYVFHMPNGDHGLPASVRYEEDDMSYGGVNVRDGTNVPQKLPHTSRGGARVKRLDQTSGSAVNVNAGHSFLPRTSSVKKNTSDVDESYAEFLSLMKIKDGFMVLELEPGVTVVYEQEEETPPGYDELRTVVMSERGIDRPAPDNLHGRDSICTDEHGVVPCTESSDFEACEDCEEEPLALNCGAPSTFDE

SEQ ID NO: 108393 - protein, 202 aa, Triticum aestivum
  Clone ID: PAT_TA_2811.pep
MAAMSDTTRNRTFPHGNDNDDATAPPSPSPPETVYYEGCPGCAMERKKENNTGTPYKEFFYVGVTTLASALPISSLFPFLYFMIQDMHVAKNEQDIGVYAGLLGASYMIGRCFASLFWGVVADRIGRKPIIAFSMFSVVIFNTLFGLSVKYWMAIATRMLLGSMNGMLAPIKAYSVEVCRPEHHALGLSVVSTGWGIGLVVG

SEQ ID NO: 108394 - protein, 174 aa, Triticum aestivum
  unsure (1)..(174): unsure at all Xaa locations
  Clone ID: PAT_TA_2812.pep
TCHRAEDIVRETVRGANAGIXAGLVRLFFXHDCFIRGCDASVLLDLADPSSATEKFGPPNLSLRGFEVIDAAKARIEKECGNVVSCADVLAFAGRDATYFLSNKKVYFEMPAGRYDGRVSLINETLIHLPPPFATVEQLKANFASKGLSADEMVTLSGAHTIGVSHCSSFDDDF

SEQ ID NO: 108395 - protein, 102 aa, Triticum aestivum
  Clone ID: PAT_TA_2813.pep
SHHGPVPRPRRAIQLDLRNATVAARNQRDGRAASKSPTLSPMRLPSPHRLLPPNSPTGHDEDGPAAGQARVPGRRPQLRLVPGLARTPSQGSVLEPPARRLG

SEQ ID NO: 108396 - protein, 78 aa, Triticum aestivum
  Clone ID: PAT_TA_2814.pep
QPHTSCKVRNSQPFIMPMHMRQAVQSSSSPMVSWEVTQGFLFQDPPYKASHLVGHYLANPPFKVKEKFLHEEGISNRQ

SEQ ID NO: 108397 - protein, 403 aa, Triticum aestivum
  unsure (1)..(403): unsure at all Xaa locations
  Clone ID: PAT_TA_2815.pep
PRVRPRVRKVLRKADMIRKNAVESILAERDILITVRNPFVVRFFYSFTSRENLYLVMEYLNGGDLYSLLRNLGCLDEDVARVYLAEVVLALEYLHSMQIVHRDLKPDNLLIAHDGHVKLTDFGLSKVGLINSTDDLSGPAVSGASLYGDDEPQMNELEEMDHRARRQKRSAVGTPDYLAPEILLGTGHGTSADWWSVGVILFELLVGIPPFNAEHPQTIFDNILNRKIPWPHVPEEMSFEAKDLIDKFLTEDPHQRLGSDGASEVKQHPFFKDVSWDTIARQKAAFVPSSDSACDTSYFTSRYSWNPSDENIYEAYEFEDSSENGSLSGSSSCVSNHQDDMGDEHGGGPTDFXXRPNVNTLSTLPLXNPSTLAPTNYDLLTKDXRTPPNGTETYLYVDYNKTF

SEQ ID NO: 108398 - protein, 459 aa, Triticum aestivum
  unsure (1)..(459): unsure at all Xaa locations
  Clone ID: PAT_TA_2816.pep
MLAPAAMEVTIXAHVSTTLASVNAVHNPRXARKLRSAVWQGLHPRERRADRQLRCYPVTICKKQLTATSRSGTTHLRNHLAICTTTSTRRAGKRRKLIVRRILHNKTSTGQPGDGHASGEDNDNDSTHFDQELSRHDLARMIVQHGYRFSIVDDLGFRKFVKNLQPQFSMVSYDIVRADSMAIYESEKLKLQDVLLKTPCRVSMSVDMWRSSTQMDYLCLTCHYIDHSGDEWKLRKKXILNFVHVEEHFTANQIANLILEKLQQWGIERKLAAVVLDNCTAGDIVAAELLRVMQPRRLLLLNGNLFHVRSCAHILNLTVEESLEQTSDIIXRVREMIQNVKFSQXERFKKFLDTAKLXLQIDQKLLVLDFXNNWAXTYLMVESACYYYEVLVRLCTTQKXYPSFLTGYEGADVKALLEXLDALIIRWRVSVEIPTANXYFNDMCGSRSFYTRALYLSCC

SEQ ID NO: 108399 - protein, 213 aa, Triticum aestivum
  Clone ID: PAT_TA_2817.pep
LQSVLFPSRSRSIMPCDGDAEESKGRLKAVNIASPRRRHGARRGVGGSHGHGQASAPSSSRTAPRHTPSLTATSGPFVYLVVANAIAAVMVGVAIFLSVWKKGSGKCSKVLVPLLDVAAPALLYSATGAAFATTEYMSYCSPRGRGRVSVCDGTVRGTNNFCSQVHMAMYISLAAAGAVSAAELVKNLKLSFCSSGSDCDSDAGCEHGCHHKH

SEQ ID NO: 108400 - protein, 212 aa, Triticum aestivum
  unsure (1)..(212): unsure at all Xaa locations
  Clone ID: PAT_TA_2818.pep
KKLKGGIPPPXGLGQXENFPGXPQGPLXPPPSXGIFXXQNPPPRQXKKXGPAPSPPSNRAPASPPAPPSNPLPPRRKIXYSSSSTSCSAPPTPNLASRRLRVDSSVLLPGSGALVGFSDRRRVRFPCSDPRNQLGVRFLDLDLPPAMAALVELFTRSYSSSTPVDWEAEAYPAYGRYAGPPARWPFPILVGSFSRPLAFFLREPGVSGFRKK

SEQ ID NO: 108401 - protein, 118 aa, Triticum aestivum
  unsure (1)..(118): unsure at all Xaa locations
  Clone ID: PAT_TA_2819.pep
MATIATMTMLKPAGLAAVPEPASAAVQELAALAAVAPADDNRGLLLLFVVAPALGWVLYNILQPALNQLNKMRSXERAYVVVVASHAVRPSGFVCVCSSIKSRGSSVERGVSARLHSL

SEQ ID NO: 108402 - protein, 218 aa, Triticum aestivum
  unsure (1)..(218): unsure at all Xaa locations
  Clone ID: PAT_TA_2820.pep
TTTTTTNTFTLSFAAAGNPPPSNPDNLTAAALEEAAGSTQSHVVVGRHGIRIRPWPHPDPVEVMRAHRIMERVQEEQRRWYGVREARPVLVVTPTYSRAFQALHLTGLLHSLRNVPYPLTWIVVEAGGVTNATASMLARSSLTFVHVPFPEKMPLEWADRHATENRMRPXLHALRVIRERKMDGVVVFADDSNVHSMELFDEVQKVQWMAAVSVGILA

SEQ ID NO: 108403 - protein, 156 aa, Triticum aestivum
  unsure (1)..(156): unsure at all Xaa locations
  Clone ID: PAT_TA_2821.pep
MATIATMTMLKPAKITARSAPSSPSSSAKVASPSISLRSLQKNAAKKGALAGLAAVPEPASAAVQELAALAAVAPADDNRGLLLLFVVAPALGWVLYNILQPALNQLNKMRSXERAYVVVVASHAVRPSGFVCVCSSIKSRGSSVERGVSARLHTL

SEQ ID NO: 108404 - protein, 218 aa, Triticum aestivum
  Clone ID: PAT_TA_2822.pep
HAHPPHYPLHLFASARASSSLRGERGQRPSCEVREGGEQPRGTRRQRPDHSHDGHAQARQAHGRRRRLRRHRRSQRQRWRPRGISLRSLQHKPARKGALERVAGGPGYADGPPSRRWPRRPRRWRRQRLAEPGRRRRPRDDSRGPAAGSSWWAPALGLGDLQHPPAGAEPSSTRCGPDEGARQPGLGIGARRTPRAVAAVPERGLPPTVTGARRHWRR

SEQ ID NO: 108405 - protein, 143 aa, Triticum aestivum
  unsure (1)..(143): unsure at all Xaa locations
  Clone ID: PAT_TA_2823.pep
MEEDYVFKVVVIGDSGVGKTQLLGRFTRGDFCLDSKSTIGIEFQTRTVDIAGRRVKAQIWDTAGQERYRAVTSAYYRGALGAMLVYDVTRRXSFSHAARWVAELRAHADXVIVVALVGNKAXLTPPRRGAAKLGPKRRGLREQ

SEQ ID NO: 108406 - protein, 381 aa, Triticum aestivum
  Clone ID: PAT_TA_2824.pep
MAAAAAICGEDEPAPRDPESAAAAGGGVERLDLGDGRAALVAGGKRSVYLMDCEPVWGCVATPGRGGEMEDACAAVPRFADVPVRLLARRRDLEVLGLDADALRLPSHLFAVFDGHGGSEVSNYCRERLHVVLSKELRKPPSDLGEMSDVDMKEHWDDLFTRCFQTVDDEVSGLASRLVDGEPRSDPIAAENVGSTAVAVVVCSSHVVVANCGDSRIVLSRGKEPVALSIDQKPDRKDERARIEAAGGKVIQWNGHRVSGILAMSRSIGDRYLKPYIISKPEVTVVPRAKDDDCLILASDGLWDVVSNEEACKVARRQIQQWHKNNSVTTSSSDGGDGSTDPAAQAAADYLTRLALKKGSQDNITVIVVDLKPRRKPKNNS

SEQ ID NO: 108407 - protein, 169 aa, Triticum aestivum
  unsure (1)..(169): unsure at all Xaa locations
  Clone ID: PAT_TA_2825.pep
MALTSQSLFFTPSPAGPSRRGRGRPVTMSAAASHNSQPRNNPFAVSSSAPKSESNTSKTDLALGSAIAAAASGAFLLASSGGFGGGPGGPLGGGGGWGGGGGGAGGGGGGGGFWSRIFSXGAANADEKPPPVGPPPPRPANCPLPLSGLSGLKRYKLSELKFFDRAAPG

SEQ ID NO: 108408 - protein, 158 aa, Triticum aestivum
  unsure (1)..(158): unsure at all Xaa locations
  Clone ID: PAT_TA_2826.pep
HAARPRSRLPSRSPPPKPRFLLASRLAPPPPPGPPPXAPRPILPPPGSSHPPSRGNEHLEPXPSAPAAPTRWPSRPAPPPRTACRRRCASTSAPAPPTAPQRGARGRGRGPAPGAAAAPRPPAVPPARARRPARAAPQGRRAIRRRSTSRARCWTGTA

SEQ ID NO: 108409 - protein, 259 aa, Triticum aestivum
  Clone ID: PAT_TA_2827.pep
MAEEKESTSVPLSQAAEAVDPEDPAKSPPRPSSPTTSTRKACCAVLQSWVSRKFMTGCVVLFPVAFTFFITWWFVQFVDGFFSPLYAKLGVNIFGLGFLTSLAFIFLAGIFVSSWLGSTVFWVGEWFIKKMPFVKHIYSASKQVSTAISPDQNTTAFKEVAIIRHPRVGEYAFGFITSTVVLQTDKGDEELCSVYVPTNHLYIGDIFLLNSEEIIRPNLSIREGIEIIVSGGMTMPQVIASLDPIPRKSQSIRLNRIMT

SEQ ID NO: 108410 - protein, 57 aa, Triticum aestivum
  unsure (1)..(57): unsure at all Xaa locations
  Clone ID: PAT_TA_2828.pep
ALQVRLITDKVTNKPRGYAFVEYAHTRDMKSAYKQADGRKVDNKRVLGDVKRXKTVP

SEQ ID NO: 108411 - protein, 499 aa, Triticum aestivum
  unsure (1)..(499): unsure at all Xaa locations
  Clone ID: PAT_TA_2829.pep
SRTSPPSSRPPPPPPPRGHYGNAMMRNQDAGVQSRVNGXQSRANLLQLKLIGQSHPTGLTTNLLKLFEPRPPLEHKPPLEKSKLPAYSGMSQFVSRFAEPGDPEYAPPVPTCEXTRAEKKDGIRQLKLEEVAAKVAEELQKYDPQNDPNVTGDPYKTLFVARLGYETSEQKVKRDFEAYGHIYRVRLITDKVTNKPRGYAFVEYAHTRDMKSAYKQADGRKVDNKRVLVDVERGRTVPNWRPRRLGGGLGSSRIGGEDAAQKHSAREQQNAAGRPRSEEPRRDDRPADRDREKSRDRVRERDRDEKTRERSHDRTRDRDPTEDRHHHRDRERTRDRDRERDQERDRGRDRRDRDRHKDHGRDRDQDRDRKRERSHGRGRDRDRDYERASHEQDPGRDRDYKRARHEHDRGHLQESDADYGNGELGYNQHEHHRSHEQYGYGLDGHERSKRHEHYRDDPHSKMATNHQGQPENAEPAVPEEGEAYEEGDYQHIQASEYRN

SEQ ID NO: 108412 - protein, 399 aa, Triticum aestivum
  Clone ID: PAT_TA_2830.pep
GTRAFALMPLQASPSPVLENLDYALEDSVTANFSNPGSAFGGLLSLEQRNKSFDITNSMTVHCGFVRGKKPGQGTGFDISDDDLLEMEQCRELVVASAIFGNYDMIQHPRNVSELSKAYACFYMFVDEETMAYVKNSSSLYKDNKVGLWRLVVVRNLPYEDPRRTGKIPKLLLHRLFPNVRFSVWIDAKLQLVVDPYLLLERFLWRKNSSFAISRHYRRFDVYEEAEANKAAGKYDNASIDEQIDFYRNEGLTHYSPAKLPITSDVPEGCVIIREHVPISNLFTCLWFNEVDRFTARDQISFSTVRDKIRAKVGWMPQMFLDCERRNFVVQAYHRELLEQMIASGRNTPPIAVEPSRKIRPGSSRRAPPSKKPVETEKGEEIELAEAGREAGYWAMDAW

SEQ ID NO: 108413 - protein, 466 aa, Triticum aestivum
  Clone ID: PAT_TA_2831.pep
MRGLPSAASLCAALPPLRRPKFKASNCPGSGSPLPRPASCKLGNFPLAEISSTDLPSLSFPAWLVLSGNASAMSELTTIPASIGALSKLVRMDLHQNKITSIPSSIKGCSSLAEFYMGNNILSTIPDDIGMLSKLGTLDLHSNQLKEYPVGACKLKLSFLDLSNNALSGLPAELGTMTTLRKLLLSGNPMRALRSSLVSGPTSTLMKYLRSRLSSEEEASGSRTTPTKDDQISAARRLSVSSKELNLSGLGVPNVPPAAWETSDVVKLDLSKNLIEDLPNELSLCSSLQALIPSNNKIKKWPGMVVSSLPSLTSLKLDNNPLAEISPTDLEPLGKLEILDLSGNASSLSEPSVVSSLPQLQELYLRRMKLQEFPIGLVQLKHLRILNLSQNNLSTIPEGIKDFSALIELDLSDNNITRLPAELGLLEPSLQVLKLDGNPLRSIRRTVLERGTKAVLSYLKEKLPSN

SEQ ID NO: 108414 - protein, 239 aa, Triticum aestivum
  unsure (1)..(239): unsure at all Xaa locations
  Clone ID: PAT_TA_2832.pep
RRTSFCLGGTEFVSAGTIRRSTGGPAFLLYGGGDSSVRVWDYINGCLLDTYEVKDKVGEQPNETEDSNLAIADLCLTNDDSLVAVAIQSLNGIMLLACDLVAKKLSFLKVITTEKSYIPTSLAYSSSADLLWTVMGASNMPNQAASQLLTRVRIIPRSQKDLSAXDHDPAVLEDSEVPHGEKLLLALQGSLDAXKQEEVLAAVLAALRVSMHKMLVKKNYSEERREQRKRGRNDKKIKK

SEQ ID NO: 108415 - protein, 235 aa, Triticum aestivum
  Clone ID: PAT_TA_2833.pep
MEVLFDCILDKTGMKGTGKWTVQQAAELAVAAPTIAASLDGRYLSGLKDERVAAASVLEEEGMPVGLLEKINVDKKVLVDRVRQALYSSKVCSYAQGMNLLRAKSVEQGWNLNLAELSRIWKGGCIIRARFLDRIKKAYDRNPELANLIVDREFAREMVQRQGAWRWVVARAVEAGISTPGMSASLSYFDTYRCNRLPANLIQAQRDLFGAHTYERIDRPGSFHTEWTKLAREGK

SEQ ID NO: 108416 - protein, 465 aa, Triticum aestivum
  Clone ID: PAT_TA_2834.pep
YCPWAKKMEESPSLFQDGSTSQTPPIETPTVDAAATGRQVATPPRPAQVKVMEEKAVSSLPKPSTEQRRSRRVLVRPSLERIEEPQADAATPVVDGSAVQEKGGTSTERGSTVVQEKGGPSLERETSGSVSVLPSGRKRLMPSSQMRDDASHGEANDANPPSKKPKEDSVQSSSELKTDQSAPEDVTTEAPVVISIDNQDVQQQPGEEMTRIRLPCQLKRLRTSRMTKRVTMMTWKNIQVHQWTSKPRMLEVNMDSDAAAVEDVPLKSEAVVESFDEDQKHEDAKEEGQITTATDAEDEREEGELPDEPEQQSDSSPLDIGEQASDAFRAASPSGAAAKSDADMSEEIVEGDGTAELAEVEPDQSPLAQSGGADASPSRTTDASPVREPSPSNPAIAGASSEQQNPGTAAENVGRTINLTERAIQNRTNRQNRLVRTSTPQPSSSRGRSREAGRGRGRSRRGGQP

SEQ ID NO: 108417 - protein, 276 aa, Triticum aestivum
  Clone ID: PAT_TA_2835.pep
LDDSKLKPLQKSSTPYYDTYTEFISANQQTFALVRGAARQTKPNQTEPGEFNTHTHISLNRKAERRPGQDTRRHCCLNILLVCCPLAESSTVSPCAPKQMLMSLPFPQPWFLRAATPTPSSAKDEFEHDGSSAPSSLSRMMSLSLPNGGVTIVLSSSSKQMSLSLVDVGAEDMEDLGSMLGGDRVFGDEAARCGIASMMPWMSFFLLAELGAELLTASVRLLLSAVVLVKACLSGVGVSATCLFSFLMVSSGPPSSDFLGVLDIFSLGRGAGSLSP

SEQ ID NO: 108418 - protein, 424 aa, Triticum aestivum
  Clone ID: PAT_TA_2836.pep
MIQDAVQEGLKSDALKLVVQAAVDEGLKSDALKHTIELAVQKALKFDVEGPTKAQAMGVYSASSSADPLPKSDAAYSTSGYWPADPLPKSTSAYCLSGSRVSRSADLLIKSSAAYCPCLSRVSRSLVLIPKTSAGYFSSVSRTCFLPLSGPRFFSTQKGCADIDKFDKFEKLYQKARVHVSTGLHRIVGLLYELKEDVDQTDFIQKWLTNIGKETLLLSDSQIEGIGKGWTCLNYGGGFFAWGTLVYFGVMTIRENNIPYTDYFHLLNAVRVQALNRGIAQYKAEKQELEDAVNAKAVMAALAKKAAEDAAAEKKAKDVEAAASRKAKAEQTGAKWRSKSEQAAALRKAKAREVRDANLTKWKQSNAERKEADTARKAKAAQAAAEIKAKLKEAAEKRMAKAKSWLLPWRLRGRPRRCKSGPKK

SEQ ID NO: 108419 - protein, 221 aa, Triticum aestivum
  unsure (1)..(221): unsure at all Xaa locations
  Clone ID: PAT_TA_2837.pep
GPXKSLXIRENGILHGXDXSIPXVPSXTRXXSPNHWQLRLVRRDQSXARRDGHQKASAHPLNGGGPLVLLIARMMRAERVTSTHGATEDTATARCPSMCAAGAAPGAPSRVTTRIAVHARRDGAATTTSCPSMHGPGGPWQGAPACAAYAGRRSTSTRGATETTATERCPSKCVRGGSWCSCSRVRRGRSNSTCGATRGSCCRVRRPCSRINGRLALVPNS

SEQ ID NO: 108420 - protein, 104 aa, Triticum aestivum
  Clone ID: PAT_TA_2838.pep
YGGFALRPRPTSDDCLEHDRTVALGVFEADLHAEPVGWRTVSDLDGHALFLGQHSSKSLRAGECTGYQEDCIYFMCDYPWPEVFCKSSSRRPVFTTSGMRRSCR

SEQ ID NO: 108421 - protein, 222 aa, Triticum aestivum
  unsure (1)..(222): unsure at all Xaa locations
  Clone ID: PAT_TA_2839.pep
DXPCSXXTLLKGTKAGAHRGGGRSRTXWIPQHISRNTKTMKTILLLILAFPFLGAAGERCPGVPSLPVEAACRKACGTKLMHDMCMDTLRGGFDPSPSVHIEVTEYALLAAHRALESYGATAAAAAELLRSGSLSGDERAAYNTCLTEYSYAVQCMEHVAGDMVARCRFAGLGEEYVRCVTYVEGCRDRLVRLKSSPLYAMNLVDRNKALLAYSLGQLLRSI

SEQ ID NO: 108422 - protein, 41 aa, Triticum aestivum
  Clone ID: PAT_TA_2840.pep
KGTPKRAPLFFFFFFFFFFGFFFFFFFFFFFFFFFFFFFFF

SEQ ID NO: 108423 - protein, 220 aa, Triticum aestivum
  Clone ID: PAT_TA_2841.pep
MTGYSDSGKDAGRLSAAWYLYKAQEEIVDVAEQHGVKLTIFHGRGGTVGRGGGPSHLAILAQLRNTDDGWPLVPVTVDLLEMVFAKGDPGIAALYDKLLVPQDLWPFGEQLRANYAETQSLLLKVAGHEDLLESDPYLRQRLLLRDSYITALNVCQAYTLKRIRDGEFRPATRPPLSKEFIDETAESLMELNPSSEYDPGLEDTLILTMKGIAAGMQNTG

SEQ ID NO: 108424 - protein, 201 aa, Triticum aestivum
  unsure (1)..(201): unsure at all Xaa locations
  Clone ID: PAT_TA_2842.pep
PSQGTPPPPXRLLRSPRIPPERSEAPWTRARSCGCWSATSPSECRSRRPPPARAPASTPPPPPATSRSASARWPARPPPPRSCSPTPPPPPPSSPPPAPWPRPSTSSRPTWSGSPASPSPFSPSPRGAGCSRVSVSAARGLGITCGVNSWAGVLRERAPSRLDKGRRNPAVLRAGFSRERLWKRGGGPGGRNPNRGGEPVV

SEQ ID NO: 108425 - protein, 266 aa, Triticum aestivum
  Clone ID: PAT_TA_2843.pep
HPAPPRRPPGAPAAPAPPRPRPAGAPPGRRRRRRPRRGAARPAGPAPAPRGAGPPGRPAAAAPRRGQPRGVGVPLPHRAAPPHGHGGHLRRGHRPRRTAAPGRRRTPPPGHRSANRLYELPHGAVVDVVLQNADMRRDNDSETHPWHLHGHDFRVLGYGEGRYGGGGLYERLNTEDPPLRNTVVLFPHGWTAIRFVADNVGAWAFHCHIEPHLHMGMGAVFVEGAHMIRELDVPRETMMCGVIRTTAAALTPAKPGSSAPAPSAHR

SEQ ID NO: 108426 - protein, 215 aa, Triticum aestivum
  Clone ID: PAT_TA_2844.pep
MGSFPIPSPPAARPGSGRALAAVAPCNSSASPSPSTSTSSVAPASGGRRGVLALGAGFLASAALLCPAGDAGATRIEYFATVGDKLCDMDFAKSGLGYCDVEVGTGVQPKRGELINIHYTARFPDGTVFDSSYKRGRPLTMRIGAGKILRGLQQGIAGGGGVTPMLVGGRRKLMIPPILAYGPEPAGCFSGDCNIPGNSTILYDILLRRHLQVSV

SEQ ID NO: 108427 - protein, 168 aa, Triticum aestivum
  Clone ID: PAT_TA_2845.pep
TPRHGEGAQLMHVCWFEIRGKIHSNMLSQDTTYAAYMVFKTTDNFYGLDSPVQEASISAGATNSTRKVCLQGNDDDDAEGGVPDNYPRMVPFPRLRLRRRNRRVVSHEENVALPQQRADGWMELELGEFLNEGGDDGEVSISLVETKGGNWKSGLIVQGIEIRRKKSG

SEQ ID NO: 108428 - protein, 280 aa, Triticum aestivum
  Clone ID: PAT_TA_2846.pep
LGELVTLPMRRPELFSRGNLLRPCKGILLFGPPGTGKTLLAKALATEAGANFISITGSSLTSKWFGDAEKLTKALFSFASRLAPVIIFVDEVDSLLGARGGAMEHEATRRMRNEFMAAWDGLRSKDSQRILILGATNRPFDLDDAVIRRLPRRIYVDLPDAQNRMKILKILLAKENIESEFGFDELADATEGYSGSDLKNLCVAAAYRPVHELLEEEKKGAVGSTKTSLRSLKLDDFVQAKAKVSPSVAFDATSMNELRKWNEQYGEGGSRSKSPFGFGS

SEQ ID NO: 108429 - protein, 238 aa, Triticum aestivum
  Clone ID: PAT_TA_2847.pep
MQQHQGVPKFGNWEDEGQGYTQYFENARMGKSPGRPVNQNDRNEGAAQAPSNDPPSVKASPLRPGSEPGLRKNRDERRATREDDLRRHEAAARKTHAESPNHRYGDQTNYDGAARKASNERSPIHPRQQARLADKGGVSSPVADRRGSAPTTPGRSKMRPTGRGDETPERGSAVPKFGDWDEKDPSTGEGFTDIFEKVREEKQSGADTVGTSHAYKDRYNQGDRYESSGCSCFSWFKK

SEQ ID NO: 108430 - protein, 396 aa, Triticum aestivum
  Clone ID: PAT_TA_2848.pep
NQERIIEKIKDAIEEKLMNCNNTRIFQTQALNSSALRPANTRKDKGTEVSTPTGEKSQKIPVSQMVRTDPRDPSGRLHTYWQGQTSNLEKKSGLVAVRNIVRSRRNPKDAGDLSSRHELVTEIDYNLHPGLFDIVKNCTYVGVADEVFALIQHNTLLYLVNVVNVSKELMYQQALCRFGNFNAIQLSEPAPLLELLTMALKDDESMSDVNEKEKLEIAEVNTEILKENAEMINEYFSIHIDQGGNLTRLPVVLDQYTPDMDRLPEFMLTLGNDIAWDVEKECFRTAAAAIGNFYALHPPILPNPSGKGIRLYKKNKDSMESAGQADNDLTSTDEDDIDQELLAEAEAAWAQREWTIQHVLFPSMRLFLKPPKSMATDGTFVQIASLDKLYKIFERC

SEQ ID NO: 108431 - protein, 85 aa, Triticum aestivum
  Clone ID: PAT_TA_2849.pep
AQNSIGPALTRTMLVLHAKLRCMYCFRRNGVPVIRSCAKACVTSIQRLRYAGFLLNCRSFIQYILLLGNYVLSILLKITFRICVI

SEQ ID NO: 108432 - protein, 148 aa, Triticum aestivum
  unsure (1)..(148): unsure at all Xaa locations
  Clone ID: PAT_TA_2850.pep
MLLLLALALSYPNKGRGGDADAGGRRRIARSHKDKGETAEKVVPAXERGEGRPQKHFADKIEQVDVENFVEDVDGGDEDGKDVKLNASAGVKRGRPLKESPNIVLEENSNSSVRSSSDESARTNGFRQIGNRRKSTPRRAAEAGLECK

SEQ ID NO: 108433 - protein, 240 aa, Triticum aestivum
  Clone ID: PAT_TA_2851.pep
FQAALHKVVNEMLTVDEFEAAWAELLDKYKLHNNTFLIQIFEVRHKWAKPYFSGKFCAKQTSTQRSESANHLLKGYIPPACPMNLFVKQYSKLQFDREAEEGFQEKRMRLGGIVLRYNYPLEEHASKVYTRTMYEMFGQALYRSGRYDVEEVERGITYHVRHVEAEKREKWCREMHVVSVHDGGARFSCECGLFEHMGMLCCHAIKVLIHLGVRKIPRFHVMKRWTVDARDNSPLHLLHY

SEQ ID NO: 108434 - protein, 65 aa, Triticum aestivum
  Clone ID: PAT_TA_2852.pep
TVRASPGLGSRSWKLTVLHFYDQYWLLCFLNEKKYYTSALEKEAAVCGELASLSKKNNNFLPLIF

SEQ ID NO: 108435 - protein, 130 aa, Triticum aestivum
  Clone ID: PAT_TA_2853.pep
MARGTAATAAAAAKGKKKGSVSFVIDCTKPVEDKIMEIASLEKFLQERIKVAGGKAGNLGDSVTVTRDKSKVTVTSDGAFSKRYLKYLTKKYLKKHNVRDWLRVIAANKERNVYELRYFNIAENEGEEED

SEQ ID NO: 108436 - protein, 131 aa, Triticum aestivum
  Clone ID: PAT_TA_2854.pep
MARGVPAATKGGAGAGKKKGSVTFVIDCTKPVDDKIMEIASLEKFLQERIKVAGGKAGNLGDSVTVARDKSKVTVTSDGAFSKRYLKYLTKKYLKKHNVRDWLRVISSNKDRSVYELRYFNIAENEGEEED

SEQ ID NO: 108437 - protein, 169 aa, Triticum aestivum
  unsure (1)..(169): unsure at all Xaa locations
  Clone ID: PAT_TA_2855.pep
NLRAHFSSLAAQSGTQGRAISRPVFLDYFGVRGALGDRLFQLVAKESSVEDGVTFEGLIVSKATYERGTKDEADEFIFQLCDVMGDSILTRSDLAAVLASIHETIFADNKEAREGSNKSTFEAFLNSAVFSKDAXGVSEKSMSLSDSRNWCIVMPSLKKXLGSLLMPPD

SEQ ID NO: 108438 - protein, 224 aa, Triticum aestivum
  Clone ID: PAT_TA_2856.pep
SRLQVPLLHYPENMSSELLLLNKEYAWHIGGGFSQHDVQEWKLLYHSSLHGQSFNTFLGNVTNGDAQTVLVIKDTEGSIYGAYASQPWERHSDFYGDMKTFLFKLYPEASIFRPTGANKSLQWCAVNFTSENIPNGIGFGGKPHHFGLFLSAGFDQGHSFTSSTFTNPPLSNTSRFRPEVIECWGIQVKGSNDEKPELVKGTVLERFKEDRNMLKLIGMASASD

SEQ ID NO: 108439 - protein, 301 aa, Triticum aestivum
  Clone ID: PAT_TA_2857.pep
MAGAGRKVAVAAVQFACTDTVADNVAAAERLIREAHKKGANIVLIQELFEGHYFCQAQRMDFFGRAKPYKENPTIMRMQKLAKELDVVIPVSFFEEAGNAHYNSVAIIDADGTDLGLYRKSHIPDGPGYQEKFYFNPGDTGFKAFKTKYATIGVGICWDQWFPETARAMVLQGAEILFYPTAIGSEPQDMNLDSREHWKRVMQGHAGANLVPLVASNRIGKETVETEHGNSTIKFYGNSFIAGPTGEIVKLANDKDEEVLVAEFDLDEIKSTRHGWGIFRDRRPDLYKVLLTLDGKTSSSS

SEQ ID NO: 108440 - protein, 257 aa, Triticum aestivum
  Clone ID: PAT_TA_2858.pep
TLKIANLATGEFLHLEKPVKNLRGDHFLFYNFGFHPLTKEYKITHLLGDSIEGRPRPHNNNRFSVVQVYTLGDEKWRDIKTPEALSLNCVKNSGAVTIDGTLYWLIEDVVASWQHAVMTFDLCGESFAQIQLPATKPEDFAAGGSRRYWIREMDGKVCVATAQTCPSLPRWLVGKLQIWELENKTEQRWIQKYNIQCSPDYIPGPNLVHGDKIILQRCDGNLYSYELLGENFNTELCKMAKLLDFSPHKPDNMQSYI

SEQ ID NO: 108441 - protein, 169 aa, Triticum aestivum
  Clone ID: PAT_TA_2859.pep
MASSQHVEVEAAKLLQKLILESKDEPAKLATKLYVICQHMKLSGKEQSLPYQVISRAMETVVSQHGIDMDALRSSRVPFAGGPQAVDSSGLMSKDKEVIGGQSSMVGSDASQSSGQAALWHLPPGSADMARPGVYIPGRASAGQNRGDVTGSDIHQGSMSQKSGRSSGV

SEQ ID NO: 108442 - protein, 101 aa, Triticum aestivum
  Clone ID: PAT_TA_2860.pep
KIFYFFFFSSIPFFFSSFFFFFFFFFFLQSSPLFLSSSLLFLFLLRFLMFYRVCRRRYIPLPITSTRGGITSTRGGGSIYPLPDNIIFPCIYVVVVDITPS

SEQ ID NO: 108443 - protein, 195 aa, Triticum aestivum
  Clone ID: PAT_TA_2861.pep
MKLSMQSLARKLSIPSPKRGKKQQQQQDGGKRGISRSEAPSFASASSSSTTSSSSEDALPRASTPRSVLPAEISRRELEAVLRRLGHEEPSDDELDAVAAIAAAGEAGPEDELMEAFNVFDADGDGRITAEELRGVLLAILGGEADGCSLDDCRRMIGGVDADGDGFVGFQDFARMMMVSTTAAAATTSAGPRFL

SEQ ID NO: 108444 - protein, 352 aa, Triticum aestivum
  Clone ID: PAT_TA_2862.pep
MNWGIGDEKGGEGTTHWLQQCGLPGVEFENLNKGNVGMRDGVSFDDGFKMGSLHGMESNLLQAMNSDPAAYNGTENAHDLSSGNFLAMGADAHKNGVDLGAGNSFFFGNNNGKRHVEDIDDGYNDQMQTQQQFLQGNQHKRMRNSSSSVPPGSAFFNANYSEPIQNLLVNASMLYEQKEREIQEALSQKQFMANLLQEKEAIIHSLNSARFEQENKLQSKLRCFEHDLNVMGQLVSGYKRALKQSHASFNEYRKKFPSNEFRYRDVPNGGGLVLSVRELERELERKRCEEEQQKIAAANEMIGNFKLEWLSKPDDWEDRINLLWRKTEGLARELDLLKEKRKAKLAALAREE

SEQ ID NO: 108445 - protein, 113 aa, Triticum aestivum
  Clone ID: PAT_TA_2863.pep
RSRRCRKTTYGCIRVKFIGGTLWVCARCMAVMPVRASLHGCILQFTVSRRTRRQIHPSLAALKALSGRNLSHRGRLMVMTVAISGHDSHVRGCIGAMGINVVDMCSCIDWRFR

SEQ ID NO: 108446 - protein, 111 aa, Triticum aestivum
  Clone ID: PAT_TA_2864.pep
APPALTFPQSLHPQIPTAFLFTANLPQNSQKYFSECITSEDLDDMNIEIMRNTLYKAYLEDFYKFCVKLGGATAEIMCNLLSFEADRRAVNITINSIGTCPSSGRPGRSDG

SEQ ID NO: 108447 - protein, 250 aa, Triticum aestivum
  Clone ID: PAT_TA_2865.pep
MDQTPQRRRRRRAEVAPSDGAPDAAEYSLDEPTLAEKLAAMSPLAEAAGGAAGESLPVVPPSADSVHVLLRQALQADDRAALLGCLYNRDGKVIVKSVSLLTPADAVKLLKSLVSLMQSRGSVLVCLLPWLQALLSRHMSSIVSQDSSLLLLNSLYQLIDARTSTFASSLKLSTCLDYHFSEICDDESDEEEGGPPLIYEDVDSDEEDSEDDDAMETEDKGTDEEDSEVDDAMETERKGTDKEESEVDDE

SEQ ID NO: 108448 - protein, 184 aa, Triticum aestivum
  Clone ID: PAT_TA_2866.pep
MKTLLILTILAMAITIATANMQADPSGQVQWPQQQPFLQPHQPFSQQPQQIFPQPQQTFPHQPQQPFPQPQQPQQSFPQQQPSLIQQSLQQQLNPCKNFLLQQCKPVSLVSSLCSIILPPSDCQVMRQQCCQQLAQIPQQLQCAAIHSVVHSIIMQQEQQEQLQGVQILVPLSQQQQVGQGILV

SEQ ID NO: 108449 - protein, 220 aa, Triticum aestivum
  unsure (1)..(220): unsure at all Xaa locations
  Clone ID: PAT_TA_2867.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQXQQQQQILQQILQQQLIPCRDVVLQQHNIAHASSQVLQQSTYQLLQQLCCQQLLQIPEQSRCQAIHNVAHAIFMHQQQQQQQEQQQQ

SEQ ID NO: 108450 - protein, 247 aa, Triticum aestivum
  Clone ID: PAT_TA_2868.pep
KTLLILTILAMAITISTANMQVDPSGQVQWPQQQLVPQPQQPLSQQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHSVVHSIIVQQQQQQQQQQQQQQQGMHILLPLSQQQQLGQGTLVQGQGIIQPQQLAQLEAIRSLVLQTLPTMCNVYVPPECSIIRAPFASIVAGIGGQ

SEQ ID NO: 108451 - protein, 156 aa, Triticum aestivum
  unsure (1)..(156): unsure at all Xaa locations
  Clone ID: PAT_TA_2869.pep
TTFSQPQQPFPWQPQQPFPQTQQSFPLQPQQPFPQQPQQSFPQPQPQQPQQPFPQQPQQPFPLRPQQPFPQQPQQSQQSFPQPQPQXPQQPSILQPQQPLPQQPQQPFQQPQQQLSQQPEQTISQQPQQPFPXHQPQQPYPQQQPYGSSLTSIGGQ

SEQ ID NO: 108452 - protein, 249 aa, Triticum aestivum
  unsure (1)..(249): unsure at all Xaa locations
  Clone ID: PAT_TA_2870.pep
FEINPTKGNKSWSSTAVAAALELVDPPGCRNSARAQXPYPQQPQQPFPQTQQPQQLFPQSQQPQQQFSQPQQQFPQPQQPQQSFPQQQPPFIQPSLQQQVNPCKNFLLQQCKPVSLXVSSLWXSMIWPQSDFQXWMRQQCCQQLAQFLKQSQCASIHTIIHSIIMQQEQQEQQQGMHILLPLYQQQQVGQGTLVQGQGIIQPQQPAQLEAIRSLVLQTLSTMCNVYXPPECFIIXXPFXSSVVARXGGQ

SEQ ID NO: 108453 - protein, 103 aa, Triticum aestivum
  unsure (1)..(103): unsure at all Xaa locations
  Clone ID: PAT_TA_2871.pep
FSQSRQPFPQQPQQPFPLQPQQPFPQQXAQIIPQQPQQPFPLQPQQSFLRQSQQPFLQQPQQPSPQPQQVVQIIPQQPQQPFPLLANQPQQPYPQQQPSGVMV

SEQ ID NO: 108454 - protein, 117 aa, Triticum aestivum
  Clone ID: PAT_TA_2872.pep
RPGLEHTIISISSPTNGASQGDCCRLCRAGPDDPATGANGRAGHTMRRVRAGMRPGLQCAAPLLLQQLLQHLSHPVQLLLPHPIRLVRARVHKPLQDQLRVIDHAGTHRHEWTPECR

SEQ ID NO: 108455 - protein, 137 aa, Triticum aestivum
  Clone ID: PAT_TA_2873.pep
MADAKTTTAVTLRTRKFMTNRLLARKQFVLEVIHPGRANVSKAELKERLAKVYEVKDPNCIFVFKFRTHFGGGKSSGFGLIYDNLESAKKFEPKYRLIKNGLATKVEKSRKQIKERKNRTKKIRGVKKTKAGDAKKK

SEQ ID NO: 108456 - protein, 88 aa, Triticum aestivum
  unsure (1)..(88): unsure at all Xaa locations
  Clone ID: PAT_TA_2874.pep
MADAKTTTAXVTLRTRKFMTNRLLARKQFVLEVIHPGRANVSKAELKERLAKVYEVKEKSRKQIKERKNRTKKIRGVKKTKAGDAKKK

SEQ ID NO: 108457 - protein, 159 aa, Triticum aestivum
  unsure (1)..(159): unsure at all Xaa locations
  Clone ID: PAT_TA_2875.pep
MKTFXIFVLLAMAMKIATAARELNPSNKELQSPQQSFSHQQQPFPQQPYPQQPYPSQQPYPSQQPFPTPQQQFPQQSQQSFPQPQPQQPQQPSILQPQQPLPQQPQQPFQQPQQQLSQQPEQTISQQPQQPFPQQPHQPQQPYPQQQPYGSSLTSIGGQ

SEQ ID NO: 108458 - protein, 117 aa, Triticum aestivum
  unsure (1)..(117): unsure at all Xaa locations
  Clone ID: PAT_TA_2876.pep
HRSSIENSESDSDRKRHMKSRKDRKRRRXHRRKDDSSEDDESGGEERRHHRHHKRRHHRRDASGSDSDGSESPHERKRSSKQKSHKRSESHGLGEDERHCPQGASRSGEKSREHKRG

SEQ ID NO: 108459 - protein, 255 aa, Triticum aestivum
  Clone ID: PAT_TA_2877.pep
MYGWEMLSFNIHDGFLEAIVRGNRSGLLTAADYNNLCQCETLDDIKMHLTATEYGPYLQNEPSTLHTTTIVEKCTLKLVDEYKHMLCQATEPLSTFLQYITYGHMIDNVVLIVTGTLHERDVNELLEKCHPLGMFDSIASLAVAQNMRELYRLVLVDTPLAPYFSECITSEDLDDMNIEIMRNTLYKAYLEDFYKFCEKLGGATAEIMCDLLSFEADRRAVNITINSIGTELTRDDRRKLYSNFGLLYPYGHEEL

SEQ ID NO: 108460 - protein, 162 aa, Triticum aestivum
  Clone ID: PAT_TA_2878.pep
AETSCRMTAKTLRNKGATDCTGGPTREQSAIHRKTKVTSGSNGRKPKGFGRFNEGIKRMLKLEAAEKALSDAVEKECLAEEKYYCGLHDRPKSYTTFDEKQFGNLDDPVARDFPCSVVSLALFDGDTMLFACSGIPLPPGRAKLPLTRYVTSERLVRVYQGY

SEQ ID NO: 108461 - protein, 232 aa, Triticum aestivum
  unsure (1)..(232): unsure at all Xaa locations
  Clone ID: PAT_TA_2879.pep
QQPQQPFPQQQPQQPFPQQPQQPFPQTEQPQQPFPQFQQPQQPFPQPQQQFPQPQQPQRSFPQQQRPSFQPSLQQRLNPCKNILLQQCKPASLVSSLWSIIWPQNDCQVMQQQCCQELAQIPXQLQCAAIHSVVHSIIMQQQEQEQEQEQEQEQQQQQGMRIFFPLSXQQQVGQGTLFQGQGIIRPQQPAQLEAIRSLVLQTLPTICNVYVPPECSNIRAPFASIVXGIGGQ

SEQ ID NO: 108462 - protein, 155 aa, Triticum aestivum
  Clone ID: PAT_TA_2880.pep
MMGSNNPGGAGGGGGGGMAPGTGGGGSDGRHDDEAVLTDFLSSLMDYNPTIPDELVEHYLGRSGFHCPDLRLTRLVAVAAQKFISDIASDSLQHCKARVAAPIKDNKSKQPKDRRLVLTMDDLSKALREHGVNLRHPEYFADSPSAGMAPSTREE

SEQ ID NO: 108463 - protein, 327 aa, Triticum aestivum
  Clone ID: PAT_TA_2881.pep
MEYERIHKPQAGALSPTKLRMKLLGAHNRVRVISSSSSRTSPSKNAEPSLAQNRLLVCDVLDEDSSGAAKCPSAVSNTEVVDKDPAVDSYKVQNMSKGSVHQPAPSNSSMIHPVRTVEEDSNECDSGLDNASTSSFEFHGGEKTAAQNPTAGYFSRQASSKWNDAEKWIVNKQTVQQNTTKGASQNQSAHQVSSAAPRGGGVVPKHHGAFARPIQNMKRFNPASSASRSILERLSFASHQPKLVRHADVCADQGSSANSDYQKGQAETNSIAIKTCNDTEAISTVQAVSVRDVGTEMTPIPSQDPSRTGTPLGSVTPTRSPNCSIPS

SEQ ID NO: 108464 - protein, 140 aa, Triticum aestivum
  unsure (1)..(140): unsure at all Xaa locations
  Clone ID: PAT_TA_2882.pep
MAPGTGAGGSDGRHDDEAVLTEFLSSLMDYNPTIPDELVEHYLGRSXGFHCPDIRLTRLXVAVAAQKFISDIASDSLQHCKARVAAPIKDNKSKQPKDRRLVLTMDDLSKALREHGVNLKHPEYFADSPSAGMPPSTREE

SEQ ID NO: 108465 - protein, 202 aa, Triticum aestivum
  Clone ID: PAT_TA_2883.pep
MAPLLSPPLLADLVAKSHSSSTAVRCSGSVRRWAVAGLAGAGRRDRHRRRRTWGRRGFRVSAVATEPRSPEGSAAEDYYAVLGVMPDATPQQIKKAYYNCMKACHPDLSGNDPDVTNFCMFINEVYTVLTDPIQRAVYDEINGFTATATNPFLDDAPRDHVFVDEFSCIGCKNCANVCSKVFEIEEDYGRARVYNQSGNEEL

SEQ ID NO: 108466 - protein, 153 aa, Triticum aestivum
  Clone ID: PAT_TA_2884.pep
MMGSNNPGGAGGGGGMAPGTGAGGSDGRHDDEAVLTEFLSSLMDYNPTIPDELVEHYLGRSGFHCPDLRLTRLVAVAAQKFISDIASDSLQHCKARVAAPVKDNKSKQPKDRRLVLTMDDLSKALREHGVNLKHPEYFADSPSAGMAPSTREE

SEQ ID NO: 108467 - protein, 133 aa, Triticum aestivum
  Clone ID: PAT_TA_2885.pep
MKTFIIFVLLAMAMNIASASRLLSPRGKELHTPQEQFPQQQQFPQPQQQQQQQQQQGMHILLPLSQQQQLGQGTLVQGQGIIQPQQLAQLEAIRSLVLQTLPTMCNVYVPPECSIIRAPFASIRASSGHHLPA

SEQ ID NO: 108468 - protein, 316 aa, Triticum aestivum
  Clone ID: PAT_TA_2886.pep
MKTLLILTILAMAITISTANMQVDPSGQVQWPQQQLVPQPQQPLSQQPQQAFPQPQQTFPHQPQQQVPQPQQPQQPFLQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPQLPFPQQPQQPFPQPQQPQQPFPQLQQPQQPLPQPQQPQQPFPQQQQPLIQPYLQQQQQQQQQQQGMHILLPLSQQQQLGQGTLVQGQGIIQPQQLAQLEAIRSLVLQTLPTMCNVYVPPECSIIRAPFASIRASSGHHLPA

SEQ ID NO: 108469 - protein, 308 aa, Triticum aestivum
  unsure (1)..(308): unsure at all Xaa locations
  Clone ID: PAT_TA_2887.pep
MKTLLIQTILVMAITIATANMQVDPSGQVQWPQQQPFPQPHQPFSQQPQQTFPQPQQTFPHQPQQQXPKPQQPQQQFIQXPQQPFPQQPQQTYPQRPQQPFPQTQQPQQXPFPQSQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQQPTXTTXGMHILLPLSQQQQLGQGXLVQGQGIIQPQQLAQLEAIRSLVLQTLPTMCNVYVPPECSIIRAPFASIVAGIGGQ

SEQ ID NO: 108470 - protein, 217 aa, Triticum aestivum
  Clone ID: PAT_TA_2888.pep
MKTLLILTILAMATTIATANMQVDPSGQVQWPQQQPFPQPQQPFCQQPQRTIPQPHQTFHHQPQQTFPQPQQTYPHQPQQQFPQTQQPQQQIPQQPQQFPQQQFPQQQQFPQQQEFPQQQFPQQQFHQQQFPQQQFPQQQFPQQQQFPQQQQLTQQQFPRPQQSPEQQQFPQQPPQQFPQQQFPIPYPPQQSQEPSPYQQYPQQQPSGSDVISISGL

SEQ ID NO: 108471 - protein, 77 aa, Triticum aestivum
  Clone ID: PAT_TA_2889.pep
YLELIYLEHVLVCFSRAAHRRHVSIPRGGVGLAGEDARHEAPSDHPPLGASHCCHAKVELPRGRKTKVKGEPLLRDG

SEQ ID NO: 108472 - protein, 276 aa, Triticum aestivum
  Clone ID: PAT_TA_2890.pep
AIFTATAAWELNPGNKELQSPQQSFSYQQQPFPQQPYPQQPYSSQQPYPSQQPFPTPQQQFPEQSQQPFTQPQQPTPIQPQQPFPQQPQQPQQPFPQPQQPFPWQPQQPFPQTQQSFPLQPQQPFPQQPQQPFPQPQLPFPQQSEQIIAQQLQQPFPLQPQQPFPQQPQQPFPQPQQPIPVQPQQSFPQQSQQSQQPFAQPQQLFPELQQPIPQQPQQPFPLQPQQPFPQQPQQPFPQQPQQSFPQQPQQPFPQQPQQPYPQQQPYETSLTSIGGQ

SEQ ID NO: 108473 - protein, 118 aa, Triticum aestivum
  Clone ID: PAT_TA_2891.pep
SQLTTRWRRWPGLPVSWWSRCWSSSPLLSRAATEFTGRSAVDPGQSQAHRVVSFPVPTFRFHVAADYFDAHRRHAVSVHLPLTRTMEGSLDACKLANSSTYGQSQLYIFAIICARSGT

SEQ ID NO: 108474 - protein, 246 aa, Triticum aestivum
  unsure (1)..(246): unsure at all Xaa locations
  Clone ID: PAT_TA_2892.pep
MAPLLSPPLLADLVAKAHSSSTAVRCSGSVRRWEVAGLAGAGRRDRHRRRRTWGRRGFRVSAEATDPRSPEGSAVEDYYAALGVMPDATPHQIKKAYYNCMKACHPDLSGNDPDVTNFCMFINEVYTVLTDPIQRAXYDEINGFTATATNPFLDDAPRDHVFVDEFSCIRCKNCANVCSKVFEIEEDYGRVLADVMLHRRIIVRDDNNDPTRTPLVSLFCCHCVVYSVSELCFTQRNRTAMMNVSM

SEQ ID NO: 108475 - protein, 204 aa, Triticum aestivum
  Clone ID: PAT_TA_2893.pep
MALAILARRRAAEAVARRAHAPGAAALSAWRAYAAAAEESDVVVVGGGPGGYVAAIKAAQLGLKTTCIEKRGTLGGTCLNVGCIPSKALLHSSHMYHEAKTSFAHHGVKISNLEVDLPAMMAQKDKAVAGLTKGIEGLFKKNKVTYVKGFGKLTSPSEVSVDLVDGGNTVVKGKNIIIATGSDVKSLPGITIDEKKIVSSTGAL

SEQ ID NO: 108476 - protein, 129 aa, Triticum aestivum
  Clone ID: PAT_TA_2894.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPHQPQQPYPQQQPYGSSLTSIGGQ

SEQ ID NO: 108477 - protein, 144 aa, Triticum aestivum
  unsure (1)..(144): unsure at all Xaa locations
  Clone ID: PAT_TA_2895.pep
VRPRVRQAAPPECSVIHDCXDSNTESEGKNMVISFVGLLLDILRHNVLFKGPDMDQLPSTGLSPAGRQALEWRLKHASHSIEDMDWRLSVLQRLPPLSGRQWSWKEALVVLRAAPSKLLNVCMQRANYGIGEEAVQRFSLPAED

SEQ ID NO: 108478 - protein, 154 aa, Triticum aestivum
  Clone ID: PAT_TA_2896.pep
MSDIRDLRNFTASAGVRSDTDFTITLASLLYEVKDPNCIFVFKFRTHFGGGKSSGFGLIYDNLESAKKFEPKYRLIRNGLATKVEKSRKQIKERKNRTKKIRGVKDPNCIFVFKFRTHFGGGKSSGFGLIYDNLESAKKFEPKYRLSGMALLPR

SEQ ID NO: 108479 - protein, 121 aa, Triticum aestivum
  unsure (1)..(121): unsure at all Xaa locations
  Clone ID: PAT_TA_2897.pep
MAAVASSKGRVIAGSLVARVLAGKANASPRRAVHASAYDKNVDEQVRPAFVPDDVIGGRPXSPDKYWGPHPTTGVFGPAAVDPQAGPPASRRPAPAQGRPSVLDQKCGSAPLQDSEKPPSP

SEQ ID NO: 108480 - protein, 145 aa, Triticum aestivum
  unsure (1)..(145): unsure at all Xaa locations
  Clone ID: PAT_TA_2898.pep
ALEARSCKHHKNNSPNSNSLNHNKSSNNNSPNNNKSPXSRNNSPNSNSRNNNFPNNNNSRNNNSSPNNNNSPIHNNSPNNNSSPNNNNSPNNNSPSKHNNNSPNNNFPYHTHPNNNHKKLPHTNNTTTTTTTIWERRYKYQWPMK

SEQ ID NO: 108481 - protein, 58 aa, Triticum aestivum
  Clone ID: PAT_TA_2899.pep
KGIEGLFKKNKVEYVKGFGKLVSPSEVSVDLVDGGSTIVKGKNIIVATGSDVRWLGVL

SEQ ID NO: 108482 - protein, 124 aa, Triticum aestivum
  Clone ID: PAT_TA_2900.pep
DYDTVPGVVYTHPEVASVGKTEEQVKASGVAYQVGKFPLLANSRAKAIDDAEGMVKVISEKETDRILGVHIMSPGAGEIIHEAVLALQYGASSEDIARTCHAHPTVSEALKEACMNTYDKAIHM

SEQ ID NO: 108483 - protein, 151 aa, Triticum aestivum
  Clone ID: PAT_TA_2901.pep
MMGSNNPGGAGGGMAPGMGVGSSDGRHDDEAVLTEFLSSLMDYNPTIPDELVEHYLGRSGFHCPDLRLTRLVAIATQKFISDVASDSLQHCKARVAAPIKDNKSKQPKDRRLVLTMDDLSKALREHGVNLKHPEYFADSPSAGMGPSTREE

SEQ ID NO: 108484 - protein, 82 aa, Triticum aestivum
  Clone ID: PAT_TA_2902.pep
RTRGLSLQSTSVANGQPQAVADPGSICKLQADLPIARRHSLQRFLEKRRDRVVSKAPYGAGKPFEGMGASSGMEAVAEGKAQ

SEQ ID NO: 108485 - protein, 85 aa, Triticum aestivum
  Clone ID: PAT_TA_2903.pep
PGSTADLPVNSVAARDSSGTLPYRCILTSHSFGRSLSPVHLQRKGARSVSYYALFKGWLLLGKPPGCLCTPTSFITERSFRGLSW

SEQ ID NO: 108486 - protein, 151 aa, Triticum aestivum
  Clone ID: PAT_TA_2904.pep
MMGSNNPSGAGGGMAPGMGAGSSDGRHDDEAVLTEFLSSLMDYNPMIPDELVEHYLGRSGFHCPDLRLTRLVAVATQKFISDIASDSLQHCKARVAAPIKDNKSKQLKDRRLVLTMDDLSKALREHGVNLKHPEYFADSPSAGMGPSTREE

SEQ ID NO: 108487 - protein, 206 aa, Triticum aestivum
  Clone ID: PAT_TA_2905.pep
MDLLERRSATIKAEAGEAQRKEAERKEQELEKEKETQQQGQGGLTRPPLANGRSGMLPMSSPPANPGQLTIFYGGSVCVYDSVPPEKAQAIMLIAAAAAAASKSNGTAAVKPPAMSATNAIQAMLTRSLSLQSTSVANGQPQAVADPGSICKLQADLPIARRHSLQRFLEKRRDRVVSKAPYGAGKPSEGLGASSGMEAVAEGKAQ

SEQ ID NO: 108488 - protein, 128 aa, Triticum aestivum
  Clone ID: PAT_TA_2906.pep
PASPIFFLSTDRVRSNTSIITISSPRNGASQGDSCLMCRAGPDDPAAGAGGRTGHNMRRVRTGMWPGVQCAAPLLLQQLLQHLSHPVQLLLPHPIRLVCARVHKPLQDQLCVIDHAGTHRHAWIQECR

SEQ ID NO: 108489 - protein, 151 aa, Triticum aestivum
  unsure (1)..(151): unsure at all Xaa locations
  Clone ID: PAT_TA_2907.pep
RCRVXLSSSCCSPAIRRRGLLESSSGRNQHFLVQHGGATIRGGVARREVGGPAWGRPRAGPKTPGGGVRAPSTCLGSPAPADHIVPARKAGRHLLRPRSCRRPTRAPPSFGEALALPARTRATRLPAITRPLELATAAMQRSSCREGGRRR

SEQ ID NO: 108490 - protein, 398 aa, Triticum aestivum
  unsure (1)..(398): unsure at all Xaa locations
  Clone ID: PAT_TA_2908.pep
CAPSLSGAIRINPWNVESTAESLNEAIXCXERDKELRHEKHYRYVSTHDVAYWSRSFIQDLERACKDHFRKPCWGIGLGFGFRVVALDPNFSKLSFDSIIMSYGRSKSRAIFLDYDGTLVPQASLYQKPSEELVSIINTLCSDKNNIVFIVSGRSKNSLGSMFSSCPILGIAAEHGYFLRWTRDEEWQTSTQSPDIGWMQMAEPVMNLYTEATDGSYIETKETALVWHHRDADQGFASSQAKEMLDHLXESVLANEAVSVKSGQFXIVEVKPQGVSKGLIAEKILASMKEKGQQADFVLCIGDDRSDEDMFENIADAMKKGIVAPKTPLFACTVGQKPSKAKFYLDDTYEVVSMLSALAEVSEPDPTAGLTDDLATSVSSLDIGDEQIQFSNTRIEGC

SEQ ID NO: 108491 - protein, 291 aa, Triticum aestivum
  unsure (1)..(291): unsure at all Xaa locations
  Clone ID: PAT_TA_2909.pep
MKTLLILTILAMAITIATANMQVDPSGQVQWPQQQPFLQPHQPFSQQPQQIFPQPQQTFPHQPQQQXPKPQQPQQQFLQXPRQPFPQQPQQPXPQTQQPQQPFPQQPQQPFPQTQQPQQPFPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYVPPECSIMRAPFASIVAGIGGQ

SEQ ID NO: 108492 - protein, 381 aa, Triticum aestivum
  unsure (1)..(381): unsure at all Xaa locations
  Clone ID: PAT_TA_2910.pep
MAGYRSASSSSAAGAGGAAVFAMRVLLLLTLLPLALAAFAFALQWRGGMRDPTGTVWXADTQRFPGMENSPLGSSSSSTGGRGSYFAVSSASASSAAADCAEILGRSASSHGISLYRGWSFDSDNGXTPKICITGSTSASLHQILPWLYYHKVIGVSHFILFVEGEAAKPAVTSVLESIRGVKIIYRTKELKEQQDRSRIWNETWLSGFFYKPCNYELFVKQSLNMEMAIVMAREAGMDWIIHLDTDELIHPAGAREYSLRRLLLDVPDNVDMVIFPNYESSVERDDIKDPFTEVSMFKKNYDHLPKDTYFGLYKEATRGNPNYFLTYGNGKSAARVQEHMRPNGAHRWHNYMKSPNEIKLEEAAILHYTYTKFSDLTSRR

SEQ ID NO: 108493 - protein, 120 aa, Triticum aestivum
  Clone ID: PAT_TA_2911.pep
AGRAPGSNTTIISISSPTNGASQGDCCHVCRAGPDDPAAGAGGCAGDTMRPVRAGMRPGVQCAGPLLLQQLLQHLSHPVQLLLPHPIRLVHSRVRKPLQGQLRVIDHAGTHRHAWIRGCR

SEQ ID NO: 108494 - protein, 171 aa, Triticum aestivum
  Clone ID: PAT_TA_2912.pep
LLAALLPQQPQQSFPQQQRSFIQPSLQQQLNPCKNILLQQCKPASLVSSLWSIIWPQSDCQVMRQQCCQQPFPQLQQPQQPFPQPQQQLPQPQQQQQGMHIFLPLSQQQQVGQGSLVQGRGIIQPQQPAQLEAIRSLVLQTLPSMCNVYVPPECSIMRAPFASIVAGIGGQ

SEQ ID NO: 108495 - protein, 61 aa, Triticum aestivum
  Clone ID: PAT_TA_2913.pep
RGLFFFFFSFFFFFFFFFFFFFFFFFFFFFFQSQTHIILTLHKTQYWIFFFFFDIPNESYS

SEQ ID NO: 108496 - protein, 222 aa, Triticum aestivum
  Clone ID: PAT_TA_2914.pep
GRRRSRHLLRRQPTAKRGRISHGGRQDHHGGHPPHPQVHDQPPARPQAVRARGHPPRPRYHTCRRFQPSWCASSSRRRVAGGGCCGVGGEMAVRVAQPLLRRRRGRPSARKPRGRSRSLRRSRRPSSQDSPADPRSPTAGLECCQCRALQQIRDSLPFFMVGQYVCMTQCHQRRLKQSCSLQQQQLRPQKAMAPLLLSLQRCLRPMLSKPCLRGRSHSRALL

SEQ ID NO: 108497 - protein, 92 aa, Triticum aestivum
  Clone ID: PAT_TA_2915.pep
MTKRTKKAGIVGKYGTRYGASLRKQIKKMELSQHSKYFCEFCGKFAVKRKAVGIWGCKDCGKVKAGGAYTMNTASAVTVRSTIRRLREQTEA

SEQ ID NO: 108498 - protein, 204 aa, Triticum aestivum
  Clone ID: PAT_TA_2916.pep
MDLLERSAATIKAEAGEAQRKEAERKEQELEKEQETQQPGLTGRPPLANGRSGMLPMSSPPANPGQLTIFYGGSVCVYDSVPPEKAQAIMLIAAAAAAASKSNGTAAVKPPAMSATNAIQAMLTRSLSLQSTSVANGQPQAVADPGSICKLQADLPIARRHSLQRFLEKRRDRVVSKAPYGAGKPSEGMGASSGMEAVAEGKAQ

SEQ ID NO: 108499 - protein, 173 aa, Triticum aestivum
  unsure (1)..(173): unsure at all Xaa locations
  Clone ID: PAT_TA_2917.pep
ALEARNCILHKNNSPNNNNSPNHNNSPNNKFPNNXNNIKSPSNHNNSPNNNNSSNNNKSRNNKSPNNIKSPSNHNNSPNNNSPNNTNPPNNNSPNSNSPNNNSSPNNNNXRNNNSPGHNNPLNNNNSPNNNSPSNHHNNSPNNNFQYHTHPSNHKNLPHTNNIHNNNHLGATL

SEQ ID NO: 108500 - protein, 351 aa, Triticum aestivum
  Clone ID: PAT_TA_2918.pep
MYSWEMLSFNIHDGFLEAIVRGNRSGLLTQADYNNLCQCETLDDIKMHLSATEYGPYLQNEPSPLHTTTIVEKCTLKLVDEYKHMLCQANEPLSTFLQYITYGHMIDNVVLIVTGTLHERDVNELLEKCHPLGMFDSIASLAVAQNMRELYRLVLVDTPLAPYFSECITSEDLDDMNIEIMRNTLYKAYLEDFYKFCAKLGGATAEIMCNLLSFEADRRAVNITINSIGTELTRDDRRKLYSNFGLLFPYGHEDLAVCEDVDQVRGVMEKYPPYQSIFAKISYGESQMLDKAFYEEEVKRLCLSFEQQFHYAVFFAYMRLREQEIRNLMWISECVAQNQKNRVHDSVVPIF

SEQ ID NO: 108501 - protein, 174 aa, Triticum aestivum
  Clone ID: PAT_TA_2919.pep
MLWGNFTGYQFHEPAMAMISPSLEITLTKGNKSWSSTAVAAALELVDPPGCRNSARGSFRLPDFAAAAAAAARRPRLLPVDEMTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 108502 - protein, 197 aa, Triticum aestivum
  Clone ID: PAT_TA_2920.pep
QQPFSQPQQLIPMQAQQPFPQQSQQSQQPFPGPQQLFPELQQPIPQQPQQPFPLQPQQPFPQQSQQPFPQQPQQPCPLQPQQPFPQQPQQPFPQQPQQPFPLQPQQPFPLRPQQPFSQQPQQSQQSFPQPQPQQPQQPSILQPQQPFLQPQQQLSQQLEQTISQQPQQPFPQQPHQPQQPYPQQQPYGSSLTSIDGQ

SEQ ID NO: 108503 - protein, 117 aa, Triticum aestivum
  Clone ID: PAT_TA_2921.pep
RRRLPALFAAAAAARCCGRLLLADEMTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 108504 - protein, 351 aa, Triticum aestivum
  Clone ID: PAT_TA_2922.pep
MYSWEMLSFNIHDGFLEAIVRGNRSGLLTQADYNNLCQCETLDDIKMHLSATEYGPYLQNEPSPLHTTTIVEKCTLKLVDEYKHMLCQANEPLSTFLQYITYGHMIDNVVLIVTGTLHERDVNELLEKCHPLGMFDSIASLAVAQNMRELYRLVLVDTPLAPYFSECITSEDLDDMNIEIMRNTLYKAYLEDFYKFCVKLGGATAEIMCNLLSFEADRRAVNITINSIGTELTRDDRRKLYSNFGLLFPYGHEELAVCEDVDQVRGVMEKYPPYQSIFAKISYGESQMLDKAFYEEEVKRLCLSFEQQFHYAVFFAYMRLREQEIRNLMWISECVAQNQKNRVHDSVVPIF

SEQ ID NO: 108505 - protein, 298 aa, Triticum aestivum
  Clone ID: PAT_TA_2923.pep
MKTLLILTILAMAITIGTANMQVDPSSQVQWPQQQPVPQPHQPFSQQPQQTFPQPQQTFPHQPQQQFPQPQQPQQQFLQPQQPFPQQPQQPYPQQPQQPFPQTQQPQQLFPQSQQPQQQFSQPQQQFPQPQQPQQSFPQQQPPFIQPSLQQQVNPCKNFLLQQCKPVSLVSSLWSMIWPQSDCQVMRQQCCQQLAQIPQQLQCAAIHTIIHSIIMQQEQQEQQQGMHILLPLYQQQQVGQGTLVQGQGIIQPQQPAQLEAIRSLVLQTLPTMCNVYVPPECSIIKAPFSSVVAGIGGQ

SEQ ID NO: 108506 - protein, 92 aa, Triticum aestivum
  Clone ID: PAT_TA_2924.pep
MTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 108507 - protein, 351 aa, Triticum aestivum
  Clone ID: PAT_TA_2925.pep
MYSWEMLSFNIHDGFLEAIVRGNRSGLLTQADYNNLCQCETLDDIKMHLSATEYGPYLQNEPSPLHTTTIVEKCTLKLVDEYKHMLCQANEPLSTFLQYITYGHMIDNVVLIVTGTLHERDVNELLEKCHPLGMFDSIASLAVAQNMRELYRLVLVDTPLAPYFSECITSEDLDDMNIEIMRNTLYKAYLEDFYKFCAKLGGATAEIMCNLLSFEADRRAVNITINSIGTELTRDDRRKLYSNFGLLFPYGHEELAVCEDVDQVRGVMEKYPPYQSIFAKISYGESQMLDKAFYEEEVKRLCQSFEQQFHYAVFFAYMRLREQEIRNLMWISECVAQNQKNRVHDSVVPIF

SEQ ID NO: 108508 - protein, 120 aa, Triticum aestivum
  Clone ID: PAT_TA_2926.pep
MAAVASSKGRVIAGSLVARVLAGKANASPRRAVHASAYDKNVDEQVRPAFVPDDVIGGAGSPDKYWGPHPTTGVFGPAAVDPKLAASLAPASAAANGGASVLDQKVWFRPLEDVEKPPVA

SEQ ID NO: 108509 - protein, 123 aa, Triticum aestivum
  Clone ID: PAT_TA_2927.pep
RPGRVAAARPRLPDFAAAAAARRPRLLPVDEMTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 108510 - protein, 246 aa, Triticum aestivum
  Clone ID: PAT_TA_2928.pep
QTFPQPQQTFPHQPQQQFPQPQQPQQQFLQPQQPFPQQPQQPYPQQPQQPFPQTQQPQQLFPQSQQPQQQFSQPQQQFPQPQQPQQSFPQQQPPFIQPSLQQQVNPCKNFLLQQCKPVSLVSSLWSMIWPQSDCQVMRQQCCQQLAQIPQQLQCAAIHTVIHSIIMQQEQQQGMHILLPLYQQQQVGQGTLVQGQGIIQPQQPAQLEAIRSLVLQTLPTMCNVYVPPECSIIKAPFSSVVAGIGGQ

SEQ ID NO: 108511 - protein, 119 aa, Triticum aestivum
  Clone ID: PAT_TA_2929.pep
MAAVASSKGRVIAGSLVARVLAGKANASPRRAVHASAYDKNVDEQVRPAFVPDDVIGGAGSPDKYWGPHPTTGVFGPAAVDPKLAASLAPASAAKGGPSVLDQKVWFRPLEDVEKPPVA

SEQ ID NO: 108512 - protein, 503 aa, Triticum aestivum
  unsure (1)..(503): unsure at all Xaa locations
  Clone ID: PAT_TA_2930.pep
MAMASLARRRAAEAVLLRRPHAAAWASACRGYAASGEESDVVVIGGGPGGYVAAIKAAQLGLKTTCIEKRGALGGTCLNVGCIPSKALLHSSHMYHEAKSSFAHHGVKFSNLEVDLPAMMAQKDKAVSGLTKGIEGLFKKNKVEYVKGFGKLVSPSEVSVDLVDGGSTIVKGKNIIVATGSDVKSLPGVTIDEKKIVSSTGXALALTEIPKKLVVIGAGYIGLEMGSVWNRLGSEVTVVEFAPDIVPSMDGEIRKQFQRMLEKQKFKFMLKTKVVGVDTSGSGVKLTVEPAAGGEQTVIEADVVLVSAGRVPYTAGIGLDAIGVETDKGGRVLVDNRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGMVKVISEKETDRILGVHIMSPGAGEIIHEAVLALQYGASSEDIARTCHAHPTVSEALKEACMNTYDKAIHM

SEQ ID NO: 108513 - protein, 218 aa, Triticum aestivum
  Clone ID: PAT_TA_2931.pep
MDLLERSAATIKAEQGEAQRKEAERKEQEQEQEHKEQETQQPGLTGRPPLANGRSGMLRMSSPPANPGQLTIFYGGSVCVYDSVPPEKAQAIMLIAAAAAAASKSNGTTAVKPPAMSATNAIQAMLTRSLSLQSTSVANGQPQAVADPGSICKLQADLPIARRHSLQRFLEKRRDRVVSKAPLRRREAIRRHGSIFWDGSGRGGQGPVTMKEERRPCP

SEQ ID NO: 108514 - protein, 150 aa, Triticum aestivum
  Clone ID: PAT_TA_2932.pep
MSALSNENIGLGFGFRVVALDPNFSKLSFDSIIMSYGRSKSRAIFLDYDGTLVPQASLYQKPSEELVSIINTLCSDKNNIVFIVSGRSKNSLGSMFSSCPILGIAAEHGYFLRWTRDEEWALLLQKHHCLHVLWGRNRAKPSSIWTIHMK

SEQ ID NO: 108515 - protein, 118 aa, Triticum aestivum; identical to SEQ ID NO: 108473
  Clone ID: PAT_TA_2933.pep

SEQ ID NO: 108516 - protein, 123 aa, Triticum aestivum
  Clone ID: PAT_TA_2934.pep
STIPCLRRRSFRLPDFAAAAAHRPRLLPVDEMTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 108517 - protein, 172 aa, Triticum aestivum
  Clone ID: PAT_TA_2935.pep
MVKYSRDPSNPTKSAKACGKDLRVHFKNTRETAFALRRMPLGKAKRYLEDVLAHKQAIPFRRYCRGVGRTAQVKNRQPNGQGRWPAKSAQFVLDLLKNAESNAEVKGLDVDNLYISHIQVNQAQKQRRRTYRAHGRINPYMSNPCHIELILSEKEEPVKKEADNVVAPRKAI

SEQ ID NO: 108518 - protein, 304 aa, Triticum aestivum
  unsure (1)..(304): unsure at all Xaa locations
  Clone ID: PAT_TA_2936.pep
MKTLLIQTILVMAITIATANMQVDPSGQVPWPQQQPFPQPHQPFSQQPQQTFPQPQQTFPHQPQQQFSQPQQPQQQFIQPQQPFPQQPQQTYPQRPQQPFPQTQQPQQPFPQVSXQPQQPFPQPQQQFPQPQQPQQSFPQQQPSLIQQSLQQQLNPCKNFLLQQCKPVSLVSSLWSMILPRSDCQVMRQQCCQQLAQIPQAXSQCAAIHSIVXHSIIMQQEQQXEQRQGVQILVPLSQQQQVGQGTLXVQGQGIIQPQQPXAQLEVIRSLVLQTLATMCNVYVPPYCSTIRAPFASIVAGIGGQ

SEQ ID NO: 108519 - protein, 172 aa, Triticum aestivum; identical to SEQ ID NO: 108517
  Clone ID: PAT_TA_2937.pep

SEQ ID NO: 108520 - protein, 292 aa, Triticum aestivum
  Clone ID: PAT_TA_2938.pep
MAAPETSACGAGPALLFPSSSSSSSSARVEAVVVFTICDSFVRRPDQAERVIGTLLGSVLPDGTVHVRNAYVVPHSESADQVALDIEYHHNMYASHQKVNPKEVLVGWFSTGFGVSGGSTLIHEFYSREVQSPIHLTVDTGFTMGEASIKAYVSSNLSLGDRHLAAQFQEIPLELKMLDAEKVGFEMLKSTMVEKLPNDLEGMESSMQKLYALIDEIYKYVDDVVEARVAPDNKIGRFIADTVSSMPKLSPASFDRLFNDKIQDNLALVYLSSITRTQIAVAEKLNTAAQVL

SEQ ID NO: 108521 - protein, 339 aa, Triticum aestivum
  unsure (1)..(339): unsure at all Xaa locations
  Clone ID: PAT_TA_2939.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQQPQQPFPQTQQPQQPFPQQPQQPFPQTQQPQQPFPQFQQPHQPFHQPQQQFPQPQQPQQSFPQQQRPFIQPYPQQRLNPCKNILLQQCKPASLVSSLWSIIWPQSDCQVMQQQCCQELAQIPQQLQCAAIHSVVHSIIQQQQQQQQQQQQQGMHILLPLSQQQQLGQGTLVQGQGIIXQPQQLAQLEAIRSLXVLQTLPTMCNVYVPPECSIIRAPFASIVAGIGGQ

SEQ ID NO: 108522 - protein, 345 aa, Triticum aestivum
  Clone ID: PAT_TA_2940.pep
MKTLLILTILAMAITISTANMQVDPSGQVQWPQQQLVPQPQQPLSQQPQQAFAQPQQTFPHQPQQQVPQPQQPQQPFPQTQQPQQPFPQQPQQPFPQTQQPQQPFPQQPQQPFPQQSQQPFPQTQQPQQPFPQQPQQPFPQTQQPQQPFPQFQQPHQPFPQPQQQFPQPQQPQQSFPQQQRPFIQPSLQQRLNPCKNILLQQCKPASLVSSLWSIIWPQSDCQVMQQQCCQELAQIPQQLQCAAIHSVVHSIIVQQQQQQQQQQQQQQGMHILLPLSQQQQLGQGTLVQGQGIIQPQQLAQLEAIRSLVLQTLPTMCNVYVPPECSIIRAPFASIRASSGHHLPA

SEQ ID NO: 108523 - protein, 118 aa, Triticum aestivum
  Clone ID: PAT_TA_2941.pep
YNNGNAGTLIDTLESMHVDAFLHGRSLAVDPAEVCALGNAQAGLDEEAVVAQGGKDVAEAVAEVGALRIARLGASRPALVAWYLLRSRRRLQLDHQDQHDTHGNSHLERRHLLGWIWI

SEQ ID NO: 108524 - protein, 92 aa, Triticum aestivum; identical to SEQ ID NO: 108506
  Clone ID: PAT_TA_2942.pep

SEQ ID NO: 108525 - protein, 203 aa, Triticum aestivum
  Clone ID: PAT_TA_2943.pep
MDLLERSATIKAEAGEAQRKEAERKEQQQEQETQQQGQGLTARPPLANGRSGMLPMSSPPANPGQLTIFYGGSVCVYDSVPPEKAQAIMLIAAAAAAASKSNGTAAVKPPAMSATNAIQAMLTRSLSLQSTSVANGQPQAVADPGSICKLQADLPIARRHSLQRFLEKRRDRVVSKAPYGAGKPSEGMGASSGMEAVAEGKAQ

SEQ ID NO: 108526 - protein, 92 aa, Triticum aestivum; identical to SEQ ID NO: 108506
  Clone ID: PAT_TA_2944.pep

SEQ ID NO: 108527 - protein, 172 aa, Triticum aestivum
  Clone ID: PAT_TA_2945.pep
MVKYSRDPSNPTKSAKACGKDLRVHFKNTRETAFALRRMPLGKAKRYLEDVLAHKQAIPFRRYCRGVGRTAQVKNHQPNGQGRWPAKSAQFVLDLLKNAESNAEVKGLDVDNLYISHIQVNQAQKQRRRTYRAHGRINPYMSNPCHIELILSEKEEPVKKEADNVVAPRKAI

SEQ ID NO: 108528 - protein, 215 aa, Triticum aestivum
  unsure (1)..(215): unsure at all Xaa locations
  Clone ID: PAT_TA_2946.pep
FGTRPFPQQPQQPFPQPQQPIPVQPQQSFPQQSQQSQQPFAQPQQLFPELQQPIPQQPQQPFPLQPQQPFPQQPQQPFPQQPQQSFPQQPQQPFPQQPQQPFPQQPQQPFPQQPQQPFPLRPQQPFPQQPQQSQQSFPQPQPQQPQQPSILQPQQPLPQQPQQPFQQPQQQLSQQPEQTISQQPQQPFPPAXHQPQQPYPQQQPYGSSLTSIGGQ

SEQ ID NO: 108529 - protein, 137 aa, Triticum aestivum
  Clone ID: PAT_TA_2947.pep
MADAKATTAVTLRTRKFMTNRLLARKQFVLEVIHPGRANVSKAELKERLAKVYEVKDPNCIFVFKFRTHFGGGKSSGFGLIYDNLESAKKFEPKYRLIRNGLATKVEKSRKQIKERKNRTKKIRGVKKTKAGDAKKK

SEQ ID NO: 108530 - protein, 356 aa, Triticum aestivum
  Clone ID: PAT_TA_2948.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQPFPQFQQPHQPFPQPQQQFPQPQQPQQSFPQQQRPFIQPSLQQRLNPCKNILLQQCKPASLVSSLWSIIWPQSDCQVMQQQCCQELAQIPQQLQCAAIHSVVHSIIVQQQQQQQQQQQQQGMHILLPLSQQQQLGQGTLVQGQGIIQPQQLAQLEAIRSLVLQTLPTMCNVYVPPECSIIRAPFASIVAGIGGQ

SEQ ID NO: 108531 - protein, 237 aa, Triticum aestivum
  Clone ID: PAT_TA_2949.pep
MPTYFYFCDTSLTLYPSTHQVNLYDKILNSLNTRVQEHMRPNGAHRWHNYMKSPNEIKLEEAAILHYTYTKFSDLTSRRDRCGCKPTKEDVKRCFILEFDRLAFIIASTATEQEMRNWYREHVVWTDKDTNLKLLRKGVLTRIYAPMAIIRGLKESGIFIDAVTSAKAHPKANIGLENNESIHTNVTAAQSTTLKEGGNDNSQATARKILEMIDVQEEAVPPMSPPGFLELMESALS

SEQ ID NO: 108532 - protein, 137 aa, Triticum aestivum; identical to SEQ ID NO: 108529
  Clone ID: PAT_TA_2950.pep

SEQ ID NO: 108533 - protein, 137 aa, Triticum aestivum
  Clone ID: PAT_TA_2951.pep
MADAKTTTAVTLRTRKFMTNRLLARKQFVLEVIHPGRANVSKAELKERLAKVYEVKDPNCIFVFKFRTHFGGGKSSGFGLIYDNLESAKKFEPKYRLIRNGLATKVEKSRKQIKERKNRTKKIRGVKKTKAGDAKKK

SEQ ID NO: 108534 - protein, 243 aa, Triticum aestivum
  Clone ID: PAT_TA_2952.pep
EAPFVGLDMDMMVVLHLQYYWFKTGVHHSHQHHCHHHHHHTSPARSYSGQQHRVTTIGSGACHVCTIARAHHYRLYVIISRKSSPAKRSDRDVELGYGRRRWRSGDGGLLDVLERAEPHLLVQHGGATIRGASSRREAGGQLGVDRGRAEDAGGRVRAPVLVWAPGAADHIVRHEGRAHLLVHVLVVGRRVHRPPRGGVGLAGEDARDEAPSDHPPLGASHCCHAKVELPRGRKTKVKGEALL

SEQ ID NO: 108535 - protein, 297 aa, Triticum aestivum
  unsure (1)..(297): unsure at all Xaa locations
  Clone ID: PAT_TA_2953.pep
ARNCIHNNNNSPNHNNSLNHNKSPNNNSPNNIKSPXSNHNNSPNNNXPNHNNSPQXNNSLNSSNSRNNNNSPNNNFPNSNSRNRNSHNNNNSRNNKSPSNHNNSPNNNKSPSNHNNFPNNNNSPSNNHPNNSNFPNNNSXNNNNYRKNNSPNHNKYPNNNKSPSNHNNSPSNNSPNNSNFPNNKNSPNSNSRNNNSTNNNYRNNNFPNNNSPNNNSPNNNSSPNNNNXRNNNSPGHNNTLNNNNSPNNNSPSNHHNNSPNNNFQYHTHPSNHKNLPHTNNIHNNNHAGSDVISISGR

SEQ ID NO: 108536 - protein, 303 aa, Triticum aestivum
  unsure (1)..(303): unsure at all Xaa locations
  Clone ID: PAT_TA_2954.pep
MKTLLILTILAMAITIATANMQVDPSGQVQWPQQQPFLQPHQPFSQQPQQIFPQPQQTFPHQPQQQFPQPQQPQQQFLQPRQPFPQQPQQPYPQQPQQPFPQTQQPQQPFPQSKQPQQPFPQPQQPQQSFPQQQPSLIQQSLQQQLNPCKNFLLQQCKPVSLVSSLWVNHLXHQGDCQVMRQQCCQQLAQIPQATPSVQPCHSVVHSIIMQXKNNKEQLQGGANPGCHCLNKQQVGQGILVQGQGIIQPQQPAQLEVIRSLVLQTLPTMCNVYVPPYCSTFRAPFASIVAKHWWPMKKKQELF

SEQ ID NO: 108537 - protein, 120 aa, Triticum aestivum
  Clone ID: PAT_TA_2955.pep
MAAVASSKGRVIAGSLVARVLAGKANASPRRAVHASAYDKNVDEQVRPAFVPDDVIGGAGSPDKYWGPHPTTGVFGPAAVDPKLAATLAPASAAANGGASVLDQKVWFRPLEDVEKPPVA

SEQ ID NO: 108538 - protein, 327 aa, Triticum aestivum
  Clone ID: PAT_TA_2956.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYVPPECSIMRAPFASIVAGIGGQ

SEQ ID NO: 108539 - protein, 282 aa, Triticum aestivum
  Clone ID: PAT_TA_2957.pep
LVPASPRGAAPPAPPPPPSPAPPAAPPPSPPRPAAGAASAPRPAAPGPSAPVVTSPPGPGGRVVDGRPISDMGNDDEVPVSGRKRPVRERLGNNVTDSDLYGSQQSNKRRQTESSSSQLGDDGLVRQIGRDDLRLKLMRKGLTQKSNSEAEQNGVDLREKLSRKSKKLQGYEARRGDPESRSSYDEGEIPESGSGYGLRGRVPESRASTLVSQVPSSRNADGLFKLEPSGKPYPSWTDDCLRYTSPDKLPSVRRDMTPPRSVRRGISPPRAIRRGMSPPINA

SEQ ID NO: 108540 - protein, 445 aa, Triticum aestivum
  unsure (1)..(445): unsure at all Xaa locations
  Clone ID: PAT_TA_2958.pep
MAAVGRLPGAAAALLLALLCLAGTSAATNVTYDHRALVIDGVRRVLVSGSIHYPRSTPDMWXPGLMQKAKDGGLDMVDTYVFRDVHEPVRGQYDFEGRNDLVRFVKAAADAGLYVHLRIGPYVCAEWNYGGFPLWLHFIPGIKFRTDNEPFKTEMQRFTEKVVATMKGAGLYASQGGPIILSQIENEYGNIDASYGAPGKSYIRWAAGMAVALDTGVPWVMCQQADAPAPLINTCNGFYCDQFTPSLPSSPKLWTENWSGWFLSFGGAVPYRPTEDLAFAVARFYQRGGTLQNYYMYHGGTNFGRSSGGPFISTSYDYDAPIDEYGLVRQPKWGHLRDVHKAIKMCEPALIATDPSYMSLGQNAEAHVYKTGSLCAAFLANIDNQSDKTVTFNGKAYKLPAWSVSILPDCTNVVLNTAQINSASTQMNLGFSTQASSSVEAELAS

SEQ ID NO: 108541 - protein, 69 aa, Triticum aestivum
  Clone ID: PAT_TA_2959.pep
RIWISLTTKVPVTFKPGLPFIATDFFFLQIQPLLDFCFTTYLSFTFYIDTLFFFNTSPSYATSLLSKCN

SEQ ID NO: 108542 - protein, 191 aa, Triticum aestivum
  Clone ID: PAT_TA_2960.pep
KTKLTMATLPPRSGAFSKGYKLAYAWDKEAPLTGQQNAAISALSHALAARLFPANLQDADNDSAFKEAGAVDAALVNTHQFYKWFVQLESAMKSEIDEKYRLYESTLQEHVNTCDGILRQVDDTLNLFEQVQSLHSRAAIRIQTLHDACDQLLMDKQRLVGFAEALRSHPSEIQRATSKFSSFARLAQFLL

SEQ ID NO: 108543 - protein, 147 aa, Triticum aestivum
  Clone ID: PAT_TA_2961.pep
RLHMSDKKCCVLFNEIDSTSSAQIPMTARRHVHHVESPMAPNATPSTWLVRVPVLRSGLVHSTIQSRLLVGLRASRDPAQVALQAVSHSERIEILVSTCSLRRHGVVNLRANANGGSGRALYKTITAQCRTLHMTPRALARARQFTP

SEQ ID NO: 108544 - protein, 100 aa, Triticum aestivum
  Clone ID: PAT_TA_2962.pep
NPSADTLNRLRGEVSEIHTVMVDNIEKILDRGDRISLLVDKTSTMQDSGFHFRKQSKRLRRALWMKNVKRPPGLAGVIVLLLYLIIAAFCGGLSLPSCRS

SEQ ID NO: 108545 - protein, 242 aa, Triticum aestivum
  unsure (1)..(242): unsure at all Xaa locations
  Clone ID: PAT_TA_2963.pep
LIMVFSKVEVNLXRLLEAAPRQQNQAKLVHYITTARELLEQLGAEITPEGISSISKAKLSEYSEKIEALAATLASLVPENENLVDQSREQDNSYEREREKVGSPISLSSGLRRRSTAQMEVGPSSHERKEKDTGAPIKLDAEAQAHIEKHRKLQEDLTDEMVDLARQLKESSLLMNQSVQDTEKILDSTERAVEHSLASTGRATARASEVYSLASKTTCFQWLLIFLMTCMFVMVVLLIRIT

SEQ ID NO: 108546 - protein, 119 aa, Triticum aestivum
  unsure (1)..(119): unsure at all Xaa locations
  Clone ID: PAT_TA_2964.pep
LVMVYSKVEVNLRRLLQAATRQQNQAKIVNYITNSEKVDGETWSLXTPEGISSVSKAKLSEYSEKIEALAAMLESLMPENKNLVDESREKDSSYEREKDGGPICLSSGLQRRSTAQRAF

SEQ ID NO: 108547 - protein, 62 aa, Triticum aestivum
  Clone ID: PAT_TA_2965.pep
VLFTFKPALPSHSYRLFFFTNPTFTNFCFTTYLSFTFYIDTPFFFFKHITQDSAPSLLSKCN

SEQ ID NO: 108548 - protein, 197 aa, Triticum aestivum
  unsure (1)..(197): unsure at all Xaa locations
  Clone ID: PAT_TA_2966.pep
GIIEHVASALGADTNAVRRKNLHSVESLRKFYGDAAGDAPTYSLIDIFDKLASSPEYRSRAEAVERFNGGNRWKKRGISCVPITYEVALRPTPGKVSILNDGSIAVEVGGVELGQGLYTKVKQMTAFGLRELCPDADGLLDKVRVIQADTLSLIQGSFTGGSTTSESSCEAVRQSCTVLXRRLKPSKISQGGARYQF

SEQ ID NO: 108549 - protein, 235 aa, Triticum aestivum
  Clone ID: PAT_TA_2967.pep
RLTELVIWSFEVKRFGFNQNAQKCFATLGAHPCPPGSCTHYPPKTPVTWQSPHRNLHGQALATLTGWGSPPPPRLWAPVLAKLRLVDLDNLPEECDVAWTMFLLEAAPYLEELSITVWDHKCQKESQKSHSRKTDVKWEPSDPDFKQKNLARLTIYGFQSDDNFIGYIRRVIQAAANIREVSLHDRKVCPFCFEKFPHAAVRPSSYPRTSKEVDLLRKKMTTASATASPDIHFRS

SEQ ID NO: 108550 - protein, 169 aa, Triticum aestivum
  Clone ID: PAT_TA_2968.pep
MGGGGGGGAEEEELTAQETALYDRQIRVWGVDAQKRLSKAHVLVCGVNGTTIEFCKNIVLAGVGSLSLMDDHIVTEDDLNSNFLIPHDESVYGGRSRAEVCCESLKDFNPMVRVAVAIGDPSLIDGTFIDRFDIIVLSCASLKTKVFINDNCRKRSKHIAFYSVDCRIL

SEQ ID NO: 108551 - protein, 227 aa, Triticum aestivum
  unsure (1)..(227): unsure at all Xaa locations
  Clone ID: PAT_TA_2969.pep
IPSQPPPFRPVWCPLGRCPTGLAYPVPGSGPGSRRTAGWAAARARRSGGSGRRRGPDAKPAAQASGPYNRQISLLGVDAPWTVRKVHVLRCGVNVVSIEFSKYTVLAGVGTIXLIHVKMPTSDCLKXEFLLTPDXVCFEVFQGYSPIVRCAIGNSASLRIDGTIVDRFGINVVIRASLKTKLFINANCQKRSLHIAFYSVSSKDFCCXIFVDMQNHSYLLMEPGGES

SEQ ID NO: 108552 - protein, 100 aa, Triticum aestivum
  Clone ID: PAT_TA_2970.pep
LQYDDYFNLSIKLRINHSLVVVILLSIRFNTHFRTKSRPRRLAGFPPPIGRALARGSPRLPAMPALRISGPSARLLPRSAPSVVPLSAWALASSRCLRTP

SEQ ID NO: 108553 - protein, 134 aa, Triticum aestivum
  Clone ID: PAT_TA_2971.pep
FSRILALMTIPFTMHFPKAIFCYWVTANLFSLGEGFALRKTAVRYFLNLPEVVPQPEAAQVSTFNLFEAPKPVSAVDTPTGNNGDSPTGDNGDSPTAANGSEQSNAELSDRVVFLEKKIAELERRAKARGESQE

SEQ ID NO: 108554 - protein, 211 aa, Triticum aestivum
  Clone ID: PAT_TA_2972.pep
MAAGALGLALVAALAVALAGANSEGDALSALRRSLRDPGGVLQSWDPTLVNPCTWFHVTCDRDNRVTRLDLGNLNLSGHLVPELGKLEHLQYLELYKNNIEGTIPSELGDLKNLISLDLYKNNVSGTIPPTLGKLKSLVFLRLNGNRLTGPIPRELAGISSLKVVDVSGNNLCGTIPTTGPFEHIPLSNFERNPRLEGPELQGLAVYETNC

SEQ ID NO: 108555 - protein, 89 aa, Triticum aestivum
  unsure (1)..(89): unsure at all Xaa locations
  Clone ID: PAT_TA_2973.pep
MAAGALAPGPSVAALAVALAGANSDGXRALGAAPPPAGTPAACCRAWDPTLVNPRTRFHLTCDRDNRXVTRLDFGNLEIYLVIWLPGAW

SEQ ID NO: 108556 - protein, 84 aa, Triticum aestivum
  Clone ID: PAT_TA_2974.pep
VVLLALYVYRLKKLQVRNIIFIQISSAITDIPAARGSRCLRPELGLLAGDLAITSLSAVLQGWTYGLNGTLLKSTQMSDMRKKK

SEQ ID NO: 108557 - protein, 249 aa, Triticum aestivum
  Clone ID: PAT_TA_2975.pep
MAATATKLSSGHEMPAVGLGVWRMDSAAVRGLIHSALRAGYRHFDCAADYKNEAEVGDALAEAFKTGLVKREDLFITTKLWNSDHGHVVEACKDSLKKLRLDYLDLYLIHFPVATKHTGVGTTGSALGDDGVLDIDTTITLETTWHAMEDLVSMGLVRSIGISNYDIFLTRDCLAYAKIKPAVNQIETHPYFQRDSLVKFCQKHGISVTAHTPLGGSTANTEWFGSVSCLDDPVIKSLAEKTARRRPSW

SEQ ID NO: 108558 - protein, 226 aa, Triticum aestivum
  unsure (1)..(226): unsure at all Xaa locations
  Clone ID: PAT_TA_2976.pep
MCLASGDTLRGVSRRSYDFFIPIATLHTALGLLGIADVDHNWTRALGDVGVHDIHTTVATGHTGVCNTGSGFHDDGVLDIDTTIRLETTXWHAMEDLVSMGLVRSIGXISNFDIFLTRVCLAYTNIKPXVNQIETRPYFQRHSLVKFCHMHGISCTAHTPLGGCTANTEWFGSVSCLDDPLIKSLAEKXARRRRSLLLRWGXQRNKVVRPKDLRARDGRTKNSADF

SEQ ID NO: 108559 - protein, 319 aa, Triticum aestivum
  unsure (1)..(319): unsure at all Xaa locations
  Clone ID: PAT_TA_2977.pep
MSSSAAHQKAAAAAPVEEEEAGEHGPFPIEQLQASGIAAVDVKKLKDAGLCTVESVAYSPRKDLLQXKGISEAKVDKIIEAASKLVPLGFTSATQLHAQRLEIIQVTTGSRELDKILEGGIETGSITELYGEFRSGKTQLCHTLCVTCQLPLDQGGGEGKALYIDAEGTFRPQRLLQIADRFGLNGADVLENVAYARAYNTDHQSRLLLEAASMMVETRFALMVIDSATALYRXLADEFGVAVVISNQVVAHVDGGAMFAGPQIKPIGGNIMAHASTTRLYLRKGRAEERICKVVSSPCLAEAEARFQISPEGVTDVKD

SEQ ID NO: 108560 - protein, 239 aa, Triticum aestivum
  unsure (1)..(239): unsure at all Xaa locations
  Clone ID: PAT_TA_2978.pep
PTRPKGAAETLKXNMALVLLPVCRNTITWIRSKTKIGAVVPFNDNINFHKVIAAGVAVGVALHAGAHLTCDFPLLLHASDAKYEPMKPFFGDKRPPNYWWFVKGTAGWTGIVMVVLMSIAFVLAQPWFRRNKLKDTNPLKKMTGFNAFWFTHHLFAIVYALLIVHGTSLYLTKEWYKKSTWMYIAYPVFLYSCERXXXRLFRSHXAVKIQKFAVYPGHVLALYMSKPTGFRYRSGQYIF

SEQ ID NO: 108561 - protein, 516 aa, Triticum aestivum
  unsure (1)..(516): unsure at all Xaa locations
  Clone ID: PAT_TA_2979.pep
DMVDSAPGGPCTAVEVKEIIALSASANKLSKIKEXADEYAALIMEELDPKNLGYIELESLESLLLQTPSEAVARSTITHSSKLSKALSMRLAPSKDTSPLRHYWLQFTFFVQENWKRIWVAALWLSICIALFIWKFIQYRNRAGFNILWFXHHLFAIVYALLIVHPRSLYLTRNTVXKSTWMYIAYPVFLYSCERIVRLFRRHDSVKIQKVAVYPGNVLALYMSKPPGFKYRSGQYIFINCGAVSPYEWHPFSVTSAPGDNYLSVHIRTRGDWTSRLRTVFSEACRPPTEGESGLLRADLSVGITDSNARFPKLMIDGPYGAPAQDYREYDVLLLIGLGIGATPLISIVKDVLNHIQRGESVGGTEPDGSGKAKKKPFMTKRAYSYWVTREEGSFEWFRGVMNEVAEKDKDGVIELHNHCSSVYQEGDARSALIVMLQELNHAKKGVDILSGTSVKTHFARPNWRSVFKRIAVNHENQRVGVFYCGEPVLVAQLRQLSADFTHNTNTKFDFHKENF

SEQ ID NO: 108562 - protein, 286 aa, Triticum aestivum
  Clone ID: PAT_TA_2980.pep
HASAHASAALEKDRYKIRQAFVAAPGNSLVVADYGQLELRILAHLTSCKSMLDAFKAGGDFHSRTAMNMYEHVRDAVHEKKVLLEWQPQPGQEKPPVPLLKDAFGAERRKAKMLNFSIAYGKTARRLSRDWQVSVKEARDTLKLWYRDRKEVSAWQKRQKELAREKCEVYTLLGRSRRFPNMTHAPHGQKGHVDRAAINAPVQGSAADVAMCAMLEIERNARLKELGWRLLLQVHDEVILEGPTESAEAARAIVAECMSKPFYGTNILKVDLAVDAKCGKSWYDAK

SEQ ID NO: 108563 - protein, 91 aa, Triticum aestivum
  Clone ID: PAT_TA_2981.pep
KKAYYMKEPAIVYTIPLHYKVQYPNSDKDYKHNYNNLVASSLIRDSIRQQIYFAFMLTDAMRRNIKVTPMNWNQQQKGLSKLIYFLKVQIN

SEQ ID NO: 108564 - protein, 96 aa, Triticum aestivum
  Clone ID: PAT_TA_2982.pep
QKQVDQLKNQSQQLSMVLGMTTQNLVALQAQNSVMQTQKMELESRLCALGEIICCMNSITNAARPVAAMGATTSSAYDIFGAGSTWSQPIDLYQCF

SEQ ID NO: 108565 - protein, 158 aa, Triticum aestivum
  Clone ID: PAT_TA_2983.pep
MAGGGKVYSFQEVRKHSQRKDCWLIISGKVYDVTPFMEEHPGGDEVLLACTGKDATADFEDIGHSDAAKELMPQYCIGEVDAATIPDKLAHAVLPAKGAEAAPAPRASAGQGVLAHGAAARPAPPAGGHGLRASELRHNQNRVDEKDRCRRGYRAADS

SEQ ID NO: 108566 - protein, 95 aa, Triticum aestivum
  Clone ID: PAT_TA_2984.pep
MSSGPSFTSSQGTRSSRSPEDCPALRAQMEKRRKRRKESTREWAPRFRVGKQQPLDDLSLQVDQLKTQSQQMNMVLGMPPQNLVALQAQNSVMSS

SEQ ID NO: 108567 - protein, 142 aa, Triticum aestivum
  Clone ID: PAT_TA_2985.pep
MAGGGKVYSFQEVRKHSQRKDCWLIISGKVYDVTPFMEEHPGGDEVLLACTGKDATADFEDIGHSDAAKELMPQYCIGEVDAATIPAKLAHAVLPAKGAAAAPAPRASTGQGVWLTVLQLALPLLLVAMAFALQNFAKTKTE

SEQ ID NO: 108568 - protein, 220 aa, Triticum aestivum
  unsure (1)..(220): unsure at all Xaa locations
  Clone ID: PAT_TA_2986.pep
TPLVAVRRPCQGFVLSRSAQQGIVPQNVAVALPGRVSASAGAGVEMAVIGALANSLRIPLWGLFGGAXNTLSTDITFPMVTPNVAAQLAAQFRGHGLQLLQLIISCRGLLDAQKMXDLETRAHVILIYLAKLWVVGALEVIDAARKAGIALMIGGMVETRIAMGFAGHLPAGLGCFSFIDLDTPLLLSEDPVYGGYEASGTXYLAQVARGNRGFLHLVQQ

SEQ ID NO: 108569 - protein, 129 aa, Triticum aestivum
  unsure (1)..(129): unsure at all Xaa locations
  Clone ID: PAT_TA_2987.pep
MMHDPVVGDDTEYRRENLECRNNSLRKVMITGFCSAKSLVELTVHILERAHSLERFTLDITYGYDTRTCNXRPNTQLRRMIGLCWPLNKRGLEEAHRAVETADRYIKGRVGSSVQFEVLGPCPRCHIGK

SEQ ID NO: 108570 - protein, 638 aa, Triticum aestivum
  Clone ID: PAT_TA_2988.pep
MLTLCGNVRAWFFTPCRLERPLGICASSGPLHSTVGGASTGAPVPAPSSGLSASSPRFPLSGPRSGRGHLFLASRSPTCPSLSGLPSPGLQRPAPVISASRFPSRCPPASWAPASPGRSGICHCAAMPGGRHAVCSCSSFAIGGSAQGLSSSMANVGNRNSAPGLTASSVLGNLGPRITNSAGNIVGGSSIGRSISSAGMSMPGIASRINSSGNSGSGALNIPSNRLSSMHQASPQFMNILGSSYPAPGGTLSQNQVQAGNNSFSSSGMLHDGNSGDNSPFDINDFPQLTGRPNSAGGGQGQYGSLRKQGVSVNAIVQQNQEFSIQNEDFPALPGYKGNSSDYGMDLHHKDHLHENANIMQGQHFPMGRSSGFNLGGSYPARQQQQQSTTSVQNGLDNIGLRPINSPSPSSNSGSYEQLIQQYHQPQTQNSLRSQTSSGQQSSKDQSQKSAQGKETVPDPYSLLGLLNLIKSKEPGPTALALGLDLTTLGLNLNSPDCLWKTFGSPWSNEPAKGEPDYQIPACYSAEQPPPLQPFNFPKFHPLTLFYIFYSMPKDVAQLYAANELYNKGWFYHREYRVWLTRASNVAPLVKTPLYERGSYICFDPNLWDTIQKDNFVLQYESVEKRPVLPSASQNVRL

SEQ ID NO: 108571 - protein, 173 aa, Triticum aestivum
  Clone ID: PAT_TA_2989.pep
LSLGLKGLAVSRGRKIYMLGGWGGGCKMALMVNGELVVWRKCSQAKVTAQWFSLFPQAKPSILTFGLLLAPQDGEPTSALPPSILLNGLPRGEKQGVFLPNCGSFTMGLLVRTGGEPQKKPAWPLESVSTSGSFLLRMRSRISEAESVLYAGSVPKTGPGGLKHQGYLAEDEI

SEQ ID NO: 108572 - protein, 118 aa, Triticum aestivum
  Clone ID: PAT_TA_2990.pep
QCLEHKRVCFYIYFPFRMVEIHILFKSTSCTWSNASETVVCYFTFYLPGGSDSSVLTKEACDIIFISTVQIKPKKCTCLPFVKNHYYYICSTLYRIICILCLPLNCCFMLNHYYYIMI

SEQ ID NO: 108573 - protein, 169 aa, Triticum aestivum
  Clone ID: PAT_TA_2991.pep
RRPLRMAFPNIADLESRSDVRADHEQVGHYWLQLGRRSKARLHMVLALLSYMVFGLLPPVLYGLSFRESNDRENKMMAVAGASLACIALLALGKAHVQTAPRAYFKTLMYYLMIAVSSSGLSYVAGVLITRLLVHYGIIEQGGSAPAPPGLSSPFAYAAGAESSAWASF

SEQ ID NO: 108574 - protein, 160 aa, Triticum aestivum
  Clone ID: PAT_TA_2992.pep
SAHASGRISFKLYDWNPAEFPRRLRNQIFEWLSIMPVELEGYIRPGCTILTVFIAMPQHMWDKLSEDTANLVRNLVNAPSSLLLGKGAFFVHANNTIFQVLKDGATLMSTRLEVQAPRIHCVHPTWFEAGKPIELLLCGSSLDQPKFRSLLSFDGEYLKH

SEQ ID NO: 108575 - protein, 264 aa, Triticum aestivum
  Clone ID: PAT_TA_2993.pep
MDLLDAGHRHSSELPAAGADMEGASVLPLSGAAYQPYVSELLSFSIERLHKEPELLRVDGERVRRQMQEVAVENYAAFIAASEALSFVRAQLEGFDKHLEALVEEIPNLTSGCTEFVESAHQILEERKLNQTLLANHSTLLDLLEIPQLMDTCIRNGNYDEALDLEAFVSKISKLHPDLPVIQGLAAEVKKTIQSLISQLLQKLRSNIQLPECLRIVAHLRRIGVFSESELRLQFLRCREAWLSGILDDLDQRNVYDYLKGMVS

SEQ ID NO: 108576 - protein, 116 aa, Triticum aestivum
  unsure (1)..(116): unsure at all Xaa locations
  Clone ID: PAT_TA_2994.pep
MDAGPSSSPLRIVIVPWLALGHLLPCLELAERLASRGHRVSYVSTPRNLARLPPPAPRVDLVALPLPRVDGLPDGAESTNDVPAXKRELHWKAFDGLAAPFAEYLAAACADXGTTP

SEQ ID NO: 108577 - protein, 317 aa, Triticum aestivum
  Clone ID: PAT_TA_2995.pep
PGGRFPWGMAPGGGANVCLRRVDAAEVYDTIARRGVTHLCGAPVVLNMLANAPEGVRRPLPGKVQILTEGAPPPAAVLGRTEAIGFDVSHGYGLTERAGLVLMCAWKGEWNKLPASERARPARIQKYVLREPRQGDGVRPARASARCSIIAVEIQGCVVLLGLICSAMADRIGMSAPHISIQQACLLQLQDSIMRRHDACLPAGYVRNESTLAIDSLLYGHPAVNEAAVVARPDEFWGETPCAFVSLKEGASGAVTAAEVIAWSRERMPGYMVPKTVVFRAELPKTSTGKIQKYVLRNLAKEMGPTRRGVSTTTSKM

SEQ ID NO: 108578 - protein, 178 aa, Triticum aestivum
  Clone ID: PAT_TA_2996.pep
RKEEKVINVRYSENKQENLDSSKNIGLGVETIGSNAITKNKALPSVDLVPSISQHQETSQGTDSDDETIGSLLSRGKKKRLSTSDITGNKQEDLDPSKNTDLGVESIGSNIIPKDKELASVDLPSSMSQHQEASQGTDSDDETIGSLLRGKNRRVATSRCYREQTRTPRFFEEHCSGQ

SEQ ID NO: 108579 - protein, 338 aa, Triticum aestivum
  Clone ID: PAT_TA_2997.pep
MSWCTCESDPGVFTELIQEMQVKGVQVEELYSLDVDSLSQLQPVYGLIFLFKWMPGGNDERPVVSDPNPNLFFARQVITNACATQAILSILMNRPEIDIGPELSNLKEFTGAFAPDMKGLAINNSDSIRAAHNSFARPEPFVSDEQKAATKDDEVYHFISYIPFEGVLYELDGLKEGPISLGQYPGGPEDLGWLQMVQPVIQERIERYSQSEIRFNLMAIIKNRKDVYTAELKELEKKREQILQELSNEATAAAEKEPLNGALAEVALAVEAVGEKIAMEEEKFRKWKTENVRRKHNYIPFLFNLLKALAEKKQLTPLVEKARQQKAPATAGASASTS

SEQ ID NO: 108580 - protein, 108 aa, Triticum aestivum
  Clone ID: PAT_TA_2998.pep
FTHEQARVGAAAPPACPPELRPPLFSIFSPHLYSPRPNCGGWHARRRSILPSSPSFPSPSPSSLPVPPPPLLLQAQPWWSTRGCERERAASVDKRCVEDLKCCRRWRR

SEQ ID NO: 108581 - protein, 237 aa, Triticum aestivum
  unsure (1)..(237): unsure at all Xaa locations
  Clone ID: PAT_TA_2999.pep
AFFKTGTGKATLAIGDGANDVGMIQEADIGVGTSGAEGMQAVMASDVSIAQFRFLERLLLVHGHWCYSRISSMVCYFLYKNITFGVTLFLYESFSTFSGQTLYNDWSMSLYNVLFTSLPVIAMGVFDQDVSARFCLKYPMLYQEGPQNLLFRWSRLLGWMLHGVGSAVIIFFLTIASLKHQAFRXDGEVIDLSILGATAYTCVVWAVNMXMXXXSTTXTXIHHICIWEWHLLRGLFP

SEQ ID NO: 108582 - protein, 109 aa, Triticum aestivum
  unsure (1)..(109): unsure at all Xaa locations
  Clone ID: PAT_TA_3000.pep
PLXELXRPPHLVSAFAFFDKDGSXFITIDELSQACEKFGLSDVHLEDMIKDVDQNNDGQIDYSEFAAMMRKGNAGGSSGTSGAVGAGRRTMRNSLHVNLGEILRPGGTT

SEQ ID NO: 108583 - protein, 306 aa, Triticum aestivum
  Clone ID: PAT_TA_3001.pep
NSARGAKEDLRYPRSLLQNVIWTCLNKFVEPVLNCWPINKLRDTALKNLMKHIHYEDESTKYIGVCPINKALDMICCWIEDPNSDALKLHLPRIYDYLWLAEDGMKAQVYDGCQSWEPALIVQAYCSTDLVNELGPTLRKAHEFIKSSQVLENHPNSEAYYRHRSKGSWTLSTADNGWSVSDCTAEALKALLLLSKISPNLVGDPIKGERLHDAVDCLLSFMNKDGTFSTYECKRTTSLLEVLNPSESFLNIIVDYPSVECTSSVLEALIMFQELYPGYRNEEIGICIKNASMFIENRQRKDGSWY

SEQ ID NO: 108584 - protein, 274 aa, Triticum aestivum
  Clone ID: PAT_TA_3002.pep
GQWPNIWEGLNRGGGARGEGDGIATATIIVLGDTCTRGCRFCAVKTSNKPLPPDPMEPLNTALAVASWGVDYVVLTSVDRDDLPDGGSGHFAQTVRALKELKPGILVECLTSDFRGDLEAVSSLADSNLDVFAHDIETVRSLQRIVRDPRAGYEQSLAVLKHAKICKEGMITKSSIMLGLGETDEEVKQAMIDLRAVGVDILTLGQYLQPTEKYLTVREYVTPEKFQFWKEYGESLGFCYVASGPLVRSSYRAGELFVENLVRNKKIKPASGSS

SEQ ID NO: 108585 - protein, 192 aa, Triticum aestivum
  Clone ID: PAT_TA_3003.pep
AVNGKRQRLEESANGADSSDRAQGLRARARAIRRHEETYERVESSKGEHELLMERNRLDAARELEDQRVQFFLKMQMEISKANNGAPLAVPLAAAAMVGNSASTAEDGDSPATADGNGPRRASMATDDMASSNHHVRYRVKDDRHHHASQRPSYQYNQNNVGAADTGGIGSGSDSGNKEEEEEMEDEEEESQ

SEQ ID NO: 108586 - protein, 447 aa, Triticum aestivum
  Clone ID: PAT_TA_3004.pep
MSTRSRSVQGSVGGGGSTAGGSAVPLAVLLRREVVSERTAAERPELQHGLFSQAKKGEDFVFLKPDCERLPGFPSSSFSAFGLFDGHNGNGAAIYTKENLLNNILGAVPADLNREDWLAALPRAMVAAFVKTDKDFQTVARSSGTTVTFVIIDGLVVTVASVGDSRCVLEAEGSIYQLSSDHRFDASKVEVDRVTEAGGDVGRLNVVGGAEIGPLRCWPGGLCLSRTIGDQDVGEFIVPVPLVKQVKLSTAGGRLIISSDGVWDALTAEQALNCSRGLSPEAAAEQIVKDAVHSKGLRDDTTCIVVDLVPEKGNPAMSAPKKQPGMGVFKNMFRKKTSSDSSSHADREYMDPDIVEEIFEDECALLSRRLDSEYPVRNMFKLFICAICQVELKPNQGISVHEDSSQPGNLRRWDGPFLCQSCQEKKEAMEGKRRSRDSSSRNSGSSE

SEQ ID NO: 108587 - protein, 131 aa, Triticum aestivum
  Clone ID: PAT_TA_3005.pep
NRGVACSPEQARKIAQPDHQRPLTGFFDASTSSCISSLICDGHLPAVPRLPGHRARPQQGVWMVVRQVLLYQRCCYVALPSTIQIISTRPNLPLPPRPSAGSHTYAGRRWFNILVSGSACCNNRQILIVLY

SEQ ID NO: 108588 - protein, 129 aa, Triticum aestivum
  Clone ID: PAT_TA_3006.pep
MASEKDAALAAVPNDNPTIFDKIIKKEIPSTVVYEDEKVLAFRDINPQAPTHIVIIPKVKDGLTGLSKAEERHVEILGCLLYAAKVIAKQEGLEDGYRIVINDGPSGCQSVYHIHVHLLGGRQMNWPPG

SEQ ID NO: 108589 - protein, 197 aa, Triticum aestivum
  unsure (1)..(197): unsure at all Xaa locations
  Clone ID: PAT_TA_3007.pep
MEIGSLAPGESPHAVMIPXPAHGHVTPMLKLANLLQRHGXHVTFVNNEFNHRRLLRSQSADSPPGLPGFRFARHRPXGLPPSDREATQDFPALCYSTTTTCLPSFXELLRKLREEAGASGGALPPVTCVVXSAALAVAREPRGRSASLGPPSAPPSPGVCHYKDLLNRGLFPLKGEAQLSNGYLDTIIDWIPSMPKD

SEQ ID NO: 108590 - protein, 97 aa, Triticum aestivum
  unsure (1)..(97): unsure at all Xaa locations
  Clone ID: PAT_TA_3008.pep
ILFSFQHRNQSQHWNWEDMRSIFRMRSTCRADRATRWSFPASTXRLLLGHVVLRVRLHLIGMHLTVCQIEGFYYSEKRLQMFPQLQLCLGISSLFGI

SEQ ID NO: 108591 - protein, 185 aa, Triticum aestivum
  Clone ID: PAT_TA_3009.pep
RYYSPAEWTKQGTKHVKIACRGRDAGRVGEAVNTFVYEVLAFHERQKPSRNPKYVLVHCTHGHNRTGFMIVHYLMRTQLSSVTEALNIFAQRRPPGIYKTDYIQALYTFYHEIPESITCPPTPEWKRPSDLDLNGEAKQDDDDDNGEPAPSPDPVDDKAITNDDVLKGCCPFTKFLAVSSCLILP

SEQ ID NO: 108592 - protein, 162 aa, Triticum aestivum
  Clone ID: PAT_TA_3010.pep
RFHQTRKPSAPARKVIRRRRRNRRRAKTTSFTSQSGVANSFGFRSRRLSTKRYRNMLWNSSVLRTKIRTNSAFTQSQASAASSAQYTVGIYDAFGNTASPFWTAGGGAFAPDFGSGVPTITGNIVVRGGVLGIRVTYTSADTQPQKVRITLIRSGSRTGVAP

SEQ ID NO: 108593 - protein, 252 aa, Triticum aestivum
  unsure (1)..(252): unsure at all Xaa locations
  Clone ID: PAT_TA_3011.pep
ARGARARGRSGGRSGRRRRVRGDGDGAAPPGRQRLRQRGSGGPGREKPWESNIGKSTNILWYDSPIGQPERQKLLGQKGCVIWMTGLSGSWLSTESCALIQELXTYVTNGVNFRVGLNRDLSFKTEDRTENIRRVGXEVAKLFADAGTICIASLISPYRRDRDACRALLPDSRFIEVFMDLPLELCEARDPKGLYKLARTGKIKGFTGVDDPYESPVNSEIVIKMEGGECPSPKAMAQQVLSYLEKNGYLQA

SEQ ID NO: 108594 - protein, 115 aa, Triticum aestivum
  Clone ID: PAT_TA_3012.pep
GLCEAAIMAKMGAEQSKPAESMKSSGNEGHDVPTIETAVETRPVCSLCQDSDSKSRLCCLIRLQAAMETMMAETVEDGQTPSSIAELASKVLSHVSSTSSLESPAVQVLEDKLEA

SEQ ID NO: 108595 - protein, 259 aa, Triticum aestivum
  unsure (1)..(259): unsure at all Xaa locations
  Clone ID: PAT_TA_3013.pep
DSMLTLLVSLMHKEKNDSTFSGCNIPSLVETLLKRFAKLSKXACTAVRQLAPQLLPSIPDHASAKLNLGSPXFDGKTPIAEAAIMAXKMGAEQSKPAESMKSSGNEWHDVPTFEPDAPKSTAVETRPVCSLCQDSDSKSPLCCLIRLQSAMETMMAETVEDGQTPRSVAEFASKVLSHVSSTSSLKLPAVQVLEDKLEAERRGASALREEIGALKKQAERVDAVIAKTQQEMKEVRKKQAETDQILQLLLRRSQGNPTS

SEQ ID NO: 108596 - protein, 228 aa, Triticum aestivum
  Clone ID: PAT_TA_3014.pep
MQDCVLPGELAVSCPTRPRQSSLFPRCPILQYLCRHLHHRAPLPARVNHPAILPGAAICEYVGALPRTGEKRSGSDMHMPSLHVENNSEAPPAPEYCIDAGSVGSFARFINHGCNPNLFAQCVLTNHHDIKLEKVMLFAADTVLPLQLAPFVCNLDACCTPNYSASLEFARVSGRGRGGPPSWATARSSSFLPILNSSGRPPSVGPQSASSGQGGSGPLWRLYVVLGV

SEQ ID NO: 108597 - protein, 345 aa, Triticum aestivum
  unsure (1)..(345): unsure at all Xaa locations
  Clone ID: PAT_TA_3015.pep
RTRGRTRGLETRSNAKLSRISSMESFKNMDSRYSKKNKKFEFNSNRLSPVPNGAARSFNPKCGSSKKYLSTSIPGSRWISRNTSPVSQRSSLHSFIKPTPTLNRVISTDXLNIVREGSLVSQGFPLTWLPFKLAHDTRKSQYLELELERTTKQLKEAIAIAGEETAKCKAAKEVIKSLTVQLKGMAERLPGGVAKNGKLPPLPGIPIPSDISAIVTESLGSPGSSGEQEQISDDRNGLLVPNGSSSVRNKAGHPEMTNNGSVPPDAESNHEAEWVEQDEPGVYITLTALPGGARDLKRVRFSRKRFSEKQAEQWWQGNRARVYQQYNVHMVDKSIAAMDREIATH

SEQ ID NO: 108598 - protein, 226 aa, Triticum aestivum
  Clone ID: PAT_TA_3016.pep
MARAPVLPALLCLAVLALAGGADARRKMVGVYELKRGDFSVKMTNWGATIMSVLVPDSKGNLADVVLGMDTLAEYVNDTSYFGPLNGRVAQRMARGRFVLDGKVYHTYINDGKNAIHGGKRGFSKVIWTVKEYVAGGDSPYITMYYRSFDGEQGFPGDLDVYATYQLTGPYELSIRTNATGLNKATPVNFLQHVYLNLGGEGSGYILGHTLQLFVFRYTPLDGRSS

SEQ ID NO: 108599 - protein, 274 aa, Triticum aestivum
  Clone ID: PAT_TA_3017.pep
RKEGQRAIHGGNIRFSKVKRTDKKDRRNGRLRGKRGVSTVIWTEKEDVAGGDSPYITMYYRSFDGEQGFPGDLDVYATYQLTGPYELSIRTNATALNKATPVNFLQHVYLNLGGEGSGDILGHTLQLSASRYTPLDVEMLPSSGRVDPVAGTSYDFRTPTPIGARIRQVMGGKVYGYDINYVIDGEGMRKVAAVRDGKSGRALELWANQPAMQLYTGNFLNHTKGKGGKLYEQYGGFCLETQAYPDAVNHPEFPSVTVRPGQVYKHDMRFTFSF

SEQ ID NO: 108600 - protein, 78 aa, Triticum aestivum
  Clone ID: PAT_TA_3018.pep
DFGGINMLHKGSVEQAGFAVLKAPDIPSILVETAFISNPDEERRLNDDSYRDEMADAIFRGIKRYFAANPPLAKNRMA

SEQ ID NO: 108601 - protein, 103 aa, Triticum aestivum; identical to SEQ ID NO: 107316
  Clone ID: PAT_TA_3019.pep

SEQ ID NO: 108602 - protein, 103 aa, Triticum aestivum; identical to SEQ ID NO: 107316
  Clone ID: PAT_TA_3020.pep

SEQ ID NO: 108603 - protein, 103 aa, Triticum aestivum
  Clone ID: PAT_TA_3021.pep
MSGRGKGGKGLGKGGAKRHRTGLRDNIQGITKPAIRRLARRGGVKRISGLIYEETRGVLKIFLENVIRDAVTYTEHARRKTVTAMDVVYALKRQGRTLYGFGG

SEQ ID NO: 108604 - protein, 298 aa, Triticum aestivum
  unsure (1)..(298): unsure at all Xaa locations
  Clone ID: PAT_TA_3022.pep
EEGQKRGLKLKXKIGNPHLRRLVSGAIAGAVSRTCVAPLETIRTHLMVGSNGDSMTEVFQTIMKTEGWTGLFRGNFVNVIRVAPSKAIELFAFDTAKKFLTPKADESSKTPFPPSLVAGALAGVSSTLCTYPLELIKTRLTIEKDVYDNFLHCLVKIVREEGPSELYRGLTPSLIGVVPYAATNYYAYDTLRKLYRKTFKQEEISNLATLLIGSAAGAISSTATFPLEVARKQMQAGAVGGRQVYKNVFHALYCIMEKEGIGGLYKGLGPSCIKLMPAAGISFMCYEACKKILVEAEE

SEQ ID NO: 108605 - protein, 412 aa, Triticum aestivum
  unsure (1)..(412): unsure at all Xaa locations
  Clone ID: PAT_TA_3023.pep
PRRRRSDGPPFPPSPRPPHPSPPAPAVAPASEEAQSAAAPTPPPPAALALGFAGLCTEGGDHAGPNATRRTLLPPAAVGARRPPAARSVPQPPLDPASKPGSLRRGGSLSCLGPSITVPASHDQPSXGLQLCKRRIELTCYQGARANGEPVPMGTAGPLALARDKLDDGSGEPFFVLNSDVISEYPFAELIEFHKSHGGEATIMVTKVDQPSEYGVVETGKVARYVGEXPKPSWGNKINAGIYLLSQSVLDRIRRPPXLYAMVLPGFWMDIGQPRDYITGLRLYLESLRKRAPARLAAGAHVLGNVLVHETAXFGEGCLIGPDVAVGPGCVVEAGVRLSRCTVMRGARVKKHACISGSIVGWHSTVGKWARVENMTILGEDVHVCDEVYSNGGVVLPHKEIKSSILKPEIVM

SEQ ID NO: 108606 - protein, 214 aa, Triticum aestivum
  Clone ID: PAT_TA_3024.pep
VWPALHSLLSRTEYQHFSGTRVALDVAETPSNLFEFYAWDYRVLRTFALDETTGDPIPEKLVKALNASRNMFPATDLQRQVFYSIMDLTLFGEHTSKPVDTISAVADLKRKHTSWNYVEGTHWHTRFSHLINYGAGYYSYLYARCFATTIWQEVCQGDPLSRSTGSAIRDKFLRHGGAKDPSVLLKDFAGDSVIKNSGGGIIPDISSLCKEVGL

SEQ ID NO: 108607 - protein, 414 aa, Triticum aestivum
  unsure (1)..(414): unsure at all Xaa locations
  Clone ID: PAT_TA_3025.pep
AGEGPRNGAPHEQVPPSRRHLTPKLKERTPLAWPSCAGGWCRFHERDHESVPQVGDDNSGDPEERGPLDYHMSLEDLCRYANRADGYEGHVGTGMYADPSAGQQQSCPSEAHGXRTHAYRALRAEEFNDTGNATSAYSGQQLACPSDYQNLYSGLQQACPSDEQNLYLPTNGLPFPQQLDDNAPFYEASXDHKWENGKDDYVNVDDISLFEDDDIMALLNASDNDFSLDLLGPVDGSNSXQLPAASNFDQKDEAKAQYGASSSVSRENLYPDTMVPDVPMDDNAGKRYFTNMLGSYPAPPAMASEFPPTTGKSIAALSGPSQIRVTAGIVQLGDHSFTGNEGSWPLQKNGVFNLLLSFTVESNVSTKSISFDDEPATTRVSAVPMVLRGGLYLFFVSAMILMLSFKVGSCIYSR

SEQ ID NO: 108608 - protein, 192 aa, Triticum aestivum
  Clone ID: PAT_TA_3026.pep
MQHAAGSIDKFLVFHIAGHQPRTPFASLAAAAHGDRAGPEDGRQPPERLLPQPLLLLRRRRGGGSGFLVGAEHVPHHLHVVVAARLHVLVKVQDPALALADAGAGGGDGEPAGAAHGRDHPCPPPRHDARPHLPVPPLSPPRRRLPRLCFAGAGEGLRRTPGTAAQPRRGCHPPAQPREEPASALPLQQLGL

SEQ ID NO: 108609 - protein, 111 aa, Triticum aestivum
  Clone ID: PAT_TA_3027.pep
NNRGTWRVQGSLAVSRGIGDAHLKQWVVADPDTRTLLVDPQCEFLVLASDGLWDKVDNQEAIDIARPLCIGNDKASRMAACRRLVETAGSRGSTDDISVLIIQLQKFSGSS

SEQ ID NO: 108610 - protein, 222 aa, Triticum aestivum
  unsure (1)..(222): unsure at all Xaa locations
  Clone ID: PAT_TA_3028.pep
EQPSNRLQTKRKQTCVNWHRPRACFTRARGAHSSCARAPARPPRPRPRPPRRPPRAPLPPAPAAPPPDGPPRPGRPPGPRSPAPPYDTXPPAPTPPIPQPTPRPPPASLGPAPARPPLPRPPRPTLTVAPIRRPRVPRVPPWPLPLLPLRPGLLPLPVPXPWGFPPPLWEGPAVAPWPRPTPWFLSRKALRFERDVSGDYFVVKELFLFLFVLSACLACFTG

SEQ ID NO: 108611 - protein, 254 aa, Triticum aestivum
  Clone ID: PAT_TA_3029.pep
AREVLLVRCLGAARHDSVVGAGWRRRGPAQLAGDGVSLRSAQAGGGLVLLTAEALVPGQICVAWRYVNISMCRTHLPRVELVGDVAGRRVEKWPQRLAAVPPRIANGEIKGMSIQAYKHDCSVWRRRVELYGTYLKDLSHRSYRNVMDMNAGFGSFAAAMLKYPVWVMNVVPANITDNNTLGIIYERGLIGTYMDWCEAFSTYPRTYDLIHANGVFSLYIDKGGTLDILVEMDRILRPGGAAVIRDAADVVLKV

SEQ ID NO: 108612 - protein, 213 aa, Triticum aestivum
  Clone ID: PAT_TA_3030.pep
CGGPDGVWQRRCGSIWWGWRQREAVLGSHGQVGGGAAMARSRWSLASSELSVIPVRRGERRCFPGDAGLGFLRGEAGLIVARSFLGVGDGRCGQSWTWPEVLVGCGPSCRLGVDVWPRFPCRVVGRWSSAMQLLRQVLRWRRCEASWQCYQSHGGVAMGEARMKILHGFCRAGGDGICGCHSPPWRHRRACSPHPSRSRCWWMSPGESLDSMF

SEQ ID NO: 108613 - protein, 239 aa, Triticum aestivum
  Clone ID: PAT_TA_3031.pep
VVREGVPTAASVQEILFFQAQTMEMMYGVIARELKAMNIEDAHLQDYLNFYCLGNREEPSTDGSPESDKSTDKSAAGLARKHRRFMIYVHAKGMIVDDEYVILGSANINQRSLAGSRDTEIAMGAYQPHHAWSSKKGHPHGQVYGYRSSLWAEHLGMVDDHFKEPSSLDCVRLVNQIAEENWERFASEEMQTLQGHLLRYPVKVEPDGKIVPLPDQECFPDVGGKICGAPTSLPDSLTM

SEQ ID NO: 108614 - protein, 523 aa, Triticum aestivum
  unsure (1)..(523): unsure at all Xaa locations
  Clone ID: PAT_TA_3032.pep
MVVLAASIISKSGKALVSRQYVDMSRIRIEGLLAAFPKLVGTGKQHTYLETESVRYVYQPIEGLYLLLITNKQSNILEDLDTLRLLSKLVPEYSSLDEDSICKTAFELIFAFDEAISLGNKENVTVQQVKQYCEMESHEEKAHKLMMQSKINETKDVMKKRASELDKIRMEKGKLDKGGYSXSISGPRVIEKTFSDMNISGTGFGSGSGLSGIGADMDSFASKPKGRPSAAATAPGKGFGMKLGKSQKTNQFLESLKAEGEVILEDAQPSSVSSRASPLIPSDPITVTIEEKLNVIVKRDGGVNNFDVQGTLALQVLNDADGFIQLQIENKDVPGLSFKTHPNIHKELFNSQQIVGAKDPNRPFPSGQNETPLVKWRIQGMNESNLPLSVNCWPSVSGNETYVNIEYEASEMFDLNNVVISIPLPALREAPTVKQIDGEWKYDPRNSVLEWSIILIDQSNRSGSMEFIVPPADPSTFFPISIGFAASNTFSDLKVTGIHPLKEGNPPKYSQRVRLVAANYQIV

SEQ ID NO: 108615 - protein, 425 aa, Triticum aestivum
  unsure (1)..(425): unsure at all Xaa locations
  Clone ID: PAT_TA_3033.pep
MRRTRGICQRREGLHARNVAESLGLPRRAKTGSQSQHWCSWEWEPKPTVSDEKSGTETSKAPAVLFLPXGFGVGTFHFEKQLMDLGTGDKVWTVDFLGRGMSFPCEDPAPKAMAGEEDEESYWGFGQDSQPWADELVYSVDLWRDQVQHFIEEVIGEPVYIVGNSLGGFVALYLAASSPHLVKGVTLLNATPFWGFLPNPARSPRLSKIFPWAGTFPLPSVVRKLTETVWQKISDPRSIQKILRQVYADHSTNVDKVFSRIIETTEHPAAAASFASIMFAPMGQISFQEALSRCQRQDIPISLMYGKEDPWVTPYWGIRVKQQVPEAPYYEISPAGHCPHDEVPEVINYLLRGWLKNVESEGSVDLPFLEDSSFQEHGVSKELEFVRTGSKKSVSVRLFEPGRGRGSQLSSFLKRHASNIRVVSR

SEQ ID NO: 108616 - protein, 104 aa, Triticum aestivum
  Clone ID: PAT_TA_3034.pep
QNKDGNDITNISPNHTRTNTGTHQNTTPTATTRRRYIERPRYTTHADMQLAAACPFPYSLHQNKLKMDDQDRRRRRREAPSRWRCRTWSTWRRTWRGRTWCIPC

SEQ ID NO: 108617 - protein, 189 aa, Triticum aestivum
  unsure (1)..(189): unsure at all Xaa locations
  Clone ID: PAT_TA_3035.pep
MRLAAACPFPYSLHQNNLMTIKTAAVELRDPAVRRRRRRGPPSRWRCRTWSTWRPTWRGRRGCSPCRPASRFLWHSSLVRQLLADFSPSLLVLLLPSLPCSPLSSFACSPLPDGTVPGSPPCWIATPPPXSSPPTASSPRPRCPSSPPSGRTPAARRAPPPAGPWQPXGGPPACRPAAAPPMAGSPPSP

SEQ ID NO: 108618 - protein, 162 aa, Triticum aestivum
  Clone ID: PAT_TA_3036.pep
MRLAAACPFPYSLHQNKLKMDDQDRRRRRRGAPSRWRCRTWSTWRRTWRGRTWCSPCRRAGASCGTPPWSGSSWPTSPPPCWCCCSPPCRRARRSPPSRARRSPTTPTAPCPGRRPAGSPRRRRASSPPTASSPPPRCPSSPPSGRTPAARRAPPPAGPWPP

SEQ ID NO: 108619 - protein, 390 aa, Triticum aestivum
  unsure (1)..(390): unsure at all Xaa locations
  Clone ID: PAT_TA_3037.pep
RLKILLQVQNPHSIKYNGTVQGLKYIWRTEGLRGLFKGNGTNCARIVPNSAVKFFSYEQASRGILYLYRQQTGDENAQLSPILRLGAGATAGIIAMSATYPMDMVRGRITVQTEKSPYQYRGMFHALGTVYREEGFRALYRGWLPSVIXXVVPYVGLNFAVYESLKDWLLQSNXFDLAKDNELHVVTRLGWGAVAGTIGQTVAYPLXVVRKRMQMVGWSHAASIXTGESXEALQYNGMTDAFRKTVRHEGFGALDKGLVPARPRTRPPPPPPPSPPRTRPLPPRAAAAAKTPGRHLPPRRGEGRSWPPRAIREGERGGGRGRGDGIGGRGGEEQGRHGRQHHGQPARGGEARARARQGARPPGPDPLQVPLRRRRRRGPIEDLLLLRLSA

SEQ ID NO: 108620 - protein, 156 aa, Triticum aestivum
  unsure (1)..(156): unsure at all Xaa locations
  Clone ID: PAT_TA_3038.pep
MRRWCCSSAGGLARRFLSSPIVVHARPPVPSXPLPPRPLPHPRASPHHGLAVPLGGSRCDRPASXMAMQVRHYAIKGRSRAPTTPTISKVKKYKMKAPSSMKFRFRTMKDGQIRRWRAGKRHNAHQKSKEAKRRLRKPALVHLAYAKVIKKLNFCG

SEQ ID NO: 108621 - protein, 434 aa, Triticum aestivum
  Clone ID: PAT_TA_3039.pep
GGGTTRSSSPTPSNPLLRVASVVSASRPLDTEEDPLIVPDTSEATNVGTGSVVPLLPSPPRAHEEAPLLVLVAQAPAEADDPVTVAVVPAHPLPSQVVTPGAGLFRDRHRPIVKQVEYYFSDENLPTDEFMLKFVMKNKEGLGNVPLGVPALCPRVRKLVQDHSTIEAALRTSSKLVVSSNGKRVRRLHPLPCNELKDVKKRTVVVENLPLDFSLESIQEKFGSVGKIMKITIHDPHAVGESAASKKPDIMLSNKVHAIVEYEAVEAAEKAVATLNDERNWRTGMRVILLAKRSVVGSGKNIQSSKENHGTCLRKNNEGQFSKEVQQSVSEKNGGADSGEVASDKENVNSDVNHEEVRQHQRANASGGRKGRYRSQGKGLSGQGHGSSPTIPGSDSANKPISGPRMPDGTRGFTMGRGRSLPLPKAEKAQKTEE

SEQ ID NO: 108622 - protein, 311 aa, Triticum aestivum
  Clone ID: PAT_TA_3040.pep
MARNEEKAQSMLNRFITMKQEEKRKPRERRPYLASECRDLADADRWRGEILREIGVKVAEIQNEGLGEHRLRDLNDEINKLLRERSHWERRILELGGRDYSRSSNAALMTDLDGNIVAIPNPSGRGPGYRYFGAAKKLPGVRELFDKPPEVRKRRTRYEIHKRINAGYYGYYDDEDGVLEPLEAAAEKRMRDEVVTEWHRVERVRREAMKNVVSGEVAAAGGRGGEAAREVLFEEVEEEVEEERRLEEERMEREKGEEAGREFVAHVPLPDEKEIERMVLEKKKKELLSKYTSDTLQGEQKEAKEMLNVQR

SEQ ID NO: 108623 - protein, 94 aa, Triticum aestivum
  Clone ID: PAT_TA_3041.pep
HAPGPERFLAGGEAADVSVLGADGRLVPFGSGRRSCPGKSLAMTTVTAWMATLLHEFHWAPAASSGVGLSEVLRLSCEMAAPPQVRVRPRRCSA

SEQ ID NO: 108624 - protein, 139 aa, Triticum aestivum
  Clone ID: PAT_TA_3042.pep
TPATCPTSGGRGASGDGKKAESKAVTISGFEDLPANDEQALIKALAHQPVSVAIEASGRHFQFHSGGVFDGPCGAQLDHGVAAVGYGSDKGKGHDYIIVRNSWGADWGEKGYIRMKRGTSNGEGLCGINKMASYPTKDK

SEQ ID NO: 108625 - protein, 100 aa, Triticum aestivum
  unsure (1)..(100): unsure at all Xaa locations
  Clone ID: PAT_TA_3043.pep
SLGTGPGPHGLHHLVYEILDNVVGEAQAGYATEINVVFHDDNSVSVTDNGRGIPTDIHPXXKKSCVETVLTLMHAGGKTYERLPECSMLLQILWKKNWYV

SEQ ID NO: 108626 - protein, 49 aa, Triticum aestivum
  Clone ID: PAT_TA_3044.pep
FLWSSGRGHLLVELLFPWARTSPVSHCTMTNRGRRLAHRRRVSRAANCK

SEQ ID NO: 108627 - protein, 35 aa, Triticum aestivum
  unsure (1)..(35): unsure at all Xaa locations
  Clone ID: PAT_TA_3045.pep
MREREREREREREREREREREREREXRXEXXXSFX

SEQ ID NO: 108628 - protein, 181 aa, Triticum aestivum
  Clone ID: PAT_TA_3046.pep
APAAGPTHLAHPHRPPRSHCCPPYRPAPRPAPPPLPSLRTGLPTPPGRRPATSHRRTPHGADAEWASDALTPRVSATVPGALPTPSTCSSGARCLGTSVLLPEVGFPVALALVPPPPGVRPPRPPPRALIRSRLLTSPVRPSTSPSELHPPTQLPGGINAALASTSKSVLIRFLNKLSFLV

SEQ ID NO: 108629 - protein, 97 aa, Triticum aestivum
  Clone ID: PAT_TA_3047.pep
LLQLLYSIELYIYVLKSSVYLITSVCRVGLIFIWLIAVRRLVFSCDHSRRWYKDRSPSVIPGRNGSGILAGKLASQFLSWFLVDALNSPPPPPPVPF

SEQ ID NO: 108630 - protein, 134 aa, Triticum aestivum
  Clone ID: PAT_TA_3048.pep
MASSLATAPAAVRDMQCDLESQANALSKIQKDISKNHEVRKQFTIQVGENELVLKELELLNEGANVYKLIGPVLVKQDNAEAKANIKKRIEYITAELMRMDRALKDLEEKQNSKKESIIKLQQKMQAVQAKAQA

SEQ ID NO: 108631 - protein, 181 aa, Triticum aestivum
  unsure (1)..(181): unsure at all Xaa locations
  Clone ID: PAT_TA_3049.pep
RRKCFPGIQLGSRQKFVILVLVLSFIVMLAFAILIWVGRGENPIDSSLLKKVYLDVFSVVVLVLGAALACYGALLFSKMSKVRSETVSTEKWKVASLAAVSLICFSSSAILALVTNIPXVLLYWYSTEAEIIKNAVILFLYYLIGSSVPSGFVXWVMRDMPQRQRGKATQSRWYLVKDRHP

SEQ ID NO: 108632 - protein, 149 aa, Triticum aestivum
  Clone ID: PAT_TA_3050.pep
DASDEDFPATAPPFLSLLSSFSLSVLSSLSPDIAEVAARRVGWSGYCFPPPAESGSRTRSSARAPPAEDGSMATGTGGARGAAAAPLLILSPTRGQAPPAEAGSRPTGAGRAGTAEAEEAAVGEEADEDEWRRRQERRRLRGAGRVGGR

SEQ ID NO: 108633 - protein, 236 aa, Triticum aestivum
  Clone ID: PAT_TA_3051.pep
GGEQQPRPVLHRCLSPSIRPRQEELEPWSATSAQTPQEEGSSSRASRRASPQPPRYHERVKITRAESRMTVGRGYSVVGPAIRCVSAVTDVQEASMVSVLGRLCLSSVCSSSQVAQEIEDVHVHLVPHRREDGRGGRGPLGFTRRRTGGNHYNHHVLLQAFLASSHDQHGEHRQRAVPNQVREERPGRPSPSNNGDNDCASWDEHGAHPLYAVHHIYLIWRVTPGVYILRSMVSVP

SEQ ID NO: 108634 - protein, 224 aa, Triticum aestivum
  Clone ID: PAT_TA_3052.pep
PRYMPRGSLGELLHGESSSSLDWETRFTIALGAAEGLSYLHHDCKPRIIHRDIKSNNILLDDNFEAHVGDFGLAKVIDMPVSKSMSAIAGSYGYIAPEYAYPPGVAAKSDIYSYGVVLLELLTGRAPVQPIELGGDLVTWAKNYIRDNSLGPGIFDSNLDLEDKAVVDHMIEVLKIALLCSNLSPYERPPMRHVVVMLSESKDRARASSASSPASDNSSKKDSS

SEQ ID NO: 108635 - protein, 124 aa, Triticum aestivum
  Clone ID: PAT_TA_3053.pep
TKCLGHCRRGLVGLQAGPVVASAFSPLMMIVVAVMGSFILSEKIYLGGVLGSVLIVIGLYSVLWGKHKETQAESAALREALPMAMASYTSKVTGDAASAGHDPECEKANGAAKPSSNGHGASAV

SEQ ID NO: 108636 - protein, 136 aa, Triticum aestivum
  unsure (1)..(136): unsure at all Xaa locations
  Clone ID: PAT_TA_3054.pep
MEGATPTPAPSNTRIAVVTGGSKGIGLEACKQLAGGGAITVVLTARDEARGXAAVEQIKRLGHADVIFHQLDITDASSIARLADFLKTRFGKLDILVNNAATDGIEHVIDPVYGLTPGDETFNGMDAGQRINWMWT

SEQ ID NO: 108637 - protein, 232 aa, Triticum aestivum
  unsure (1)..(232): unsure at all Xaa locations
  Clone ID: PAT_TA_3055.pep
LWRYIAYRHDFIENAEXWGAQPLGDESDLECEIEPFPKPSNEAAAEASRFAKILIYGPSREQGSSHCVNSEGPLLNTPNEKIPRVPSDKQLAQSHRLTNGTGPVSNSKQASHTGLSPDPFDGNGPHKKTKKPKAWSNKEDADLMDGVHKCGEGNWLNILRKYNFDSTRTYVQLSQRWAVICRRQGTTKLAKVKSVTTEFDIKATQKAFSMALDMPMTACGFSTLRLGASQSA

SEQ ID NO: 108638 - protein, 136 aa, Triticum aestivum
  Clone ID: PAT_TA_3056.pep
VKMHPPHTWLCIASNNIAVEMNQQCRSIAPKVIRTSTPYTSNIPRLLVDPPIEGRIEQEDGADEDHVHQENHGPQAQGRPPRPIGEAGAWLGGGGGRHWGRRGRIRRRGRLSGSKEGYLRSAHGRSRADAVLGKQG

SEQ ID NO: 108639 - protein, 183 aa, Triticum aestivum
  unsure (1)..(183): unsure at all Xaa locations
  Clone ID: PAT_TA_3057.pep
MATAIHQLSFAAPSAGARRRLTRASASATDRHEVLSPKRRLPLRKVPGEHGPPLPGALKDRLEYFYGPGGRDGFFAARVRAHRSTVVRLNKPPGPFVAKDPRVVALLDAASFPVLFDTSLVDKTDLFTGTFMPSTDLTGGYRVLSYVDPAEPNHAPLKSLLFHLLTHRRQHVIPTFREVXXXL

SEQ ID NO: 108640 - protein, 110 aa, Triticum aestivum
  Clone ID: PAT_TA_3058.pep
TDNSIHPNNTHVNFLRSRRFVSPLCSQGTVVCTPIGRLAMAPCDSFSRKPTTRWPDQENSCMRLLRQQPPPPPPPLRRPDLSRSGASYRRFLKNVRLVAYGLSLVWAFTL

SEQ ID NO: 108641 - protein, 124 aa, Triticum aestivum
  unsure (1)..(124): unsure at all Xaa locations
  Clone ID: PAT_TA_3059.pep
TLRSVSPLESAMKGAKSKGAAKADAKLAVKSKGAEKPAKGRKGKAGKDPNKPKRAPSAFFVFMEEFPKESKEKNPKKXSVAAVGKAAGDSGIPERSDKSLCTKVTTQLEYNKXIAAYNKGEKRN

SEQ ID NO: 108642 - protein, 216 aa, Triticum aestivum
  Clone ID: PAT_TA_3060.pep
MVKAKLLAVLALVAVAAPFLRAAGQEEGEGGARPSELLPFAVGAAPAGCDVGQGEWVYDEAAAPAYDEEACPYIPAELTCQAHGRPDKSYQHWRWQPRGCSLPSFNATVMLEMLRGKRMLFVGDSLNRAQYVSLLCLLHRAMPEGSTSFETVDALSIFRAKAYDATIEFYWAPLLAESNADDGVEHQLNDRVIRGAPMDRHSRFWKGADVLVLNST

SEQ ID NO: 108643 - protein, 189 aa, Triticum aestivum
  Clone ID: PAT_TA_3061.pep
PRVRLAQDGPQGDETHVTTRVMGTHGYAAPEYIMTGHLTTKSDVYSFGVVLLELISGLRSVDRARRPREQNLMAWARPYLKCSDRLYKVMDPSLECQYSCKGAEAASLVAYKCLSQNPKSRPTMREVVKALEPVLSMEDFFPMGPFVFTVIVDEDKVVDMKVEVEEKHQHPRQNHQDRHRQRYLGRDHA

SEQ ID NO: 108644 - protein, 137 aa, Triticum aestivum
  unsure (1)..(137): unsure at all Xaa locations
  Clone ID: PAT_TA_3062.pep
APLRLRAQAAAIGTGLNRLMRGATTMSFLSLSEAITIAGSFXVYACVAAAGWVFMYFFLPGPVGPGLALPRGLGRRRTWTPPTPTAPPARAARPAGPPAGSPSSLRRTSVHMSCDTCRVLVLCVVWPVSKAILDVNL

SEQ ID NO: 108645 - protein, 186 aa, Triticum aestivum
  unsure (1)..(186): unsure at all Xaa locations
  Clone ID: PAT_TA_3063.pep
ITHKESEQAQSWSKIYSEDTKEQSIPVITAWQLNERMXRVCLLLLLFSLPVRFGKEQVHEWRRSYDTPPPNGESLEMCADRAVSYFKDQVVPHLTAGKHVMVAAHANSLRSIIMHLDKLTSQEVISLELSTGIPMLYIFKEGEFIRRGSPVGPSEASVYAYTRVRVYSIFYPSTEQFVSTVYIKTN

SEQ ID NO: 108646 - protein, 278 aa, Triticum aestivum
  unsure (1)..(278): unsure at all Xaa locations
  Clone ID: PAT_TA_3064.pep
VQVVHTRRGSFTPPQXSAAAETNPTDYILETLELSNPRSLIQYLAFQDLCAVSECNIEPWRRAALFEESGETYKRIVTACLKPLEEFTSKIAEALEGFTSERPELLLQQSKLYGAFSDSQICSWCARTLATLTARSRQEDRYGVAQLTGCNAAVMSTLLSALVAVEACLGKKTNPQPAHSLGPASIRWGNNFSTARKGNVTAIASTQRGGLHTKAHSMADVFRTSIYQIVSAFLDDMRANAKASSLEKNWISEGRKPIYGSRAVLVQKLSLFIEYRAV

SEQ ID NO: 108647 - protein, 166 aa, Triticum aestivum
  Clone ID: PAT_TA_3065.pep
RVLCRLTRSIGDVYLKRPEFNREPLHSKFRLPETFRRPLLSSEPAITVHQIQLTDQFIIFASDGLWEHLSNQKAVELVHSSPRNGIARKLVKAAMQEAAKKREMRYSDLKKIDRGVRRHFHDDITVVVVFFDSNAIAMDAWSRPTVSLRGGGVALPANSLAPFSGS

SEQ ID NO: 108648 - protein, 63 aa, Triticum aestivum
  Clone ID: PAT_TA_3066.pep
MDSARSYVSSGASTGASTGKKASPAPAKPATMPLQRVGSGASAVMDAPEPGSGPDSRLGGSKS

SEQ ID NO: 108649 - protein, 639 aa, Triticum aestivum
  unsure (1)..(639): unsure at all Xaa locations
  Clone ID: PAT_TA_3067.pep
GGAVKVLSLGDVYGAYTFDASRMEDSACAGFKVGARTVXHSLVYVSTKELVTRLRTPCTVVYMTNLADGXTVRLTPPGQYDVSPAVSPSGKMVAVANFRGNKWTGEIERLNTDIAIMNVDKGRRGRLPXLIRDRGWPTWGSDNVMFFHRGTGESPTNWAVFRYDIATKETVRVTPEAIDAMTPAALSETRVAVAAIRQKSRQAAMTTPPEEAQYRPIEIFDVASPDGPAVQISQTIMPKDDHNNPFVADGGSRIGDPRGRTDDLVMGSNLSAPATSFDKIHSPHXHVGLFRVSGGVPSLPKDGAKLAFVANEFKXVWLAHTQGLRVVXYETRGSNAVFSTAWNQNPTXHTLYVAVGRSFSAXRPLENYANSNPSGPPPGHKLGQRAAGHPAKEDPHTNPMIAQGDKFVFRSTRDGGKEKFHKNLYIMEDAEXGEFGQGTVTRLTNGPWTDTHCSWSPKGDWVVFSSTREMPASAPEMAFLDAGYFAVYLVKVSDPTVVVRVVQSSATLAGHVNHPIFSPDMRSIVFASDLAAVSNEPISMPVFLHSVRPYGDILSVDLRDTDDITKNKDIQEFHRITHSRYEYSTPTWTKFATDDPNEQWNMLAAKGSATFKPACPYMYPDGGEGWHMAGHLTIPKRCC

SEQ ID NO: 108650 - protein, 311 aa, Triticum aestivum
  unsure (1)..(311): unsure at all Xaa locations
  Clone ID: PAT_TA_3068.pep
LLVRPRVRPSIWFGFAFLLHGSLQKRELGTLTQRWNLRTIGYMPDAWVPVFFVQALLVFVGPTFVKEENSAQGRRVFAKYFIQTSMPVGDTNVCTYPLFGTIFLGLIDAVLMSYVSYVGSRVLSLVINKALRXRVTWLIMSVLFFLPIRXVLLLGFSVMPXXAGDKAFGGHRPSCHFVMMPIPAQTGWDTLCLGNTGPCPMNSIGNSKECXATRGRIXEMVPYDDYYYXGSSLVANQSFREIERNSDTSTKRGSISFRTMIREDQLPPDGTDEIGFSSRXGGXNIGIILALXGSSPSAAMPMLPLKEXPRY

SEQ ID NO: 108651 - protein, 135 aa, Triticum aestivum
  Clone ID: PAT_TA_3069.pep
MTHKIVIAVQMGSSRCRSKALALVAATPGVDSVALAGDGKDQVVVVGHGVDSVKLTSALRRKVGHAELLQVGDAKEDGKKPAAAAVVEYYPYGYYYPSQPAPVNFFYGQHYPAAAAVEAYGYPCSRPEPGTCSVM

SEQ ID NO: 108652 - protein, 84 aa, Triticum aestivum
  Clone ID: PAT_TA_3070.pep
MALDGRALPQPAPACVPAVQAVRPWAGDSGANSSTEGRERGMLQGSAVEVDVPLLRDDEGRMKRELVAWAKAVASMAIRESMRC

SEQ ID NO: 108653 - protein, 585 aa, Triticum aestivum
  unsure (1)..(585): unsure at all Xaa locations
  Clone ID: PAT_TA_3071.pep
PRVRTDAALAVLAARHGGLAELHIGPDPLDRISSDALRSVALCCPRLRCLRLSGLRDLAAAPPARRAPXLPALDVSRTDVSPGAVSRLISHSTTLRLICALNCASLEEEEAHSPAAFANSRGKLVLTINRTISKYIAADAAPLCPDTAVKDTVVFDECRSSSGKRNGVSQLITWLEWILSQSLLRIPESNPHGMNQFWLDQGAALLLTLLKSSQDDVQERAATTLATFAVIDDENTNVDPARSEAVMLEGGIPMLLDLARCSRESLQSEAAKAIANLSVNPKVAKAVADQGGIAILTNMAKSVNRLVAEEAAGGLWNLSVGEEHKVAIAAAGGVKALVDLIFRWPAGTGVLERAAGALANLAADDKCSLEVATAGGIHALVTLARSCKVEGVLEQAARALANLAAHGDNNNNNAAVGQEPGALEALVQLTHSPSEGVRQEAAGALWNLSFDDRNRESIASAGGVQALVSLCQECLNASDGLQERAAGALWGLSVSEANSIAIGREGGVPPLIALAQSEVEDVHETAAGALWNLAFYSCNSLRIVEEGGVPVLVHLCSSSHSKMARFMAALTLAYMFDGRMDEIAL

SEQ ID NO: 108654 - protein, 171 aa, Triticum aestivum
  unsure (1)..(171): unsure at all Xaa locations
  Clone ID: PAT_TA_3072.pep
MLGAMKLVLRREKSRAAGTFSCDLAGYFSTSSSCQRLSGKVAVITGAASGIGKAKAVEFTRNGAKVGLADTQEFAGRSVAAELGPIAEYTRRYVTDEPGPGAEYDHADVTHEAQNAAAMDVAVARHGRLDVLYSNAGVSGSSAPAPLAXLXXADFDRVMAXNARSXXXXVK

SEQ ID NO: 108655 - protein, 142 aa, Triticum aestivum
  unsure (1)..(142): unsure at all Xaa locations
  Clone ID: PAT_TA_3073.pep
XXSFPWPAAXPXFSXRXWSLPSTSCKCRELLRVRRAALGGGATTGPLVVAAVAVADGGFVLGPPLPVGLLVEPQHHVRQAHLVAGLRHNHFLVLGCKSGVRGSRCSVVSCRVLPAGLYTRRRGGRGEAAMDGTVLAGPARSG

SEQ ID NO: 108656 - protein, 225 aa, Triticum aestivum
  unsure (1)..(225): unsure at all Xaa locations
  Clone ID: PAT_TA_3074.pep
MASRFLARSKTLQHPRSRPLPPPAGAGGSGALPCLPRPPAAPAXPAPSAPIRAPAGLRDMREHQPTAPLSGTQVLPLLXPTIASKGSTMQTTQDSETCKEVDGTGHYKALKATEGDFPKFTEFNPLEATAKPRSRPLKSESSKVRRSEILTGXTFYMIPALLLSSRNSISTSLMVAAVYHQIYMFHKEIFLDYVHHDITRKWALIYFKLLLLVMAKDTIVYFGLV

SEQ ID NO: 108657 - protein, 73 aa, Triticum aestivum
  Clone ID: PAT_TA_3075.pep
STISTSPQLPHWTRRIVRREADLVMGEQAAKVPPKKEKASSSNTQLTKTAACRRNPLQPQKKQMKQTTPSKKN

SEQ ID NO: 108658 - protein, 158 aa, Triticum aestivum
  unsure (1)..(158): unsure at all Xaa locations
  Clone ID: PAT_TA_3076.pep
MAMCCHSSCSLICIVFLLVFVAVAAEGAGYVQARQRKLQQVPAPPPVPLPNPNPQPDPNPQPLPMPDPNPQPLPQPLPQPLPGPNPXPQPLPXPLPRPNLQPQPLPQPLPDANPQPPPLPQPLPRPLPGPNAQPLPQPLPGPNHXPLAQPDVQGHIRR

SEQ ID NO: 108659 - protein, 110 aa, Triticum aestivum
  Clone ID: PAT_TA_3077.pep
FLWNNDHIEGLIKQNSKVLLPIILPSLERNTKGHWNQAVQSLSLNVRKIFLDHDPVLFEGCLKKFQDDEAQLVAGPSFRGASGMRLQGVPSALPHAGRPQAMAHQQGSST

SEQ ID NO: 108660 - protein, 145 aa, Triticum aestivum
  Clone ID: PAT_TA_3078.pep
GFGRRASAPALVAMSFSFPLACPCSHLLLPSSVIVEEIVWKLLHTNLLARRPGGVVGVVSPFSPSLRPLDWALLHAPTRCRGTPWSKSSSWNKSWTMPWKMNGHVDKALVKTKDLVGSHKNCTTPSNTEKTKMAWPSTFIQKIYG

SEQ ID NO: 108661 - protein, 57 aa, Triticum aestivum
  Clone ID: PAT_TA_3079.pep
FRWFSNFSEAEELLKLAAARQQVQAHIAKLRRQLSMIEGMPQQSRVISGPGQQFGHG

SEQ ID NO: 108662 - protein, 217 aa, Triticum aestivum
  Clone ID: PAT_TA_3080.pep
MSADELRLDLEELRRLEGLAKRPRVVSLLSNEIRSVDAKLASRAAPVQTQAPQAVAVAAAAPAGLSYVTLGSFSWDQDNEKIRVYVFLENVDQEKVETTFKPMSVDIKFHDVKGKNYRCAIPKLNKEIVPEKCKIGVKPTNMAITLWKASSGNWLDLHYKEDKFKPSMDKEKDPMSGIMDLMKGMYEEGDEDMKRTIAKAWSDARSGKTADPMRGLP

SEQ ID NO: 108663 - protein, 138 aa, Triticum aestivum
  Clone ID: PAT_TA_3081.pep
MNVGGAPVSFQNEANPDDSFMNLMMKDQRSGEADGGLLLHNAVAQHSDENARFMAYHLAELGRYGNGNVSLTLGLQHSGSGLSVPNAQANFPGVSDDDIYNAGAPLGVSIASSDYESLNQMDQRQRFEQSPLLHDFVA

SEQ ID NO: 108664 - protein, 245 aa, Triticum aestivum
  Clone ID: PAT_TA_3082.pep
MADSPRRRYTRPSRSPSPYKGRQKQMSRSRSPVAQSQSRSPSPDPRAQARSRSRSPAREREPEAVNHGNTLYITGLSSRVTDKELREYFNKEGKVVSCHVVLEPHTRVSRGFAFITMDTVEDAERCIKYLNQSELQGRNITVEKKTLGRPRTPTPGSYLGHRYERREMQRGGRFRRGGYGRDDYYGNSYRRSPPPMGGRGYSPHRSPPPYGGRARRERSRSLPYSPYRMPERGYGRRAGGGGYDR

SEQ ID NO: 108665 - protein, 187 aa, Triticum aestivum
  Clone ID: PAT_TA_3083.pep
EGALESGLAAAMGSSAVQKEAVVLNGGGSGAGEDHRLRALAARTVTDSLRAAVARSSAADKAARLEECARSLEAEKAKMEVFRRELPISVHLIADVIEWLKDEVAQHRRPAPDQLLAPAPSPSPAPPEKRKAEVVKTEADASDKRSWMSSAQLWTCGSHSSTSNSNGDSVKKHAQKVSNAFMPLNGL

SEQ ID NO: 108666 - protein, 79 aa, Triticum aestivum
  Clone ID: PAT_TA_3084.pep
CWHDLFSILSTRLAYNQIGVVEIKIHWLAVSLRLAEITTCQIDWWPSSSVCAYLLLGREPGYSSINKSFIALFSFHSFL

SEQ ID NO: 108667 - protein, 274 aa, Triticum aestivum
  unsure (1)..(274): unsure at all Xaa locations
  Clone ID: PAT_TA_3085.pep
GFDEATMASLHDSKEFLSGSISSFGTAEQSQLAGSGLKAEQQEQNAMCNIPLPFASGSQMAVSEAQGAXFXSKXSSTMHNNKSEYPVPISHSADAQNKANSANGNSASAKPRARARRGQATDPHSIAERLRREKISERMKNLQDLVPNSNKADKSSMLDEIIDYVKFLQLQVKVLSMSRLGAPGAVLPLLAESQTEGRSNSPLSSPTASQGLLDAAGPEDSLVFEQEVIKLMETSITNAMQYLQNKGLCLMPIALASAISNQKGTSAAAIPPER

SEQ ID NO: 108668 - protein, 176 aa, Triticum aestivum
  Clone ID: PAT_TA_3086.pep
WVVDPRVAARMAAAAAPPAVRVIPPGGAGASPRLLCPPPGLLIASASVGAGRKRAPVLKSAAVYSCFLGTSANLRYQIIAGLLEHRLGESLATQYNQPLLAGLLSFVARTVNSYLGTQQWVDLARYTGVQKIQEQLPSDEVTTPPETSQLEDGRTDVQNPDESSSSNADRSSDPTK

SEQ ID NO: 108669 - protein, 70 aa, Triticum aestivum
  Clone ID: PAT_TA_3087.pep
FDRKAPVCQEDRRRESIRRPQVLLAHIHVASLVLKVETKALFAGDFECVKCACACCVFKCSRRFFVHAMT

SEQ ID NO: 108670 - protein, 277 aa, Triticum aestivum
  Clone ID: PAT_TA_3088.pep
STYRPTSAQSVHSVQSRKCSEWREPTVIASPKLLLLLATLLPRCGLLLACPAPMTLTVVNNCAYPIWPGIQGSAGSEVPARGGFFLPSLSQRSFPAPTPAWSGPTWARTGCTPAGAGQLRCATGDCGGRLQCGGLGGAAPATLAQVSLHHGGDDQSSYGVSVVDGFNVGLSVTPHEGRGTCPVLACPDQLTCRCAPRRPAAAAWGGGVAAGRRCSPTSGTDELRTRDASPGPAACRPSKYSDCANNECPPAFTYAHDSPSLTHQCSAPRELKVIFCH

SEQ ID NO: 108671 - protein, 238 aa, Triticum aestivum
  unsure (1)..(238): unsure at all Xaa locations
  Clone ID: PAT_TA_3089.pep
MDFSGGAGGARAPEMYQSARRLLLSARDGVARVERLACAPAGPSYSASPPLVGAPDPAGAEAVRREVAAAQGLCAQMDRNRRQTPVTGLSDLWKRKVKRLSIGERELKETLDKHLLRQPKRLLEXKERAKLFERANGESSHVLQIFDDEAQAMQSARSSSRMLDEAFETGVAILHKYSDQRDRLKSAQRKALDVLNTVGLSNSVLKLIEKRHRVDKRIAYGGMIITVVLMVAFWRWTH

SEQ ID NO: 108672 - protein, 304 aa, Triticum aestivum
  unsure (1)..(304): unsure at all Xaa locations
  Clone ID: PAT_TA_3090.pep
MPNHRATPRFPNSSAVLPACRGRESPPLHNNHREAARARARTEAAAISRPPTARAMASTNGGFVSPLAATVPVEAVLFDIDGTLCDSDPLHHIAFQELLLAIGYNNGVPIDDEFFINNIAGRSDAEAAQNLFPDWPLEKGLKFLEDKDVKYRSLAMERLEPVKGLHKVVQWVKDHGYKRAAVTNAPRINAELMIKLLGLSDFFQAVIVGGECEQPKPAPXPYLKALKELEVSAAHTFIFEDSASGTRAGVAAGMPVVAVSTRNPVKSLQEAGAALIVSDYEDQKLWNALEEIDREEAKLKTGGA

SEQ ID NO: 108673 - protein, 156 aa, Triticum aestivum
  unsure (1)..(156): unsure at all Xaa locations
  Clone ID: PAT_TA_3091.pep
RNEQFFMIGSTSAYPAXVLHMVVNLLTKKGIHFRVTSKQTAADTNDKFADLYDMRWVPMLIPTTVVLIANVGATGVAMGKTIVYMGAWTIAQKTHAALGLLFNVWIMVLLYPFALAIMGRWAKRPVILLVLLPVAFTIVCLVYVAVHILLLSYLTF

SEQ ID NO: 108674 - protein, 136 aa, Triticum aestivum
  Clone ID: PAT_TA_3092.pep
PGTPCPEQQGNPRPCRHPFCSSSLVSSPFRKPLASPGRLILEPPMASFSIPSSLNVHDIVDVIRIGQVSSGAGNVKILHCEMTSDADTEVGSIQCITAGVPGTEAEVRPGTSAPTGSPCPMTAGDEGRWRGTRPGR

SEQ ID NO: 108675 - protein, 180 aa, Triticum aestivum
  Clone ID: PAT_TA_3093.pep
VGGGVRLAGNGGYEDWRLGTATYIKESQGHPLNDGGGACGYGDLDIFRYGRYTAGLSGALFGRGSACGGCYELRCVNNVLYCLRGSPTVVVTATDFCAPNFGLADDYGGWCNFPKEHLEMTEAAFLRVAKAKADIVQVQFRRVSCDRAGGIRFTITGGPCALPGLFPSGAAHRVVVAAWL

SEQ ID NO: 108676 - protein, 113 aa, Triticum aestivum
  Clone ID: PAT_TA_3094.pep
GRAQCQFTQQNCSAGQDEETLVNLDTVTPNIFDNKYYGNLLRGRAPLPSDQRGRSRGVAAATTAPIVHRFSGSQKDFFKNFAASMVKMGNISPLTGRAGEIRNNCRRVNNKPY

SEQ ID NO: 108677 - protein, 104 aa, Triticum aestivum
  unsure (1)..(104): unsure at all Xaa locations
  Clone ID: PAT_TA_3095.pep
RAYQTLXGXLLQKLHLGTNVASSRLRFLWAGSREVETRHVTKAQRPRELAHGVEXWSQVPDGTHSQDRLQIYSKXLLLLDLRFLSSYSFIRPSFCLSRSLDNNM

SEQ ID NO: 108678 - protein, 51 aa, Triticum aestivum
  Clone ID: PAT_TA_3096.pep
EIMHVQFFFLQRGSASNPLITSRNCDLLQRLLLCALFYLLCALENKQNKDS

SEQ ID NO: 108679 - protein, 83 aa, Triticum aestivum
  Clone ID: PAT_TA_3097.pep
SCLEAPKWCLNYRKELCVRPPPYGYVKTPTEFFDKDIAIAEDLELLDSLAGIAVQCLSLDVDQRYTMMEVAEQLHKLSRSRKV

SEQ ID NO: 108680 - protein, 60 aa, Triticum aestivum
  Clone ID: PAT_TA_3098.pep
FVGRIYRILNRQIRNHLPIQLSCMSFAYILSFLVLTSHAVWISYGSSLLLRSGFSNCCTC

SEQ ID NO: 108681 - protein, 145 aa, Triticum aestivum
  Clone ID: PAT_TA_3099.pep
MCAGKLHLVVGLGEANGPEVGKKSWMPLICSCGARCMTENFYDGVAVLRMHASPDIITTFTCSPKWPEITESTEPGQKTVDRSDITVRVYRLKLLEYLQKMRTGRMFGPIVAVIHTGEFHKRELPHACVLVWQEKHHDRVVTPTS

SEQ ID NO: 108682 - protein, 85 aa, Triticum aestivum
  unsure (1)..(85): unsure at all Xaa locations
  Clone ID: PAT_TA_3100.pep
NWSPKKAPPLFFFFFFFFFFFFFFFFFFFFFFFFFFFFFFFFFFFFFFXTKRITSNLLCTKQYKQLPICSTCYRFPATYALRITF

SEQ ID NO: 108683 - protein, 63 aa, Triticum aestivum
  Clone ID: PAT_TA_3101.pep
CVREPPLYRKTEDCPELITVGQKNESDKETDDFQGGLACSFCRFLLGARTIKHIPYSDSPRVR

SEQ ID NO: 108684 - protein, 216 aa, Triticum aestivum
  unsure (1)..(216): unsure at all Xaa locations
  Clone ID: PAT_TA_3102.pep
MAEALLHHLPRRFGASTTASSSPSSHGVLSPAPRADLRVTRLAAAAPPGRPPRLMAHAAGAFKRRGERPKWWEKNAGANMIDIHSTQXFLDALRDAGDRLVIVEFYGTWCGSCRALFPRLCRTATDNPNIVFLKVNFDENKPMCKRLNVKVLPFFHFYRGADGQLEAFSCSLAKFQKLKDAIAVHNTDRCSIGPPVGVGDVLDSSSSQEKPAEAAS

SEQ ID NO: 108685 - protein, 267 aa, Triticum aestivum
  unsure (1)..(267): unsure at all Xaa locations
  Clone ID: PAT_TA_3103.pep
RLSSANMQGTLSDSIGQLGQLMFLDLSFNSGLSGTIPASIGNLGKLTTLILAGCSFSGGIPKELGNLLQMTFLALNSNKLTGTVPPQLGLLSKLFWLDLADNAITGSVPISTGTTPGLDLLTNTKHFHFNKNQLSGTLTGLFKPNMTLIHILFDSNQFTGPIPRELGSITSLQVLRLDRNQFAGAVPNITNLVNLNELNLATNKLTGSVPNLSSMNVLNXVDLSNNTVYATSQVHKSNKYFFKIDVFCEAHLAGPSGTLQFAPACMK

SEQ ID NO: 108686 - protein, 117 aa, Triticum aestivum
  Clone ID: PAT_TA_3104.pep
SCLSSFSPFKLNPSLKPSPPPLSLSLFYPVFVSKRKNSEDPLEMQNRPIFLQFFFSLPLHFLGCLVLVSVCLGWVLVRMDQHRTLGKLRLIRVYWVCFLLSSWEGFEGRGDMKTFWG

SEQ ID NO: 108687 - protein, 52 aa, Triticum aestivum
  Clone ID: PAT_TA_3105.pep
CWFDTDFSTRTYRMLKNLSKDINSLSFHRRQRIVESLCSDCSALLFQTIVYL

SEQ ID NO: 108688 - protein, 189 aa, Triticum aestivum
  unsure (1)..(189): unsure at all Xaa locations
  Clone ID: PAT_TA_3106.pep
MPAEELRHGPVGAFSWLGIAFLTVNSAMAIHRSKGDPSAVGFVAFSYLDLVLLFYFHRRFESAAPGSPARRRLKVAVWVLTTMLTAVLSYKVXAAIMPLPVKILVWAMAGAATAGGFYAFFLFREWQGCLRKRGIYLLGKPLFWILHAPNVAGKRNQRYICSFRKMGRYGQGLAHSHFQVVGCCRNCCR

SEQ ID NO: 108689 - protein, 592 aa, Triticum aestivum
  unsure (1)..(592): unsure at all Xaa locations
  Clone ID: PAT_TA_3107.pep
MCGILAVLGCADWSQAKRARVLSCSRRLKHRAPDWSGLFQCEGNFLAQQRLTVLSPLSGGQPPYNEDRTVXVVGANGEIYGDRQRRNQLRXKYTFTTGRDGEVIMPLLEEXATNFVNARARNRTCPLGDSRNKRYMSARDAVGVNPLYFGRGSDGSVWIASEVKALHEDCPKFELFPPGNLYSSAAGGFRRWYNPQWFAEHVPATAYQPLVLREAFEKAVIKRLMTDVPFGVLLSGGLDSSLVASVTKRHLIETEAAKKFGTELHSFVVGLEGSPDLKAAREVADYLGTIHHEFHFTVQDGIDAIEEVIYHNETYDVTTIRASTPMFLMARKIKALGVKMVLSGEGSDELLGGYLYFHFAPNKEEFHKETCRXKVKALHQYDCLRANKATSARALEVRGGLLDKEFIDVAMSMDPEWKLYDANLGRIEKWVLRKAFDDEKEPYLPKHILYRQKEQFSDGVGYNWIDGLKAFTEQQVTDEMMKNAAEEYPYNTPINKEAYYYRMIFERLYPQDSARETVPWGPSIACSTPAAIEWVAQWKASNDPSGRHIASHNDAAPAHAHANWNGAVANGKANGNGTANGNANANGTLVPC

SEQ ID NO: 108690 - protein, 144 aa, Triticum aestivum
  Clone ID: PAT_TA_3108.pep
MAGTMMAVTAKSKNCTLASEKKHGWAIPQLPELRFPWDSQEDKAFSLSLHDSASPHHGALFASVGLKVSTPAPAVSTSPAEQEFKIPFADHCIKFVSSAVGFPVVGAVDGSVEEEVVVDGKVIRKKAKKRGLKLKIKIGNPHLR

SEQ ID NO: 108691 - protein, 101 aa, Triticum aestivum
  Clone ID: PAT_TA_3109.pep
MAFMRYRALPQGEVTAEEFWAWLGQFDADHDGRISREELQRALRSLSLWFASWKAREGVQAADANRDGAVGREEAGRLFAYAQRQLGGKITQLGSYGSNWA

SEQ ID NO: 108692 - protein, 266 aa, Triticum aestivum
  unsure (1)..(266): unsure at all Xaa locations
  Clone ID: PAT_TA_3110.pep
PPVXPKDMVRXLTHPYLRXRCALLWELLKSSSSAPLYDSSNIWEGSHLHLDSSTAEGNSSLAIELDGIRELEHLFQIQPLDLILKDECVHMLALRWSQHFCEDYRSRKYRGILFSTPAVPFRLMQLPPVYQVLLERYVKMQCPDCGSVPDEPALCLLCGKLCSPSWKPCCRAGKCLNHASQCGAGVGIFLLVRKTTILLQRSARLAFWPSMYLDAFGEEDHEMHRGKPLYLSQERYAALTYLVASHSLDRTSEVLRQTTISFYTSD

SEQ ID NO: 108693 - protein, 47 aa, Triticum aestivum
  Clone ID: PAT_TA_3111.pep
PYPLVTRSMAAPMLILVPVHMIIMVLLSWSDDFTHANKHPCDMFFTS

SEQ ID NO: 108694 - protein, 138 aa, Triticum aestivum
  Clone ID: PAT_TA_3112.pep
KFDVLMLPPRKTYGGHCSLSELEGKLCLLVVDGALEGIPRTMDILMLDNDDKQSWTHRYHISLPPLMQSCYFTPRHTLFHDSKIWVQLFARNLYCYDPNSNSEELEIACPESEFPFSIHTFVESIIPLRQDNFIKKIQ

SEQ ID NO: 108695 - protein, 147 aa, Triticum aestivum
  Clone ID: PAT_TA_3113.pep
MAAIQKLYEVCKVSLFEKGPSSPEAVENARTVLDMITPSDVGLECEAQAVRVWRRPRALNRKTVLHSSPAIRYRHIYECKSFSIGIYCIPASSIIPLHNHPGMTVLSKLLYGKVHVKAYDWIDIEEPGNLSKVRPAKVVRDGEISAP

SEQ ID NO: 108696 - protein, 128 aa, Triticum aestivum
  unsure (1)..(128): unsure at all Xaa locations
  Clone ID: PAT_TA_3114.pep
MSSIGTGYDLXSVTTFSPDARVFQVEYARKAVDNSGTIVGIKCKDGIVLGVEKLITSKMILAGSNRRLHSVHRNSGLAVAGLAADGRQVVSRAKSEAANYEKVYGEPMPVKELADRVASYVHLCTLYW

SEQ ID NO: 108697 - protein, 105 aa, Triticum aestivum
  unsure (1)..(105): unsure at all Xaa locations
  Clone ID: PAT_TA_3115.pep
PQLYMIETSGXSSYKYFGAALGKGRQAAKTEIEKLKLSELTCREGXVEVAKIIYGVHDEAKDKSFELELSWVCDESNRQHEKVPNDLLEQAKAAAQAALEEMDAD

SEQ ID NO: 108698 - protein, 259 aa, Triticum aestivum
  unsure (1)..(259): unsure at all Xaa locations
  Clone ID: PAT_TA_3116.pep
MSSIGTGYDLSVTTFSPXDGRVFQVEYAGKAVDNSGTIVXGIKCKDGIXLVVEKLITSKMILXGTNRRLHSVHXNSGLDXVAGLAADGEADSLQEAKSEADKXYKRVYGRTHAXVKELADPVVAXYVHLCTLYXWWLRPFGCGVILGGYDRDGPQLYMIEPSGLSYKYFXGAALGKGRQAAKTEIEKLKLSRAKYCREGXLRLPMIIYGVHDEAKDKSFELELSWVCEESNRQHEKVPSDLLEQAKAAAQAALEEMDAD

SEQ ID NO: 108699 - protein, 97 aa, Triticum aestivum
  Clone ID: PAT_TA_3117.pep
LITPKVLAVNAAKDATDLVAKLRSYHHKAQTNADKQHLSSMGLDLTKGVIRNNLEHGVIEPAMSKVKIIQFATEAAITIVRIDDMIKLDKEESGQEV

SEQ ID NO: 108700 - protein, 241 aa, Triticum aestivum
  unsure (1)..(241): unsure at all Xaa locations
  Clone ID: PAT_TA_3118.pep
TWGDRASTEQREDHPVGQTSFHYCAKTSLSXKLITTDDNFFANLVVEAVQAVKTTNSKGEVKYPIKSINILKAHGKSAKESYLLNGYALNTGRAAQGMPTKVIPAKIACLDFNLQKTKMQMGVQVLVSDTRELEKIRQRESDITKERIEKILKAGANVVFTTKGIDDMSLKYFVEAGAIAVRRVRKEDLRHVAKATGATMVTTFADMEGEETFDPSFLGHADEVVEERFLMMKLIAMMKQY

SEQ ID NO: 108701 - protein, 579 aa, Triticum aestivum
  unsure (1)..(579): unsure at all Xaa locations
  Clone ID: PAT_TA_3119.pep
GAAPAARPPVSPPPRPPCPPPPPPPAPRRPPAALPITSPVPAPTGARQSGESVRTPSVSAHQAVPNAGQWALAPVGPEYLLVDDIGDVTIANDGAAIMRMLEVEHPAAKVLVELTELQYREVGDGTTCVVIIAEELLKKANDVVRNNIHPASIFSGCRLAMREACKYVEEKLTVKVDRLGKDCLFNCAKTSMSSKLITTDSNFFSNLIVLGVQAMKTNYSIXQVYYYFQSFILLNARGKSAKESYPLNGYALNTGRAAQGMPTRVTPARIACLDFNLQKTKMQMGVQVLVSDPRELEKIRERESDITKERIQKVLKAGANVVFTTKGIDDMSLKYFVEAGAIAVRRVRKEDLRHVAKATGATMVTTFADMEGEETFDPSFLGHASEVVEERISDDEIILVKGTKNTSAVSIILRGANDFMLDEIERSLHDALCIVKRTLESNTVVAGGGAVEAALSVYLENLATTLGSREQLAIAEFAESLLIIPKVLAVNAAKDATDLVAQLRAYHNKAQTNADKQHLSSMGLDLTKGVIRNNXLEHGVIEPAMSKVKIIQFATEAAITIVRIDDMIKLDKEESGQEE

SEQ ID NO: 108702 - protein, 204 aa, Triticum aestivum
  Clone ID: PAT_TA_3120.pep
PNYSANVPYPANGNNYLQMAGGGSHLTAGQVKYGVSQYKPPPPGHPPGYGNYTHPAGYTISSPGVIGAGVGVDDVNRMKYKDNNIYAPTPQVETSDIWIQNREIPTLQCPPYYNLSGQATPGAYMPNPGNASFSATAQSSHAQFPGMYHPQQPPSIVSPHPMVHQQVPSAIGPNVGVGVAAPGPQVGAYQQQQLGHMNWRQPNF

SEQ ID NO: 108703 - protein, 74 aa, Triticum aestivum
  Clone ID: PAT_TA_3121.pep
KAVTNGHDFFSVNQSYQKREKATSASGQHPTLLKISMTTAGHTPCSALCCGLAARAMTTSETMVASGRQQPWRP

SEQ ID NO: 108704 - protein, 143 aa, Triticum aestivum
  Clone ID: PAT_TA_3122.pep
MDHDAAAASPSASPSSSGASPSPRSKRRRTDRYALGFEFAPRSAPSAPAPRTTPEWTEESTFALLDAWGERFACDGRRSLSADEWLEVSRIVAAAASRPAGYFSESQCRNRIDTLRKMFRKEKERSRLAAHRSSNPAPSKWVY

SEQ ID NO: 108705 - protein, 234 aa, Triticum aestivum
  Clone ID: PAT_TA_3123.pep
ASLSSSETMCESASLLAAAGNQDGHHQGEIKTAEMDTSGLLDPSSAALGPSPLPTPPPPLVFYEDDYRYYYDDDSCFQENQEGDDDAYQLLEDEEEDVAATGSLAARLRELVRQKLAEVNASSAVVAGLGLVGSAVGAYFLWPAAAATATAATMAAPRGRRFPHLPCGVCGQAEALLPDPPHCRSGSGCRRFRPVAAREGRPRTHCLVSSRARRSCVGRLRCLYIANNGAVSLS

SEQ ID NO: 108706 - protein, 269 aa, Triticum aestivum
  unsure (1)..(269): unsure at all Xaa locations
  Clone ID: PAT_TA_3124.pep
REQKLELHRGGGRSRTSGXXGLQEFGTSPTPSPLSLRQWRPAAQRNLRNQWSRLLAAKTQWLDAAASGRSHAATLVNAYLSRSYMPGMDLGVLKDMPRIRDRASAKLXTRRCNAREMLLSAYKEMVCAMSDLVKASHAMRCFSKVSSGSPLVRFTDRQDDLNDLGDGGGAPVHRWVSMLEFENLAKELVEIFGFRTTNWKRVFGPGGLDDSFPHYLEKLERAGGPFHAREFEFKIGLGSGDNFPLPEWKADVLQTLDIPNPRRKVIYPG

SEQ ID NO: 108707 - protein, 120 aa, Triticum aestivum
  Clone ID: PAT_TA_3125.pep
MEPSMAPRRLWHVVRAVLFMLRKGMSKRKLSMDLQLLLHRGKIAGKALSRLMSAHGHHDQAASRSAAEAPPPASWSRRTLDPALAVYGPRGAGRQVEFSCSNTPSYPTQLILAKRRRANN

SEQ ID NO: 108708 - protein, 347 aa, Triticum aestivum
  Clone ID: PAT_TA_3126.pep
MGGYENGDSPAAAAWEGGVILGVDGGTTSTVCVCLPAAMPPPEAPGSVAVLSRAIAGCSNRNSVGENAALETLEQVMMQALTMANTDRSAVVAVCLSVSGVNHPSDQQRMLDWICNLFPRNAKFYVENDAVAALASGTMGKLHGCVLIAGTGSIAYGVTEDGKVARAAGAGPVLGDWGSGYGIAAQALTAVIKAHDGRGPQTNLTRDIIRKLEISSPDELIGWAYPDPSWARIAALVPVVVSAAEDGDKVANTILHDAVQELAESVVAVVRRLTLCGEDGKDQFPLVLVGGVLEGNKKWDISGEVIKCISKVFPGVCPIRPEVEPAIGAALLAWSHLRKESKLQNGS

SEQ ID NO: 108709 - protein, 253 aa, Triticum aestivum
  Clone ID: PAT_TA_3127.pep
MADKENAAPAAAAGPRLTRAAAKRAATCSAGPSGGAKRKRVALSELPIVSNAGVVLRQPSKPAKPAAAAEGEEQHGGLSRCASTSPTPVGEEVSGGGGITQLSGSYASDIYTYLRTMEVEAPRRPAADYIEAVQTDVTANMRAILIDWLVEVAEEYKLVADTLYLTVSYVDRFLSANPLGRNRLQLLGVAAMLIASKYEEISPPHVEDFCYITDNTYTRQELLTMESDILKLLNFEIGSPTIKTFLRRFTRSG

SEQ ID NO: 108710 - protein, 92 aa, Triticum aestivum
  Clone ID: PAT_TA_3128.pep
MRPQVLLAALAVIAVLAAALPLAHSQGATLCCDNCGSCTRSIPPQCTCMDTSPTGCNPACKTCSRSTVGGRNSFQCKDRVANFCKTRCTNAA

SEQ ID NO: 108711 - protein, 135 aa, Triticum aestivum
  Clone ID: PAT_TA_3129.pep
ARPPRPANPGAAASPRRDRSRLPRRRRAAGPSSRPPSPAKPRTGHWTEEAPGRSRCLGQRKLDPALVREEPAAAGRDSQEPSTIKASEAREKLKHRRRLARLTRIAQPWREVALVEPVLCCSGLLCSPLPRERRK

SEQ ID NO: 108712 - protein, 298 aa, Triticum aestivum
  Clone ID: PAT_TA_3130.pep
YGGGSPLKRRLTLLWFILCAFCFPPACSLISSAFSPTSPTETLEEFILSILLFMPAGIRVSASFLFSHPYEMPAGRLKLAVRLPSPSDEPADGGLKLARGKAAGRTTAPFRGAPLRCRLDLSAAPTGSGGVPRLRLRHRRQGVCPGERGRRRRHLLDAGDGRGPGEPLAPPPLLPESAPERQAEAKLDLLGLRIQAPRLLLAATGLASPADAAQQVPRVGLHRRRSQELVTGQRKLPHGVVARVRGSSRARQRRARTAQPRREVDASGVEPAMCCSGPLAVAAASHGEEEGDAPSQQK

SEQ ID NO: 108713 - protein, 72 aa, Triticum aestivum
  Clone ID: PAT_TA_3131.pep
LGVTIRPVKVIHIEMKNYTTFQCLTCALFASNAGVLLAPSPQVMQLLPHARCRHMHISSPPRAPATIQPERE

SEQ ID NO: 108714 - protein, 103 aa, Triticum aestivum
  Clone ID: PAT_TA_3132.pep
LARTHPTTPVLAGWWPELAEDSGHACGGTEHEATTALLAGKAQVRHLHYLQTRRKINRTSPYLWLSGWSCRHPIGPPLAICAIYHSSLTPLLVDPILKNIKFC

SEQ ID NO: 108715 - protein, 57 aa, Triticum aestivum
  Clone ID: PAT_TA_3133.pep
MQYGYGGIGDLDQDSYYYDGMSAAGGDWQSGSHMDGADDDCNDSGGYGAGEVPLWSY

SEQ ID NO: 108716 - protein, 219 aa, Triticum aestivum
  Clone ID: PAT_TA_3134.pep
MDQYSYGGGDGDQAGQGGYATVTSAPPKRPAGRTKFRETRHPVYRGVRRRGAAGRWVCEVREPNKKSRIWLGTFASPEAAARAHDVAALALRGRAACLNFADSATLLAVDPATLRTPDDIRAAAIALAETACPAAPVAAEASAPAPAMMAMMQEPSAVEYDDYPMQYGGIGDFDQHSYYYDGLSAGGGDWQSSSHMDGADDDSNCGGGYGAGEVPLWSY

SEQ ID NO: 108717 - protein, 335 aa, Triticum aestivum
  unsure (1)..(335): unsure at all Xaa locations
  Clone ID: PAT_TA_3135.pep
MATFEVTRSFGASVDNTKIKFSKLYLRQIWEGPNTNQTGPLVSGDPALQFGLSGVNSWGIYDDLGSEAKLVAKAQGWHTAIHPNWYSWFSMTFFEGERFKGSTLQVMGASRSANDGEFAIIGGTGDFAMARGILTKRLVVDVAGSKISSXVDGFCHMNIPVPAPTKMGPWGAKDAPLREMDKKSQRIXSVTIYFXSVVSAIQFSYIGEDGQICNSGLWGTTGCTNSPSTIETLSFAQMKFVKQITGTVGDPDYLSHLKIVTNIKTYGPFGPQDGKSPFSFTVPEGKTVVGFFAQCDDYIRKIGCLHHLNWPPRVLFMAVCLIFFNFPSSSNKLAS

SEQ ID NO: 108718 - protein, 239 aa, Triticum aestivum
  unsure (1)..(239): unsure at all Xaa locations
  Clone ID: PAT_TA_3136.pep
LRGSPKALAPYLDKAISYILHTMDPSNLIMRKACIISSMMALREIARVFPMVALNESMTRLAVGDAIGEIHSATIRVYDIESVTXIRILDACGPPGLPSFLKGPSDTTTTMLIAAARVSPVGLGRVACSEFGRLPSRWSLASAGSASLRRSLTPIQCTTLIYVPPWXGFSPNSARLSISSYIWHEDKHQNSESKTRELDEADNLKLLLHNLDLSYRLHWVGGKTIKLTRHDQDLGTFQL

SEQ ID NO: 108719 - protein, 187 aa, Triticum aestivum
  Clone ID: PAT_TA_3137.pep
MADARLALASLFVSILMLSMAHPFFACPTRCESEIKMQMYLHQVVSGPTHNQEVVFKSTPTIEFGRTVAFDYTLLDAPTPDAKIIGRAKGTHVQADQVNAGDFSHFSMIFQQGRFTGSTFQVMGMTPPNGVWAIVGGTNELAMAQGIIQFAIVKGTPNVESYRELNITAFIPTVSIATGSFVQYFDI

SEQ ID NO: 108720 - protein, 174 aa, Triticum aestivum
  unsure (1)..(174): unsure at all Xaa locations
  Clone ID: PAT_TA_3138.pep
SFQRPSWRGSPLLPPACGPSPRASPCIPRGSPPLFSPLLRAVQCSPRRRKNGGLLRRHGMQYLGTRCAVRSCGSSDVCVWLALTSKVMKTTLGQRYSASSVACSLLPAAPSEIASQSIFQARAAYRLPMCGGTKASEKAPNDGHKCMAHHPTPDRLESXAASFGSLTGLARPFA

SEQ ID NO: 108721 - protein, 87 aa, Triticum aestivum
  Clone ID: PAT_TA_3139.pep
MAAGSRRDRRMFASISNLAELRSAAAAAAMDDYYEFDHFDDGRQYGGLEHAMKHKKRRSVLRKFGDLFRRRSLLHKSDDFAPVLASR

SEQ ID NO: 108722 - protein, 68 aa, Triticum aestivum
  Clone ID: PAT_TA_3140.pep
ACDDLTLSKSHDGRGDAGAAVEVKHDPLRSRLGMGRKLHLLSAAPRAPVAGGESARRTSSRFPAGARP

SEQ ID NO: 108723 - protein, 122 aa, Triticum aestivum
  Clone ID: PAT_TA_3141.pep
PFGMGSNKKRSRSAAAPWCVVLGILLLVVGAVAKDLGNIFQDCEFDCQDFDPSSDSYFMCMAVCVFGNGAVHLATDGGTEREDRKMKREAGEDDPFSCEDHCREVFEPDSAKFRKCMRICQA

SEQ ID NO: 108724 - protein, 69 aa, Triticum aestivum
  Clone ID: PAT_TA_3142.pep
CSQNCMYLLPTKLSMNCRFRKLVWHSSKLFALTQIKVVRYHEISNMPLVKPYFKFAICKLGFCFSHFFF

SEQ ID NO: 108725 - protein, 372 aa, Triticum aestivum
  Clone ID: PAT_TA_3143.pep
MKQDSRMAGNSVNLPHATRRRSTLAFKFLIPFVLVLSVSVIAVTQYFQSISYFLRPLWDTPPKPFTRIPHYYAPYMSMHQLCQLHGWGILSSPRRVFDAVLFSNELDVLEIRYHELFPYFDRVPRLRANATFTGIPKSLTFFENLNRPAFASSKIVYDMLPIGELDPDSRRMPFLVEAGHRRALNNLLKRSGIAVGDVLIMADADEIPSPETVQLLKWCDGIPPIMHLELKNYMYSFEYHVDQNSWRTTAHVFTERTKYQHSRQTDLMLADAGWHCSFCFREIKEFAFKMKAYSHADRVKHDIFLNPDRIQRVICNGDNIFDMLPEEYTFSDLFKKMGPIPRSASAVHLPSYLIRNADSYRFLLPGGCLRPG

SEQ ID NO: 108726 - protein, 156 aa, Triticum aestivum
  Clone ID: PAT_TA_3144.pep
LGDVYVFHIYVFVVQYARRQRGNPERRGLLVAKVDAKDRVAIRRLGPNGVYGCTIQYGYADPLDSEEDELTGLVVGALRDYITEEEEEVALLEEAREAGVVHVRGKMRFHIGKDTGFFDRILLGFYEFLHSTCRSALPALGIPLQQRVLIGMLSKA

SEQ ID NO: 108727 - protein, 193 aa, Triticum aestivum
  Clone ID: PAT_TA_3145.pep
AAMHGLPVIATKNGAPVEIHQVLDNGLLVDPHDQHAIADALYKLLSDKQLWSRCRENGLKNIHRFSWPEHCKNYLSRILTLSPRYPAFPGNEDQIKAPIKGRKCIIVIAVDSASKKDLVCIIKNSIEATRKETLSGSTGFVLSTSLTMSEIHSLLISAGMAPTDFDAFICNSGSDLFYPSRAGDSPSTSRVTF

SEQ ID NO: 108728 - protein, 122 aa, Triticum aestivum
  Clone ID: PAT_TA_3146.pep
SAARTAGRPARCRCGGAPAPATRVQWGPVRAGGAPGWGGQAPRGVPVRRIPRGAGRPRPARHSSPGHWEDARDGPVPSRNSLSSVSHAILAALMVRIRTFLRPSHTWMPEAPMGRQAKHYCC

SEQ ID NO: 108729 - protein, 158 aa, Triticum aestivum
  Clone ID: PAT_TA_3147.pep
HASADAWGSCIVCAAVKLPNRSSEVWSPESKKKLKKESGSRSRSRTSCSIAVDAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 108730 - protein, 396 aa, Triticum aestivum
  unsure (1)..(396): unsure at all Xaa locations
  Clone ID: PAT_TA_3148.pep
MALAFDEYGRPFIILREQEKKSRLQGLDAQKANIAAGKSVARILRTSLGPKGMDKMLQSPDGDVTITNDGATILELMDVDNQIAKLMVELSRSQDYDIGDGTTGVVVLAGSLLEQAEKLLERGIHPIRIAEGYEMASRIAVDHLESISTKYEFSATDIEPLVQTCMTTLSSXLLVRCKXRSLPEMAGQRKFLAGTXIGVEGYIGGXIEDTELVQGIIVDKDMSHPQMPKRIEDAHIAILTCPFEPPKPKTKHKVDIDTVEKLQTLRGHEQKYFDVRVQKRKDVGATLVICQWVGDDDANHLLWHWXGGMSVRMLGELPTEMPVRDEGVLLKAFGTRKXRMLDIEKCAKTRAVTTFIGGSNKMMIEEXTKRSIHDALCVARNLNIXSRIPYGGGYDA

SEQ ID NO: 108731 - protein, 149 aa, Triticum aestivum
  Clone ID: PAT_TA_3149.pep
SDAPRQMASTVGLLFVAALACVLGGADAKLAAGSSSAASCRATPAALIDIATSPVFPNAEVGSCGARGRWWPARRPTPTGPSRMEGARDKRAGGVHRPVLAGGGTRRSTSATRSCRRWGSWSPTWQGPLTRLLGGIFHLFPAGFSFHSR

SEQ ID NO: 108732 - protein, 265 aa, Triticum aestivum
  Clone ID: PAT_TA_3150.pep
MEEFISLGASEPGASEGIIDLDHALQVDAVDLNLNLNAQPQGKPSTSTSSLLDIIDLEEGQVASEEASAQHAQGTAADNPHQAKPQQEALGANGGVGPPPSDGVIDLEEGQVEDMDLSDDNALRWYKAAWVAVSAETPKGNNVGPSLSTPTSAFIDQSPTRGVKRARAESTEPSVRVVYNNLTRESKRKLMELMQQWSEWQARKQHASTETVEQVLDCGEETYYPALHVGSERSCAVSFWVDSQARGNAAVDDGAVPLYDREFTL

SEQ ID NO: 108733 - protein, 98 aa, Triticum aestivum
  Clone ID: PAT_TA_3151.pep
IGKGFFNCWEICIPFTSCCCSSACPSLCPFPSPSPSPSPSPSPSPFPFPSSPNPSPSVARSKTKGSGSRHHRHSQMWVFLANQRCASPLTSECCLGDL

SEQ ID NO: 108734 - protein, 199 aa, Triticum aestivum
  Clone ID: PAT_TA_3152.pep
SRRQSRVRESAGEWGVISKLEAAEYKLEELKSNMVGLGKEAVSAMAAVEGQQQRLTLQRLIAMVEAERTYHQKVLEILDHLEEEMVSERQKIEAPPPPAAESYMSPPPPSYDEVNGMFASTSADQAVNSVDFFLGEALDSFEAESEFELNLSVGDIVIVRKISSNGWAEGECKGKAGWFPHAYVERRERVLASKVPHIF

SEQ ID NO: 108735 - protein, 402 aa, Triticum aestivum
  Clone ID: PAT_TA_3153.pep
SPGSLDAGSSGSRVHVFCFDGNLDLVHIGTDIELFVQKKPGLSAYAQDPREAAQSLVSLIEKAREVVPAELRDQTPVRVGATAGLRALGAGKSEEILQAVRDLLREKSSFKNQPDWVTVLDGTQEGAYEWVTINYLLGNLGKTYADTVGVVDLGGGSVQMAYAIPEKDAEKAPKPADGEESYVKKLFLKGTTYHLYVHSYLRYGLLAARAEILKAGNANGYSNCVLAGHQGQYKYGGNTFEASAAPSGSSFSECRADVVKALKVDEACTHMKCSFGGIWNGGGGAGQKNLFVASFFFDRAAEAGFINSNAAVAKVKPSDFEEAAKRACKLNVNDAQSSYPGVQKDNVPYICMDLVYQYTLLVDGFGVDPQQEMTLVKKVPYSDAFVEAAWPLGSAIEVASSS

SEQ ID NO: 108736 - protein, 87 aa, Triticum aestivum
  Clone ID: PAT_TA_3154.pep
DTKTGLYTIVQSTVTKHCLEGEYKSFTFMFPTTQAGSTETKFMSAQQQSKVIQRRVQVQVGMKPSLRSLGLAGRTRGLGECFHLDAS

SEQ ID NO: 108737 - protein, 124 aa, Triticum aestivum
  unsure (1)..(124): unsure at all Xaa locations
  Clone ID: PAT_TA_3155.pep
MEVAAPKQLLPMAPRDPNSPSSSTSSSSPSSAAXPSSHRPSPLPPSPRPVPRTIDTTPFPTTFVQADTASFKQVVQDAHRRRHASAVLAAAGPEPEAPXGRQQQGRRPVPGQEAGFNVYERRST

SEQ ID NO: 108738 - protein, 172 aa, Triticum aestivum
  Clone ID: PAT_TA_3156.pep
VVLAKKSDMAPAAAAEAEAGGNKGKFKVPADDVKLILALKRNDLPSIDYLDDLADLYTPEEIAKRRLRHQSDLELFKRIDDDFEEYQKKVRDSVDKYGYFEVDYDYVEARKKKNAWTKAQWAKIIEDVNITVCAPDADQATLGYIEYVDSDDDAEYDDDSEYYDDSESEDED

SEQ ID NO: 108739 - protein, 282 aa, Triticum aestivum
  Clone ID: PAT_TA_3157.pep
RAILSIVLRMAGKEEELSMEAAGKWMLMPCTAPKSKSMEASEHGPATRFPSKRKAAAGSSYKEGDQLPEGWIDLPSAAGQDDPEAYNLFKFERREAAIDKMLGEAKLSAVVLAKKSDMAPAAAAEAEAGGNKGKFKVPADDVKLILALKRNDLPSIDYLDDLADLYTPEEIAKRRLRHQSDLELFKRIDDDFEEYQKKATPILVRQIWLLCRPIHDYVRTDGKRKMHGPTHIRLRSWKISITLFVPLMMLLSMMMILSTMMIPSLKTKTDFFSVGARAGMED

SEQ ID NO: 108740 - protein, 140 aa, Triticum aestivum
  Clone ID: PAT_TA_3158.pep
DVIKSDSAAVSVPELELELSSGGPGGAAATVEGLIVKICEALERVHGFQLGDSTYEWKKKKWDGFTERLAKLLNLEEPWTLILDDALAASFIAPATDSLEDDKQLTIEEYERSWEQNEELGLNDMDTSSADMAYNTTSTS

SEQ ID NO: 108741 - protein, 141 aa, Triticum aestivum
  Clone ID: PAT_TA_3159.pep
RLVVAGGHLEGNFTLPGGGSQRQSTPRPPPNDPLLHCNRTLADHNIWKESTILLVLRPCSTIGGTMPIFVKTLLGKTHTLEVGSLDTIESVKVKIYEKEGTRPIQQRLIFAGKQLEDGRTLADYNIQRESTLHLVLCLCGC

SEQ ID NO: 108742 - protein, 261 aa, Triticum aestivum
  Clone ID: PAT_TA_3160.pep
FGRGRRLTEGSLWSVAAHKVAKLMAKSVLAVLARVSLAFGALVPGLPPPLTGRGWALGHSSGPMHQSTAPDAAIRHSAPIFRQKDTASTSSEPLKPPASTVARSGAQLRSAFVCLPAVTPLLARSPPHGIGEAHDGMTELAMRDELYKMLPVTIRAAVNEKLRERLRGGQVDEEAAATAMDAVDGVLRWLGPMAHDTLRWQDERSMERKQRFSMQPRAPMVQTLHFADRRKADAAIVEVLVGLSCMCWYDDQRRRPADWNE

SEQ ID NO: 108743 - protein, 358 aa, Triticum aestivum
  unsure (1)..(358): unsure at all Xaa locations
  Clone ID: PAT_TA_3161.pep
RFNAKIDGVEVSGIVEHVGLWSPTVIRGDDREAIYIPNHKFTMSILRNNTRRNHWRIKTYLAISHMDAGKIGIIVADMRKVLAKNHHIEQQKLHRRVFFEKIDPKTQALMIYISCFVKTSHFEEYLNVQEAVMLDLLTIVGHHRARLATQIRTVQKSYGNADIDNIPFGEDTYSPRARGRPLLIDTSARISDDKKPPRPAVAREDQKAKVASVSAVEPKSDAPDASSLNSSEKQEEKKLVPDDAGLKKDHVKTTIPSPTTPXADPVASTTSKTDEGKAQGSEGQGDGSSVATPKKESSRPAFEDNIVLGVALEGSKRTLPIDEGMNPHLSLSEPEQDAGSSPKKKGQSYSLSGQEKAD

SEQ ID NO: 108744 - protein, 327 aa, Triticum aestivum
  Clone ID: PAT_TA_3162.pep
RAGRRSGFFDSPLPFLFGRVGTLCTVELPPASGWLAPRLFVGGAPPAAVHPAGLAIEYNRKPEEEEASTPPPPPPQVSTSEKEPAPVPAPLGLPRVQPLDLLGMDEPIPDTAELDQKNALALAIVEPDNARKAAAGSENVATSWELALITEPSASENVATSRNLAGGMDLLTLDSLYDDAHQHAQQNVSYNPWEQPAPASAPMMQQQYQQQPMHNPLYASAQQQQAFMLQQQQAFVLQQQHQYQQMMMMGAPSLHRQASSNPSLHRQASSNPSLHRQASSNPSFHRQGSSNPFDRSYVPAAAPGGGYPYAPAMQLHTGNAYTGTGMM

SEQ ID NO: 108745 - protein, 126 aa, Triticum aestivum
  Clone ID: PAT_TA_3163.pep
FEATRTWGSRSCEIACITTNRGQNRCDQSNRAVDYWACNCETILATACAEIGFIGPATARRSWPRPAPRWATGSARTGSPTLPPRPTALPSSPPLPHSPSPSRRSHSPSPLPAPARAHSPSAPAPS

SEQ ID NO: 108746 - protein, 320 aa, Triticum aestivum
  Clone ID: PAT_TA_3164.pep
MDREWGSKPGSGGAATAQNEAIDRRERLRRLALETIDLAKDPYFMRNHLGSYECKLCLTLHNNEGNYLAHTQGKRHQTNLAKRAAREAKDAPAQPQPNKRKLAPRKSVKIGRPGYTVTKQYDPDTKQHSFLFEIEYPEIEDNSKPRHRFMASYEQKIQSWDKRYQYLLFAAEPYEVIGFKIPSTEIDKSTDKFFSYWDPDKKSYILQLYFKPRPPEINRQPAAPGTVPNGTGGPPGAPPRPPSQPQALPPPPPNAPMGMPPRIPPPPMSGLQPPPPPPPLANGPPRSIPPPPPSGGPMANFTPGAPPPRPPMQGYPGPQQ

SEQ ID NO: 108747 - protein, 173 aa, Triticum aestivum
  Clone ID: PAT_TA_3165.pep
RDPKCVPPKIISGHRFTAISQHQSAVRDYLEAYKLDSENPLINLCVGSSLINLSLGFRLQNKNQCIVQAFAFLYKCLRIGSNRQEALYNIARAYHHVGLKTLAAIYYEKVLAMEVEDHPIPKLPFEEDFHEHQALRPGYCDLRREAAFNLHLIYKESGATDLARRILKTYCSI

SEQ ID NO: 108748 - protein, 124 aa, Triticum aestivum
  Clone ID: PAT_TA_3166.pep
HASAHASGEKHSMAYNQTAFVLSCKTMLYSLRKPPKHFETLVVHHFHERERAILDACSAYASGIIVGSSVRDGAKYACDKCFAGFKKSLDAHTELLAKELAKNRAQALELKGDTPAADEIASTS

SEQ ID NO: 108749 - protein, 261 aa, Triticum aestivum
  Clone ID: PAT_TA_3167.pep
MAFTREDHERWTKTIQNEWKLLQRDLPGSIYVRVYEDRIDLLRAAIVGPSGTPYHDGLFFFDVCFPPEYPRCPPKVHFHSSGLRLNPNLYESGKVCLSLLNTWLGSGSEKWGKSNSTMLQVLVSIQGLVLNDKPYFNEPVIFSSKEKHSLGYNQTAFVLTCKLMLYLLQKPPKHFETLIVCHFHERERAILEACRAYASGMVVGSSVKDGRTYLRNKCFAGFKKSLDAQAELLAKELAANRLRALQLKRGVPAADKTMSTS

SEQ ID NO: 108750 - protein, 149 aa, Triticum aestivum
  Clone ID: PAT_TA_3168.pep
CRHTSTPHRPTPHHTSTQTMRNAALDAQMNSGGASSSPMIPPPFWSTPTPYLFIGFAVVMSLIAVALAVLLCSRRREGGREDEEAVPAGMMSVRVLTPLDREVPKVVVVMAGDDMPSFLASATPLAFAEAAKVQRPYCQCGAKDVAAPV

SEQ ID NO: 108751 - protein, 214 aa, Triticum aestivum
  Clone ID: PAT_TA_3169.pep
MGGYGDLFEKAKPYIAMICLQFGYAGMNVITQVSLNGGMSHYVLVVYRHAFATVSIAPFALILERKVRPKMTWSSFLQIFVLALLGPVIDQNFYYVGLKYTGPTFACAMSNILPAMTFVMAFIFRMEKVDLRNLRCQAKVAGTVVTVAGAMLMTLYKGPLMRMAWTSHGQAHGGEAPAVDPTGREWFLGSLFIIIATLAWASLFILQAHTLKQY

SEQ ID NO: 108752 - protein, 165 aa, Triticum aestivum
  Clone ID: PAT_TA_3170.pep
MQLINHHPHTHTRTAQLQFTLRLSVEEVQQRGRPGLRRVAAGFLAARRGGVLVRRAASPPAGQRRRQGRQAEVQIARRQHRPRQLHLLPSCGAAARVVLAPLPGGRGRGVLRRGVEGGGAAGVCADVAVEAGHVAFREGGGHGGERAQGVTAQHGVGGGLAEVTT

SEQ ID NO: 108753 - protein, 235 aa, Triticum aestivum
  Clone ID: PAT_TA_3171.pep
PVRNFRVDPRVRDCHENKEHALRIKDAETSGLGSSSGKDAMIGRVGGNEGGNDERTSGEGVSPMAQELVEPAPDNVHIDAVFITEVSGSMSQSDFHSSLMASERIVPGLEDGEAALRRTSSRDVLSSERSDVSQSSLTSVLPATSSASSIIGESIPDATASREDVPTIFSVSHGQIGGSTVHEDMVSIFSNDGPEHSRDSSNGETRRNHRRVLWDSFSRRGSRGYLDSDTDDLGF

SEQ ID NO: 108754 - protein, 103 aa, Triticum aestivum
  unsure (1)..(103): unsure at all Xaa locations
  Clone ID: PAT_TA_3172.pep
KASKTLTLSIPIPPIPNPPPPSPPNPIPDLPPASPPRRWQAPPAPPPPXPQPAQRRPLLLPAPPPPEPAAPAAGPAEPPPPDXCPCSPRPPPPGGRRPRRPQL

SEQ ID NO: 108755 - protein, 153 aa, Triticum aestivum
  Clone ID: PAT_TA_3173.pep
CFAAGAGGFRRGYCLKRGRADQERKKGVPWTEEEHRLFLKGLKKYGRGDWRNISRNYVTSRTPTQVASHAQKYFIRLTSGGKDNKRRSSIHDITTVNVPDDDDRGSPSGSPPSALTTVDTKPSPSYGGQRHAFVPPTLQPGTLGGGHPYGSVK

SEQ ID NO: 108756 - protein, 118 aa, Triticum aestivum
  Clone ID: PAT_TA_3174.pep
MGCAGSTPKGAAAAGGEATKKVRKPKPWKHPQPITIAQLRQMRDEFWDTAPHYGGRKEIWDALRAASEADVALAQAIVESAGVIVSNADLTLCYDERGAKYELPKYVLSEPTNLVQDS

SEQ ID NO: 108757 - protein, 118 aa, Triticum aestivum
  Clone ID: PAT_TA_3175.pep
LFFTEKPLLRSHVTINHCIVFPITQWTYITIPYKPNHYFLQWLLPTNWELRRYTGQEGTSSRTATARQSRRRSPSLTKRNSSSASILISNSILACVGDKCAFTSRNLSICPEQSRPSS

SEQ ID NO: 108758 - protein, 318 aa, Triticum aestivum
  unsure (1)..(318): unsure at all Xaa locations
  Clone ID: PAT_TA_3176.pep
MAPAPPPPRPPPPRPPGPSPPPPPPAAARRRLRGAVFKTATLKNQIRSTERLLRKDLPHDMRVAQEKKLXQLKRQQEKQTQEAMQRTIQLRDRKIKFFERRKIERMIRRLDKQQRLNADEASNKWATLREDLEYVRFFPKKEKYFPLFTGGNTPDVVEKRNTWRKQIKENLIAEAANRKDLEETASDDVTVDGSEDDFFMSGSSSDEEADDELTDKSTWGPRASATAASGMSSDEKNQRQRDARVLMPPPRSLPPNRARSADKRAVSSSSNASTSTSGNSFKNRRASNLSGDHNSTLSSNSDAHKPRRKRRPKKKKQA

SEQ ID NO: 108759 - protein, 78 aa, Triticum aestivum
  unsure (1)..(78): unsure at all Xaa locations
  Clone ID: PAT_TA_3177.pep
DNLFSXHRYIYRSPPLGTLTRARTHTHINQYKVVIQFPVLISMTNHVMARSATVALVHKLLGRRLAASWLTLHKSFIP

SEQ ID NO: 108760 - protein, 90 aa, Triticum aestivum
  Clone ID: PAT_TA_3178.pep
MASTTRKEEGPDKQQQQGSTRLYSRMLSKDVAIAVPSFRVYYGVASAGSVPFLWESQPGTPKSSPSAAALPPLTPPPSYYAAGGKGGSKR

SEQ ID NO: 108761 - protein, 182 aa, Triticum aestivum
  unsure (1)..(182): unsure at all Xaa locations
  Clone ID: PAT_TA_3179.pep
FKPLVGTTDRPPRRPPKPRKKMATSATFLHLLAPPGLRPKPILRPRLRRLALSVSPSGPDEIPADDPPVLPSILVKNTEPEDVARRRSWVEHGWAPWEEAMSPEVAFARHSLNEGEEVPLTSPESVEAFRMLXPAYREKVESXPGYSRLFIMREKPDPXETRWXAGAXSXPAAGWAPPGWKW

SEQ ID NO: 108762 - protein, 172 aa, Triticum aestivum
  Clone ID: PAT_TA_3180.pep
QGAGAPTIFQAMRRIVDSLMHQSMGEGALERALTSSFLVSADMAHALHPNYPDKHEEYHRPELQKGLVIKHNANQRYATSAVTAFLFKEIARIHNLPVQEFVVRNDMGCGSTIGPILASGVGIRTVDCGIPQLSMHSVREMCGKEDIDTTYKHFKAFFEMFSDIDQKLNVDF

SEQ ID NO: 108763 - protein, 149 aa, Triticum aestivum
  Clone ID: PAT_TA_3181.pep
MQILVRCGCGEAACPEWAVVEVQGVLQPQPCFSGRIQGLHIGRLCSTSSAPTSKGGYTFTVGYHELAGSKVTLKKPLLVLRKKKNDKGDAGELGQGGQAAAEVELEVIGIIRHKILFKDRPKALISKPVPKEKKALPAAATPSTVPPAS

SEQ ID NO: 108764 - protein, 96 aa, Triticum aestivum
  unsure (1)..(96): unsure at all Xaa locations
  Clone ID: PAT_TA_3182.pep
MITGTDFYHVMTAMVPLYVAMMLAYGSVKWWRIFTPDQCSGINRFVALFAVPLLSFHFISTNNPYTMNLRFIAADTLQKLMMLAMLNAWSXLSRRG

SEQ ID NO: 108765 - protein, 197 aa, Triticum aestivum
  Clone ID: PAT_TA_3183.pep
MASSPGVGGGGADGGVGDGPTTLDELYHINVVPAELHFKFRKELQGLRVGLNFEFYNLEVNDFEAKVVLKPLDFDRKWKFQYKPISGDIQLLSKKIPVTKYLNLQVGIGHNFQLKATGWKWKLSTCLGGDGVSQIRNKSKLNLFPGFDLRLGWKAEYVLPEIHGAVGTGEPAFSMNYGRLQASIDRVEAIVTQSDRC

SEQ ID NO: 108766 - protein, 53 aa, Triticum aestivum
  Clone ID: PAT_TA_3184.pep
VVVLPLDSLRKGGIMSVISVGMAKYAIAQILILLFYLWVKLILLILASCAVLS

SEQ ID NO: 108767 - protein, 146 aa, Triticum aestivum
  Clone ID: PAT_TA_3185.pep
MAGRKGGDRKKSVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKVATKE

SEQ ID NO: 108768 - protein, 126 aa, Triticum aestivum
  Clone ID: PAT_TA_3186.pep
MARTKQTARKSTGGKAPRKQLATKAARKSAPATGGVKKPHRLRPGTVALREIRKYQKSTELLIRKLPFQRLVREIAQDFKTDLRFQSYVVSALQEADEVYLVGLFEDTNLCAIHAKRVTIMTKDIQ

SEQ ID NO: 108769 - protein, 142 aa, Triticum aestivum
  unsure (1)..(142): unsure at all Xaa locations
  Clone ID: PAT_TA_3187.pep
SFTRPRTRGLAHASYAFNDYYQKNGQASSACDFSGAATIVNQAPSGRCDPSPSWCVANAAVGAARLQNALDYACVHGADCTDIQPASTXCFDPDTKVAHASFAFNDYYERHNQAAGTCDFAGAGTIVRQAPKIGNCVLPSRA

SEQ ID NO: 108770 - protein, 320 aa, Triticum aestivum
  unsure (1)..(320): unsure at all Xaa locations
  Clone ID: PAT_TA_3188.pep
MILSAFLLLCCAVATWTVSPAKARQSQSPSPVIGADHHQAYGTLDQVKAALQRVGLESSNLIIGVDFTRSNQWTGKRCFGGRSLHHLAAGPNPYEEAIGIVGDTLSAYDEDNAIPCFGFGDTAXSTHDQGVFSFYGDGRPCAGIPEALLRYREITATVQLSGPTSLAPIIEAAMGVVQRSGXKYHILLIIADGQVPRGCGAHRASSLDESRSENDMEERTLQALIQASHFPLSIVLVGVGDGPWDXIRCGSTTGRRRFDNFQFVDFTKIMSAEMSRAEKGERFALEALEKIPSQYAAIISQRISDLAARAPARTPLPPPS

SEQ ID NO: 108771 - protein, 475 aa, Triticum aestivum
  Clone ID: PAT_TA_3189.pep
MVRNRIQSMEEEYASKVAKLCFQEADGEEEEEDRGAQDAGELARPLPPQLEILVAIKPGPAAFVTGNDRVPSSELVEMFLMTRCRNLNCKSMLPVDDCECKICSSNKGFCGACMCPVCHKFDCAANTCSWVGCDVCGHWCHAACGLERNLIRPGPTLKGPIGTTEMQFQCLGCSHSSEMFGFVKEVFNCCAENWNAETLMKELDVVRKIFAASDDFEGKGLHAKAEEVLSMLSKKVISLPDALNNMLQFFKYGVTDCSVTGSKSKGILAANQASQSTIPLLSPTISPPKSFNFNASTSILDSQIDALKTSPKSLSIEPRFGSSSNPLAIEPRFGASSKPLSVDSRFGASPKPLSIEPHFSTTSKDDEASTLETVVKCKEAEAKLFQKLADDARKEVENYPLVGRAGALCLAEEAASEVAGRCVRVAGEASRNGLGELPPLADSPYDGLKACRRARTENPRALASSGMEATKKMWV

SEQ ID NO: 108772 - protein, 327 aa, Triticum aestivum
  unsure (1)..(327): unsure at all Xaa locations
  Clone ID: PAT_TA_3190.pep
MALASLPKVVLGSIAFAVFWMMAVFPSVPFLPIGRTAGSLLSAVLMIVFHVISPDDAYASIDLPILGLLFSTMVVGGYLKNAGMFKHLGTLLAWKSQGGRDLLCRVCVVTALASALFTNDTCCVVLTEFVLELAAERNLPAKPFLLALASSANIGSSATPIGNPQNLVIAFNSKISFPRFLIGILPAMLAGMAVNMVMLLCMYWKDLEGVAPDAAGKQMSVVEEGGRSPSVASLKSPHPFNGTTADDGNESMMEENISTKHPWFMQCTEHRRKLFLKSFAYIVTXGMVVAYMAGLNMSWTAITTAIALVVVDFRDAEPCLVKVSYSL

SEQ ID NO: 108773 - protein, 42 aa, Triticum aestivum
  Clone ID: PAT_TA_3191.pep
ECSSASNVYGRRSPQPARPNGIRLRTSPPIPGILKGRVKHEH

SEQ ID NO: 108774 - protein, 115 aa, Triticum aestivum
  Clone ID: PAT_TA_3192.pep
PNLPTVLLDDIAGRLLLYDVAEYIRLRAACKEWRNCTDDPRAGGGLDCRFRPRRWIMLSNRTEGDGRRFLNDSTGASACVDLPELSRHHLETSTEGLLLLRGKASHAVRLFNLLT

SEQ ID NO: 108775 - protein, 198 aa, Triticum aestivum
  Clone ID: PAT_TA_3193.pep
STAALRLFPSPSMGVGVAAPAVPAAFDLNNAAEIQDLAPAALGTLEAARAPNLVLGQPAEEEEAPPPVLTASPRRSPRIRRAYDGVRVGSVERAAKRKAVATGSDSSLGSSRRSGSSWRRKKVKTVAVSELLELPLLNTPSPLTRGKLKQIAQCCDLNANAILEQAKDRAVSVSSGDASNSASASTGSPACVFNSFNG

SEQ ID NO: 108776 - protein, 188 aa, Triticum aestivum
  Clone ID: PAT_TA_3194.pep
MAAIKLVSLSLVVLLSIGLASATRVVRYASSTGTGSGVGNGGGTVNGSGGGTGSGNGNAYSGSSGAHANAGGGGSGGGASQDGGTGHGAGSGDGSSSSYTSDGRYSYGGDSYAGGNGAGSGGGQAAGPGSSGYGAGGGAGSGSSAASGGWYPYANANANGNGGGIGTGQNGGSGGGTGGGSGNAGAYP

SEQ ID NO: 108777 - protein, 774 aa, Triticum aestivum
  unsure (1)..(774): unsure at all Xaa locations
  Clone ID: PAT_TA_3195.pep
RDRKYHSPLQTDGRSETACLIADPVILLPPAGEVIEVENSEPGSPDVGSRSSGSGRSSSEYSGWVYHLGVNSIGHEYXHLRFLVIRGKCVAMYKRDPHDNPGLEPIRRVNVGHTLVVEEVGRKKVNHGDVYVLRLYSRLDQTKKGEIACATPGEAQKWTEAFEQAKQQAEYDLTRGANWNRLQSENEFNLDGHRPRVRRGLGKLVRIGKGPEMLLRQSSDLQSHERVNTNFGGDTGDALEAHEWRFVRTLNDSPISVEIANAGRGKGILRGSIGVVGANPDSVFEMVLSRDKHKRHEWDMLISDLELVETIDGYCDVVYGTYEPKYLNWWKSKKDFVFSRQWFRGHPGAYNILQSPASHKQKPPRHEYERTHINPTTWEIKRLNTSESTPKCIVTRMVEISPSFWDRWRRRTSSNFERSIPFALLSQVAGLREYFAANPAITPDFPSTVVKSKVSESLIIQSELEYSEPNDEFYDALVRGESFEGDSDDDDNDDDDVTTPKAGKVKLKNVSWAIAGLAMKRTKASLERSELVTNSIPIAIDTSHFHGTVRQAKSEDDPNSWSSPGGEKFMIRGKTYLTDYAKIAGGDPLLKLIAVDWFKVNERFDSVALHPKSLVQSEAAKKIPFILVVNLQVPAKPNYNLVMYYAAEKPVNKDSLLGRFIDGTDAFRDARFKLIPSIVEGYWMVKRAVGTRACLLGKAVTCNYLRQDNFLEIDVDIGSSSVARSIIGLVLGYVTSIVVDLAILVEAKEEKELPEYILGTVRLNRVNPEAAVPI

SEQ ID NO: 108778 - protein, 155 aa, Triticum aestivum
  unsure (1)..(155): unsure at all Xaa locations
  Clone ID: PAT_TA_3196.pep
MRLALKSTGKKRAAPDDDDDDEIEMDPEGRMIIREEREWRKKKPVVSHEEEADDKTSVRSQSVKRRKVASTGWSYTGHEYTSKKAGGDLKKKDKMEPYAYWPLDRKLLNRRSXSQAVRXKGMASVMKMAKRFEGKSASGALAAKRTQKHKQKKNK

SEQ ID NO: 108779 - protein, 351 aa, Triticum aestivum
  unsure (1)..(351): unsure at all Xaa locations
  Clone ID: PAT_TA_3197.pep
SCDHFSSTPRSDVARHENQRRFQTTPVYAIEDRNGRHRMLKYTPEHMHCFAMFWGPLAPPKSGVLAVQSLSSNKVPFRITATGWVQEFNNTARIMKKIKLTGAPCKIFKKTALIKXMFTTDFHEARFEGAAIRTVSGIRGQVKKAAKIEPGDALRRKGEITEGIARCTFEDKVLMSDIVFMRAWVNVEVPTYCNLVTTSLQPRDQMWQGMRTTAELRKAHNIPIPHNKDSVYKGIERKVRKFNAIEVPRKLQPLLPFKSKPKDRPKGKKGSAVDMIPEIMNIGEKKIHGALQQLHLLKHEKTRKEKIKRGLQKKAHEAQKAKTDEITRKRQREDRRERYREEDKKKKRARK

SEQ ID NO: 108780 - protein, 167 aa, Triticum aestivum
  Clone ID: PAT_TA_3198.pep
MSSHRVKWNEDNLYEIESNKPVRQKITEPKTPYHPMMDEDGSLSPTRPFDKCLDETVSAEAILTALNGVASSSKNDSKDDEWASSDDDADAMEQDGDSEADRSSVSFKEHRRNHYDEFRKVKELMRTGSLVEDEARANERAANNVEDKTAGEKATGDKSESSASPQV

SEQ ID NO: 108781 - protein, 122 aa, Triticum aestivum
  unsure (1)..(122): unsure at all Xaa locations
  Clone ID: PAT_TA_3199.pep
MSSMDGIINTVSANIPMXPFLGLLKPNGKMIMVGLPEKPMEISPFALVATNKTLAGSLIGGMRDTQEMLDLAAKHCVTADIEVIGPEYVNTAMERLAKADVRYRFVIDIGNTLDKTAAATTE

SEQ ID NO: 108782 - protein, 377 aa, Triticum aestivum
  unsure (1)..(377): unsure at all Xaa locations
  Clone ID: PAT_TA_3200.pep
ELPVRPAVTPAPTAAAAEQSQQHTKKAVGLAALDASGHLSPLAITRRSTGDDDVVIKILYCGICHSDLHSIKNDWKNAKYPMIPGHEXPGGGPGVGKNWTKFKAGDRFGVGCMVNSCQSWRGCDKGFREPLPGHNPHHRDGTLTYGGYSSMVVVHERFVVRFPDAMPLDKGAPLLCAGITVYTPMKYHGLNAPGMHLGVLGLGGLGHVAVKFGKAFGMKVTVISSSPGKKQEALERLGADGFVVSKNADEMKAAMSTMDGIINTVSANIPMAPLFGLLKPNGKMXIMVGLPEKPIXEIPPFALVAKNKTLAGSFIGGMRDTQEMLDLAAKHGVTADIEVIGAAAMERLAKADVRYRFVIXDIANTLDKAAAAPPTTE

SEQ ID NO: 108783 - protein, 218 aa, Triticum aestivum
  Clone ID: PAT_TA_3201.pep
MSSSMYPKRRSAVTACSIKLPSGLTACSSKRPRLIAAAAISYPSSWASLQADLVRLIGWRVLASDLRDYVRFRAVCPHWRSSSVCPRGRGVVDPRFHPRRWMMLPEGHGLYPGHGRLHGYIRFINLSTGAIVRCLLPLFRDHCILDSVDGLLLLQRDEDTAIRLLHPFTGDIAELPPLATLMRLPGAKKNVEMVWTYLRNIGATSVSVSAAGVITCMI

SEQ ID NO: 108784 - protein, 183 aa, Triticum aestivum
  Clone ID: PAT_TA_3202.pep
MAGRKGGDRKKAVTRSVKAGLQFPVGRIGRYLKKGRYAQRVGSGAPRHLAAAPVCLAPVARARPRLAPARYRLARSVPRRPRLAVPPAPHRGWLRPGRSGPPARGRPCRGAVLSSLLRAKVCPALAGRRWRHLRASFPFLKAPSWSFFDTLHSRIWFFGRKPRPIWVGQRRRPRGVSPFGALL

SEQ ID NO: 108785 - protein, 210 aa, Triticum aestivum
  unsure (1)..(210): unsure at all Xaa locations
  Clone ID: PAT_TA_3203.pep
FLDPAWPHLQVVFELFLRFVQSPETDAKMAKRYVDQGFILRLLDLFDSEDPREREYLKTILHRIYGKFMVHRPFIRKAINNIFYRFIFETEKHYGIAELLEILGSIINGFALPLKEEHKSFLVRALIPLHKPKCVSMYHQQLSYCVTNSVEKDASLLDTVIRGLLXXWATTNXSKEVMFLGELEEXLXXLNPARFPEIMVPLFXQIARCL

SEQ ID NO: 108786 - protein, 327 aa, Triticum aestivum
  unsure (1)..(327): unsure at all Xaa locations
  Clone ID: PAT_TA_3204.pep
KRXAAAASVKGALHGQTLTRSGLRLATHGELTRLSGLVANLITAGHGREAAFAAAVLGDNALMEKAWQDTGMLAEAVLHAQAHGRPSLRSSVITWNKMLQKELDHTPTVKTDAAAAFLASLEDPKLTSLGETEKKPPIEILPPGMPPLSAPPIIIKKAAAKPGLPNAAQTPTAGAPMNQGTPMAQGTPMNQSPPWPRGPPLARPAPMAQAPPAPAQSTDEVKPSEATTAPDNVEATAAXXNAEATAAPGTAEATEAPVPDPTSSSPDAADAPAPAPAPAADSSGTDALAVTPSDSTNDAPSSKEPETQDKPPSTEASPSPPPSISAV

SEQ ID NO: 108787 - protein, 205 aa, Triticum aestivum
  unsure (1)..(205): unsure at all Xaa locations
  Clone ID: PAT_TA_3205.pep
SQSSFLLSFPTRIFTQRIHLKVLYKRSLEAGKPSCSVRPCRSEGEGAAGAGQPEPPGGRRGRRRGPRPGDLGGGGGRRRAGGGGGRAAGGGAADAAPGPRRRAQAGPARERAIGAGITAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 108788 - protein, 175 aa, Triticum aestivum
  unsure (1)..(175): unsure at all Xaa locations
  Clone ID: PAT_TA_3206.pep
PPPRAVAPPPXPSAASPSPSPSPAAAPSFPPAAPKPPXPLPPFLPPRPPXAFAPRSPLPPPSTPPLPPPAPVPDPADLGRPASPPGRQVPATPVRSVRCCPWRGASVPGAIPLLCVVATSALIPSPRCGAGRTTTVMLFSMCLGYYPPTVVNSNHLESENSMFSIIEVEGIMVTA

SEQ ID NO: 108789 - protein, 103 aa, Triticum aestivum
  Clone ID: PAT_TA_3207.pep
MTSKYTQEMQTIDELLNERNVIHASYTNNPPLKRTSSRNKSKSSPSFKFDEEKNQRKEKKVKDQHMEGCGSEDDDSSEKKTKERSARKRWLNIPFKVDRRKPC

SEQ ID NO: 108790 - protein, 175 aa, Triticum aestivum
  Clone ID: PAT_TA_3208.pep
MVFLQEEMSWNVLISPDQLSPKGLLLRKSIIVRLLEDVTNRKASKEHGYYIAVNELKTISEGKVRELTGDVLFPVTFTCITQRPMKGEILVGSVEKILKHGVFLKSGPIESIFLSEKSMSDYKYMGGENPMFMNDHSKLERDTAVRFKVMGFRWMEADRQFQLLASLAGDFLGPL

SEQ ID NO: 108791 - protein, 198 aa, Triticum aestivum
  unsure (1)..(198): unsure at all Xaa locations
  Clone ID: PAT_TA_3209.pep
AARSFPTSSTARLSSRRGVASEEERCLPASALSASTAARLKPPPRPMRRLLPRXRKKRVVSGVQPTGMVHLGNYIGAIKNWVALQDLYETFFFIVDLHAITLPYDAPELSKATRSTAAIYLACGIDSSKASIFVQSHVRAHIELMWLLSSSTPIGWLNKMIQFKEKSRKAGNENVGVALLTYPVLMASDILLYQSDLV

SEQ ID NO: 108792 - protein, 118 aa, Triticum aestivum
  Clone ID: PAT_TA_3210.pep
GTTIRLSVIFSGWEAIQSSNLSSSIENLTCTEGSEMVQTIPLWELHLPAAFIFLSSRSIAFLLASSTCSSPGMFFSADPRLGLPTLLGELLRRLFPPGAPFGDPTGLEPIVQFWLTLV

SEQ ID NO: 108793 - protein, 167 aa, Triticum aestivum
  Clone ID: PAT_TA_3211.pep
NREIRNLVERVRLLILELAKANVNENGAENAATHNGLLRAIVNGAHGAGHGGTAGDFIVGNCKTIYFAGHETTAVTAIWCLMLLAKHPEWQERARIEALEVCHGRSTLDVDALHRLKILTMVIQETLRLYPPASLMMREALTDIKIGDLDVPRGTIVQVTRSMLHLD

SEQ ID NO: 108794 - protein, 45 aa, Triticum aestivum
  Clone ID: PAT_TA_3212.pep
LNILCFSLEYLKEPANSTIHTMHIISQVKFFRKFTAHFNPLDLYT

SEQ ID NO: 108795 - protein, 145 aa, Triticum aestivum
  unsure (1)..(145): unsure at all Xaa locations
  Clone ID: PAT_TA_3213.pep
MVLLVPGEFDRADGLSSPRCGWVNGPIVLSAGPAGIVVADMLREQGVPFVGLERDDCNCIGSLWQRRVCDRXRLHLQAVLPPPPAFRAPRDLPHQARHGAGAPRREIGGTVVRPAVASSSGAGRSLVVAAAACGTSLARHALGTL

SEQ ID NO: 108796 - protein, 118 aa, Triticum aestivum
  unsure (1)..(118): unsure at all Xaa locations
  Clone ID: PAT_TA_3214.pep
VVLLELLTGRKSLDRSRPVREQTLTDWAFPLLAHRKKVLGIVDPRLAADDYPVKAVHKTAMLAYHCLXVRNPKARPLMRDIRRHPLSPGKQQPQPQPGRGGGVSPATASAGRVGVGVR

SEQ ID NO: 108797 - protein, 152 aa, Triticum aestivum
  unsure (1)..(152): unsure at all Xaa locations
  Clone ID: PAT_TA_3215.pep
PPPLRRISPASPPKPPPPTAXHPGSGLQLSRHTAASPPLPPLNPRRRPWRPPPLNPTAAPPXTPPPPPPSPGALPSPSSPPPSPAASPMASPPSPRTLGPPAPPYSAPSVRAWRHRGRPEYVPDRTRRPQLRSQSSTTTAPATGAAIPRGAP

SEQ ID NO: 108798 - protein, 255 aa, Triticum aestivum
  unsure (1)..(255): unsure at all Xaa locations
  Clone ID: PAT_TA_3216.pep
MPGAVKVFGSPTSSEVARVLACLFEKDVEFQLIRVDSFRGPNRMPQYLKLQPHGEALTFEDGNVTLVESRKILRHIADKYKRQGNLDLIGTGALERSSIEQWLQTEAQSFDVPSADMIYSLAYLPRTMPLDRRNDAGAGAGRQQKQQRDMMMSPSHMQKVEEMKQLFEKSSRDLSKVLDIYDQRLEEAEYLAGDKFTLADLSHMPNADRLASDERSARLIQSRRNVXRWWADVSSRESWVYVKSLQRPPSAEAPF

SEQ ID NO: 108799 - protein, 318 aa, Triticum aestivum
  Clone ID: PAT_TA_3217.pep
MDAVELSWGARCAGLAFFVLSVLVVALAAVLLLVRRWPWCSCHVCRTYLTGSWAKDFTNLGDWYAHLLRESPTGTVHIHVLGCTVTANPANVEYMLKTNFENFPKGKRFSALLGDLLGGGIFNVDGDAWRHQRKMASLELGSVTVRSYAYKIVAHEVETRLLPVLTDAADKGKVVDLQDVFRRFAFDTICKISFGLDPGCLDLDMPMSDLANAFDTVSRLSAMRGAAASPLVWKMKRMLNIGSERELKKAIKLVDDLASAMILQRRKLGFENSHDLLSRFMASDGDVHAMDDKYLRDIVVSFLLAGRDTVAFALTTLF

SEQ ID NO: 108800 - protein, 241 aa, Triticum aestivum
  unsure (1)..(241): unsure at all Xaa locations
  Clone ID: PAT_TA_3218.pep
MASKAIRRRPTEKERERHMETTMPESVTAPLLGNSAQGNKSEGYEPIPDFWDGKSRECLHWVHIVSTFITQSARKIVNAISEFGSFLARFFGCSRAPQSSQNAQTMLIHLSPLQEERLKFLRQRLNVPFDCSAVKHQDALKELWRLAYPNRRTPPPGNQFYGRKWGWQNPDPTTXLRXGGSIPWGNLIYLQEXTSSFHPVLHKXNGERTEWETFAVTGVKTKCNQSGLHQNRXGKPNGCQH

SEQ ID NO: 108801 - protein, 217 aa, Triticum aestivum
  unsure (1)..(217): unsure at all Xaa locations
  Clone ID: PAT_TA_3219.pep
PRGAASPPPARRRATSRSAQPQRDEVIRRXTVYVSDIDHQVTEEQLAALFINVGQVVDCRMCGDPNSVLRFAFIEFTDEEGARAALNLSGTVLGYYPVRVLPSKTAIAPVNPTFLPRSDDEREMCARTIYCTNIDKKVSQADVKLFFESICGEVYRLRLLGDYQHNTRIAFVEFVMAESATAALNCSGVILGSLPIRVSPSKTPVRPRAPRPMILEL

SEQ ID NO: 108802 - protein, 340 aa, Triticum aestivum
  Clone ID: PAT_TA_3220.pep
QCDLVKVSWLPDFYAIPPEIQIAGSHASQQGKIYGIDAASGAAILALDVQPGDHVLDLCAAPGAKLCMLADMLGSSGSLTGVDVAKHRLAACRTMLQKYSLGDRSRLFVADGTSFSILPVNSNLGSMEAFVGIEDNGSIFSEWTSKRSWKDRQKSKKAKAAGSPHLPSTSEPELIYYGKDSGLIGLQKRYVLHPSTDAAACTSGYDKVLVDAECTHDGSIKHIQKFEFWGWKTLDRRVLNVERTGNLLHLQLGLLTNGFKLLKTGGSLVYSTCSLTVAQNENVVQQFLSKHPSAELLKINPADSWPCRSGGIQKTLRFDPATSQTSGLFVAKFVKLRCSL

SEQ ID NO: 108803 - protein, 486 aa, Triticum aestivum
  unsure (1)..(486): unsure at all Xaa locations
  Clone ID: PAT_TA_3221.pep
GGGLGGGDVVQHDPEGAGRRQGPDQHRARQGHQQHRAGARRAHRQDHQPRRRAGRGAPHPRDPPPHRIPRTRGRVLGRMHHLQQLLDRFLACRPTGGAKQSRMVLVALYQMARESFQLYADICEVLAVLLDRFLDMEYADCVKAFEAYASAAKQIDELCSFYAWCKDTGVARSSEYPEXVQRVTDKLLETLEEFMRDRAKRPKSPPQEPEPEPPEPVKEEEPEPDMNSIKALPAPEDYKEPEPEKVEEEVKPEPPPQPQGDLVDLREDTVSADEQGNRLALALFQGPPAAGGSNGSWEAFPSNGGNEVTSAWQNPAAEPGKADWELALVETASNLSKQKAVMTGGMDNLLLNGMYDQGVVRQHVNAQATSGSSSSVALPAPGQKTQMLALPAPDGSMQNVGGDPFAASLTFAPPSYVQMAEMEKKQQFLTQEQMMWQQYQRDGMQGPSSLAKLDRTYNNGFGPNPAMPYGMPNAPMANTGYYYPTY

SEQ ID NO: 108804 - protein, 166 aa, Triticum aestivum
  Clone ID: PAT_TA_3222.pep
SLVGLRRAMHPIDVAGKVCQHDEARAIACSMPKLRHLEIGYMLIATNAVVEIASRCRDLSFLDLRGCWGVDDKLLQDKYPGLKVLGPRVDDCYENSFLEECSDDSDDDSIYSWEEFMDDEDYFAAGSDDDEALWDDGHALEGLEVRFYGGGFGEGAFAGFDWPESP

SEQ ID NO: 108805 - protein, 226 aa, Triticum aestivum
  unsure (1)..(226): unsure at all Xaa locations
  Clone ID: PAT_TA_3223.pep
GVEHQLNDRVIRGAPMDRHSRFWKGADVLVFNSYLWWMTGDKIQILRGADNDMSKDIVEMGAEEAYRLVLHQVVRWLDGNVDPKKSRVFFVTASSTHASGQLWGDEAEGSNCHGQTKPIADASYWGSTSKAMLRVTGEVLGASAXRVPVGVVNVTXRCPSTCRDAHTQVYREQLGAGRSGRRPPTEQLADSKSYADCTHLCPPGVPDAWNDLLYWXLFFPANDQAL

SEQ ID NO: 108806 - protein, 196 aa, Triticum aestivum
  Clone ID: PAT_TA_3224.pep
MNASSQNNISDHAKSTVPTVVPGQVNVSNRGPDASRNIFSAFPPAVRENQCIPSAPVAQSWISFGASSESKPTIVSPNFNDGNSGWKMPFANVRTCDETKISAVPQFFRQPVQVPRESPGQNKGLVIFPQLVQTDFSRSQGQSQWQGLVPHMQQKPNMDMLRPDLNIGFPSPGSPPARQSSGINLEAQQPDLALQL

SEQ ID NO: 108807 - protein, 81 aa, Triticum aestivum
  Clone ID: PAT_TA_3225.pep
AARLLLSPTHLLSVVVAEQGWLLGVVSLAVLVLLVQDPLTHKLCPAVEVNPEDDMHGSLGSSIFTVFTSRNSHLLSFRTVF

SEQ ID NO: 108808 - protein, 1072 aa, Triticum aestivum
  Clone ID: PAT_TA_3226.pep
MCTQGCSQLWDMKSRFHHIKWIKSSLNPEESLQKIKSLKQIDDGNDYASKVARNLTSQLGGSDELDGYFADISNRENANLSFGQGFYKRSKWLDARKSSAVLSKDAQLRRLMQRKAENSYRKMEEFVINRLREIMKSSRFDFFIPKVAKIEGRLKSGYYARHGFSSLKNDIRSMCRDALRYKGRSDLGDMKQIVVSFIQLAKRLGNPRLISERPGAVAQKDNSDTSQYSSDAKLKKKQNKTTGERRGGNWATASAGADASSRAFDREIKRSLSKLKKMDVDSGSETSDDDDGYSEGDETESETTVSDTESDLDSNSAAWDLRGNSMKLFESGDSVGDDRGWGARMTAAGLVPPVTRKYEVIEKYLIVADEEEVQRKMRVALPDDYSEKLLSQKNGTENLEIPEVKDYQRRKVPGDEVLEQEVYGIDPYTHNLLRDIMPADVGLSSADKHTFIEELLLNTLNKQVRDFTGSGNTPMVYPLKPVIEEIQKSAEESGDRRTAKMCLGMLKAMRSRPEHNYVAYRKGLGVVCNKKGGFGMDDFVIEFFGEVYPSWRWYEKQDGIKHIQNNSEDQAPEFYNIMLERPKGDRDGYDLVFVDAMHKANYASRICHSCNPNCEAKVTAVDGQYQIGVYTVRPIAEGEEITFDYNSVTESKEEHEASVCLCGSQVCRGSYLNFSGEGAFEKVLLEFHGVLDRHSLLLQACEANTVSQQDLIDLGRAGLGTCLLAGLPGWLVAYTAQLVRFIFFERQKLPNEIFKHNMEEKRQFFTDINMDSERNDAEVQAEGVLNSRLQHLTHTLDKVRYVMRCIFGDPKNAPPPLVRLTGRSLVSAIWKGEGSLVDELLQSIEHHVDEDVLTDLKDKIRLHDPSDSEDIEGDIRNSLLWLRDELRTLSCTYKCRHDAAADLIHMYAYTKCFFRARDYKTVKSPPVHISPLDLGPKYADKLGPGFQEYSKTYPENYCLAQLIYWYSQNAEPESRLTRARKGCMSLPDVSSFYVKSVKPTQERVYGTRTVRFMLSRMEKQAQRPWPKDRIWVFKSDPRFFGTPMMDAVLNNNSPLDKEMVHWLKTRSNVFLG

SEQ ID NO: 108809 - protein, 187 aa, Triticum aestivum
  Clone ID: PAT_TA_3227.pep
AHPASSLLSETELSDLVFHIASKRTCKVLPYRKHYAASSHVHWKWKLPTASSWPPSSGWASPAPTTSHTRSPRSGPRRPLPGARSAPWPPSRPPSPMRPPGPSAPTPPPPGPYRQPPHGHRAQAGPPRHRRQATQDHLGDVAAGDSQRQEAAPWTPSRPPPPMRPTGPTTSRPHPPWPWPRATGSSR

SEQ ID NO: 108810 - protein, 638 aa, Triticum aestivum
  unsure (1)..(638): unsure at all Xaa locations
  Clone ID: PAT_TA_3228.pep
MKKLKKCAEAADVAKSQFLATVSHEIRTPMNGVLARVRMLMDTDLDTTQQDYVRTAQASGKALVSLINEVLDQAKIESGKLELEAVPFDLRLVCDDILSLFCGKAQEKGLELAVYVSDQVPQTLIGDPGRMRQIITNLMGNSIKFTERGHIYLTVHVVEEVMSCLEVETEFQNTNNTYNTLSGYKVANRRHSWQSFQLFNTDLHSAEMPFAPILPETIRLIISVEDTGVGIPPEAQSRIFMPFMQVGPSIARIHGGTGIGLSISKCLVHLMKGEIGGLXSLPNVGSPFSFTAVLTKARSNANANKSPGFKGINALVVDHKPVRAKVTKYHLQRLGVKTELTTDVNQVIPKMNCASLVTRLVLVDKETWLKESHSMPQLLSKLRSKDQSDPPKLFLLENPTNSIKSSSNISREHNLNVIMKPLRASMLQASLRRALGGVDKVHGKNGVVGNSALGSLLHKRQIIVVDDNVVNLKVAAGALKKYGAEVICADSGKKAIALLKPPHSFDACFMDIQMPEMDGFEAIKGIRMPERDVNEGTERGEAPAECAKVRRWRTPXILAMTADVIQATYEQCLKCEMDGYVSKPFEGEQLYMAVSPSYPRRGSGKEKRCKCIVNWTEVGTSVHMALVRGRFVKMQRTP

SEQ ID NO: 108811 - protein, 97 aa, Triticum aestivum
  Clone ID: PAT_TA_3229.pep
RHESRCILVLDTFISETSISGIWEYIVSKLSSLHVVYSIFYFPCTMDLRVYAYLCSGGKSYADFTTDHDGRLAFFPFAEFHNNFLYTSLCVSVPCKL

SEQ ID NO: 108812 - protein, 75 aa, Triticum aestivum
  Clone ID: PAT_TA_3230.pep
AVDAWVLLLSTFTQAQTEKRFNNDYMGLLHKYQVQKRFNNDFYGMLGRYQQRPYKRMMYGDYYNWLRNYQDRLTY

SEQ ID NO: 108813 - protein, 77 aa, Triticum aestivum
  Clone ID: PAT_TA_3231.pep
PILAHTRESRSIVKGDLVLCFKESNDEALHFDAHVLDVQRKQHDIRGCRCLFHVEYDHDQSQEMVNLKRISRRPRYL

SEQ ID NO: 108814 - protein, 155 aa, Triticum aestivum
  Clone ID: PAT_TA_3232.pep
VAVHLKGKKVVGKCIILCSRHLPAVPNVRMSAELLYYYYKKNNFKSHSTCPIVSITMRRHVSFGGVPLTKSDDPVQRYRRRVYKSGADGTAYGVGQGAGTGVGHAAGQVGKGADDGDQGVGQVLQGAGEGAQDGHGYLAPALLLAESVPVDRALL

SEQ ID NO: 108815 - protein, 140 aa, Triticum aestivum
  Clone ID: PAT_TA_3233.pep
ASVGVLADTRDPRRRRAPVPRGGCGGLLTRLRLAPAIRRAPASRGRRPPLGRLGAGLRRRRPPSPVRSSRRGARPPRARLVLGPPRRPLPSSAAPFRTASSLPHRVRPGRRRHALPSPCLMQPVTTLPGRRQTRRPGRGR

SEQ ID NO: 108816 - protein, 301 aa, Triticum aestivum
  unsure (1)..(301): unsure at all Xaa locations
  Clone ID: PAT_TA_3234.pep
MAAPSSLASSHLSRLAAAAPAPQHHHQNHQLRLGCSRRRAQRLVAMAGSGKFFVGGNWKCNGTKESISKLVSDLNAATLESDVXMLSVAPPFIYIDXLKEFTNWGRIEAVCSKHMRLEKGEAFAGGDQTLGCQWVIVGHSXRVMVTLGEXDQFIXGKKAAYALSQNLXVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 108817 - protein, 54 aa, Triticum aestivum
  unsure (1)..(54): unsure at all Xaa locations
  Clone ID: PAT_TA_3235.pep
KGPPPFLVFCFSCFFFYFCFPFFFFFFFFFFFFFFFFFFFFFFFFFXMFRVLID

SEQ ID NO: 108818 - protein, 138 aa, Triticum aestivum
  Clone ID: PAT_TA_3236.pep
DDAVAGFTPRFKKLSADAQVALLLYHGVPSRRSEEALRLINGEEVPTLDKGPLPGSRSMLTIDVYEDIVVLSSPLPSPSVAAVTEMVVDHDRLAVYIINDVMIPREPEIGFPALLLFFGLLALAALVLAQVLLIFGDV

SEQ ID NO: 108819 - protein, 270 aa, Triticum aestivum
  Clone ID: PAT_TA_3237.pep
MTVIDILTRVDAICQKYDKYDAEKLNGANVAGEDPFARLYGSVDAEISQCVEKAEAARQEKNRATVVALNAEIRRAKAKLLEEDLPKLQRLALKKVKGLTKEELATRSDLVAALLDRIQSIPDGSSSATKKNGGWGASGSRPGGGVKFDSTSDGNFDDEYFKGTEESNKFRQEYEMRRMKQDEGLDVIGEGLATLKNMASDMNEELDRQVPLMDEMDDKVDRANADLKNTNVRLKQTILQMRSSRNFCVDIILLCIILGIAAYLYNVLKK

SEQ ID NO: 108820 - protein, 193 aa, Triticum aestivum
  unsure (1)..(193): unsure at all Xaa locations
  Clone ID: PAT_TA_3238.pep
MATTVDWRSYRPDLPAAMYHMVDGRDQVMHAFAPPTAQGAAPTISFSFPCPGADQSAGLLRGATYLTPAQILQLQSQLHHVRRAPGAPMAAVGQPMKRHGVAALPVRPATKLYRGVRQRHXWGKWVAEIRLPRNRTRLWLGTFDTADEAALAYDAAAFRLRGESARLNFPELRRRRAPRPAARCRDRRQAPLH

SEQ ID NO: 108821 - protein, 180 aa, Triticum aestivum
  unsure (1)..(180): unsure at all Xaa locations
  Clone ID: PAT_TA_3239.pep
MKYMRTRGKPDVFQTEGNIRFVATELATDIVITVGDVKFYLHKFPLLSKSSRLQTLVASTDEEGNDEVDISDIPGGPSAFEICAKFCYGMTVTLNAYNVLAARCAAEFLEMFETIDKGNLIYKIDVFLSSSIFRTWKDSIIVLQTTKXXLPWSEXLKVIXNCVDSIAAKASIDPSXVNXS

SEQ ID NO: 108822 - protein, 259 aa, Triticum aestivum
  Clone ID: PAT_TA_3240.pep
MAPPGPGQLLPLTRSLLPPSAPPFLSGRRRLPPPARAQTSRPPPWQPRRLLCPAPLQPLRPLAGNRTRPVAAPPGASAAGGGEAQALAAEFMTSERVKVAAMLGLALALCNADRVVMSVAIRALSRAYGWTPSFAGVVQSSFLWGYLISPIIGGALVDYYGGKRVMAYGVALWSFATFLSPWAAARSLWCIISTRILLGLATELALPCMNNMAGFQLGRTIRSLASPIAMSRFGTGRPIVIFGLFIFLWVPGTFAAITG

SEQ ID NO: 108823 - protein, 228 aa, Triticum aestivum
  unsure (1)..(228): unsure at all Xaa locations
  Clone ID: PAT_TA_3241.pep
MSSESRELLGIDPNELRFAFELKKQISCSLHLTNRTDQYIAFKVKTTSPKKYCVRPNNGIVAPRSXSDVLVTMQAQREAPPDMQCRDKFLVQSAVVSQDIAPKDINGDMFTKESGNVVDEVKLQVIYPPPSPPPSGVGGAXGRGGAVGVIKRQQRELAEPETLPSDPLALILKLMKEEKNFAVQENNKLREELRLLRREISRQNVGFSLLFVLVAAILGVLLGFFMRR

SEQ ID NO: 108824 - protein, 193 aa, Triticum aestivum
  unsure (1)..(193): unsure at all Xaa locations
  Clone ID: PAT_TA_3242.pep
EFMTRGSLEKLLFFXYAASLQWSXRXKXALGAAKGLAFLHEAENPVIYRDFKTSNILLDSDYKAKLSDFGLAKDGPEEDETHVSTRVMGTQGYAAPEYIMTGHLTAKSDVYGFGVVLLELLTGRKSVDKSRPPREQNLVDWARPYLNDSRRLDRVMDPNLAGQYXPAGAAQRAAALAYKCVSPNPKSRPHMSA

SEQ ID NO: 108825 - protein, 138 aa, Triticum aestivum
  Clone ID: PAT_TA_3243.pep
LASYHLASQASNNDTSKPEAEPEAMNGSQRRPASEEEGHHTSPVPVPLAPTRIIYQLPTRTRTVCHPALYSSHRLVDSRSEALLVDDGRARLVVIALGDVLVLGEDHLGQDRAAQPRRVPRQVLRHVLRGLTRVGRIA

SEQ ID NO: 108826 - protein, 344 aa, Triticum aestivum
  unsure (1)..(344): unsure at all Xaa locations
  Clone ID: PAT_TA_3244.pep
MEAVVVDAGSKLLKAGMALPDQGPGVVMPSKMNTEVEESEVADGAAAVVEEVVQPVVRGFVKDWDAMEDLLTYVLYRNIGWEMGDEGQILFTQPLFTPKALREQLVQLMFEKFNVSGFYDYEXAVLSLHALGASEGHTWPLAHLMVYCRLSSFYXGVLAHCTCVVPLQICSRECIALLSLAQACYTEDQLAFEAIASTCQPETHTLPDGQVITIEKERYIVGEALFQPSILGLEDYGIVHQLITSVSNVASEYQKQVLENTMLCGGTVSMTGFEDRFQREANLSASAIRPTLVKAPEYMPEDLARHSAWLGGAILAKVVFPQNQHVTKGDYDETGPSIVHKKCF

SEQ ID NO: 108827 - protein, 60 aa, Triticum aestivum
  Clone ID: PAT_TA_3245.pep
FNQQVTITLQHRSLHEKIQMSSGDVVISAKDAWLPYELEAFQHGVLPVIRGFSDIFESRG

SEQ ID NO: 108828 - protein, 205 aa, Triticum aestivum
  Clone ID: PAT_TA_3246.pep
SRPRRPKSGKVGSGVLNVGLPAYVILNALLRSAKSNSNGLILSDGTEITSDNRPKSTLFDWFFDPLMIIKEQIKAENFTEEEEEYLKMRVLMVGEPSNLKGTLPHVPSLNERKKAEIDAFARRLQGITKSISRYPTSKRRFDVLVKSLLSELERTMGGSLPANGSQALRLRGGIARMLSQKSVGKTANITDEDPEAQVTRKARTP

SEQ ID NO: 108829 - protein, 117 aa, Triticum aestivum
  Clone ID: PAT_TA_3247.pep
MSSNSGGGAKEKGPRIATPLVPPPLVQNSMPTASDGPTTDLRLAQQSWPGHVVLRPCTSWPPHVNPAYPQQNGEAVADVVAADVLPVINSCNEKMLPEVNMLFDDENDAYEFYNIYA

SEQ ID NO: 108830 - protein, 113 aa, Triticum aestivum
  Clone ID: PAT_TA_3248.pep
PTRPRTRGHTHTHTHTHSEREREREREREREREREREREREREEKKRERKKMGQSPLLRLPVEEQVQGVVATNGSNRKEQLTKSTKATNKYYKNSSKDDLVLRATLDSITRMG

SEQ ID NO: 108831 - protein, 159 aa, Triticum aestivum
  Clone ID: PAT_TA_3249.pep
LVPNSARAEVEEEMEFLYECAATAAVADVAAALAGTAGLQAGRTRGFVAVAERCPSGELERALSEAEAYASKVQVRHNKFVSPRALREHIKNIEKAAANALPDTSEALCPQHPKSDEKRDSIQLWWAGKELAMHKKLSDYIGVNDKTKIVIRLSLPTSL

SEQ ID NO: 108832 - protein, 125 aa, Triticum aestivum
  Clone ID: PAT_TA_3250.pep
RSSPVRPAPPAPSPRGPSPSAMDDTAELQRFIEQEKEKMMVSEMIGKVTSECWDKCITGAPGSKLSSGETSCLSNCAQRFVDMSEMIREAFRRALEQDHHTCTRAVASWPSELRVFRCERILVWR

SEQ ID NO: 108833 - protein, 103 aa, Triticum aestivum
  Clone ID: PAT_TA_3251.pep
SVGYELEVGLDGVGAWVLESLVISGDILRHPGVHTLCHSCFVLGLSLLTKRLLPIYNEARPLSPCQGSGEQQGEEGEGEEGGGSPGHPHLRVTHAMHALSLPQ

SEQ ID NO: 108834 - protein, 129 aa, Triticum aestivum
  Clone ID: PAT_TA_3252.pep
SMGVKLTLPPAALISQVAKLSSLLALLLLALLLPVFLRVAYGYLLFNGIVLALGIQAFVGGGGASIADDEDRHGSPSAGQAVEASPFQRAGAESVRPDERAAVLGDLVVVPAFVASNIFELKTRQRRWC

SEQ ID NO: 108835 - protein, 259 aa, Triticum aestivum
  unsure (1)..(259): unsure at all Xaa locations
  Clone ID: PAT_TA_3253.pep
LAPIVSCWLAKASILHGFLQITVVAMAVSSQVFPYSTGAPKRVVLQHTFVTDASNIXXSNYGGSVVDANSLEFVFNNASEAAKWLKDNSELSLKEKYRSDRSTWVALYPVPFLFSGSLKFPAQTEEIRKHHQHFPQLVVQKTSSNNWNRRMHLQLSLGSLSEVWTTSLNITGPLSNWTFADNTLPAPXTVTGGPPSYICRLTGQTNENWSFWLXXXSSEPLRXVDVAVLDQXXVDSXKELXSLFPSWXDMTVFTKIFST

SEQ ID NO: 108836 - protein, 163 aa, Triticum aestivum
  Clone ID: PAT_TA_3254.pep
MEAERSQLSPIDPRRARFPCCIVWTPIPFITWLMPFIGHIGICREDGVILDFAGPNFVSVDNFAFGAVTRYIQLNGDECYKLLDTGAETTWDGALRKGVQEFQNRNYNLFTCNCHSFVANNLNRLFYAGHDKWNVVSLAAVMFLRGRWVSAGAVVKTLAPFVV

SEQ ID NO: 108837 - protein, 203 aa, Triticum aestivum
  Clone ID: PAT_TA_3255.pep
DAWGFVLSDMFQNLRSEDRGALLHEGAGHSVVSAFVEIIFDNSDNRIPVDKEEVRLRRTVASKKDEYYLDGKHVSKTEVMNLLESAGFSRSNPYYVVQQGKIASLTLMKDSERLDLLKEIGGTRVYEDRRRESLKIMQETANKRKQIDQVVRYLEERLRELDEEKEELKKYQQLDKQRRSLEYTILDHELNDARNELASMDDN

SEQ ID NO: 108838 - protein, 131 aa, Triticum aestivum
  Clone ID: PAT_TA_3256.pep
MAPVDPHSYTDGAHPVTAHAALAFYLDFAASTIHASALVTLSAPHTGDLLLDTRALAVHSAATAPAPDAAPFPIPFSLAADADPVLGTALTLALPPDTASFLLTFSTSPGASALQWLAPPQTASGLPFVFS

SEQ ID NO: 108839 - protein, 340 aa, Triticum aestivum
  Clone ID: PAT_TA_3257.pep
MAEGMAMARAGSLVSKLESKICYHRDAALEYMEIKAVVGEVMEEKEMLQQDYRALKDELEEAKKTIVEVNKELAAGSEETSLSKKELELVKKKLQDWEAKQNLPELLNCSASEHVQPSNSKGQKRSMRHQEVPSQGPLGIDAHKPDLAEERPGSMLVNNPIVGQTSVVPPSTDDDVVALREHLIKQFLEIDKYGGRIIGIKEMGKLNVKAFEIACAEKFRTTKAADASSKLYSLWQQRITDVSWNPFNMVTVEGNHQEVLNVNDDKLQELKKEWGEGPYKAVINALMEMKEYNCLGDRSTVYELWNYRADRKATLTECTEYMADRVQELTVVKRRKTRRN

SEQ ID NO: 108840 - protein, 275 aa, Triticum aestivum
  unsure (1)..(275): unsure at all Xaa locations
  Clone ID: PAT_TA_3258.pep
HARVWLGTFPDQDSAARAYDVASLRYRGRHAAFNFPCATVEAELAFLAAHSKAEILDMLRKQTYXDELRQGLRRGRGMGARAQPTPSWAREPLFEKAVTPSDVGKLNRLVVPKHHAEKHFPLKRTPHTTTTTXQGVLLNFEDGQGKVWRFRYSYWNSSQSYVLTKGWSRFVREKGLGAGDSIVFSCSAYGQKKQFFIDCKKNKTMASCPADGGAATASPPVAEAANGEQVRVVRLFGVDIAGEKRGRAAPAEQELFKRQCVAHSQHSPALGAFVL

SEQ ID NO: 108841 - protein, 112 aa, Triticum aestivum
  Clone ID: PAT_TA_3259.pep
RPDGEIGLQWVISTHSSIPYTSITRVIFPEAIDRQCYPSLVQRRSYSRWRRSAHHLKSILSCSMHGVECSECCSSPSVSGDDDILELHCINLAMIDAVCSSKQAHGISFSKK

SEQ ID NO: 108842 - protein, 305 aa, Triticum aestivum
  Clone ID: PAT_TA_3260.pep
MQNSKTSRNGSSDAPQRTSPATPRSSRVAKTGGNETDSAGITPTRTPTERSPKVIERRSPRSPVTEKKRPSRLTELESKVNQLQDELKKTKEQLSASEARRRQAQQEADEAKKQGQDASSKLEESQCQLVELSAAEESRLQELRKIQQERDRTWQAELEALQKQQSVDAAALSSALSEIQRLKLQLEATVQSDTARAKQCEHADSELEGLKQEMELRLATIEALKVNVSESDKAAADANAMATEAKLQLETAKATIDTLLAEGVRLQECLRSKDIELSESKARVASLEEDLKKAQAAGNEILNEA

SEQ ID NO: 108843 - protein, 136 aa, Triticum aestivum
  Clone ID: PAT_TA_3261.pep
PVTPPSPTPITPPITPVTPPSPTPITPPTPPSPVAPAPVPATPPPSSSTGKCPIDTLKLLGCVDALNGLVHALIGSSASDKCCPLLSGVADLDAALCLCTTIKLKALNINLVLPIAIEVLVNQCGKTVPDDFQCPS

SEQ ID NO: 108844 - protein, 61 aa, Triticum aestivum
  Clone ID: PAT_TA_3262.pep
RALGDEPYRRHLADEQGCRDVNVIAVGCVLVHSTCDYARIYLICCKFHFLWLNQLIKILTF

SEQ ID NO: 108845 - protein, 409 aa, Triticum aestivum
  unsure (1)..(409): unsure at all Xaa locations
  Clone ID: PAT_TA_3263.pep
GKCVSGPSFNGSALCNNKLVGAKFFQRGQEALRGRVLGADSKSPLDTNGHGTHTSSTAGGSXATAPAFDYARGKAVGMAPGARIAVYTAPKRAGRKGASSDILAAFDEAIADNVDVLSVSLGAVGMAPNFYSDKTAVGAFRAVSKGIVVSASAGNSGPKESTAFNVAPWFLTVGASTLNRQFPGSKVCEKGKLNATKVAGKIVLCESGVNARAAKPYAVKLAGGAGAILASTKSFGEQSITSPHVHPATAVSFVDAEKIFKYIRVQTSPTATIVFRGTVVGPTPPSPRMASFSSRGPNFRAPEIFKPDVTAPGVDILAAWTGANSPTELESDTRRVKSNNIPRTCPPRQCGVICRRREDQEVHARANVPYRYDLLPRHQWSDRRLLLLEWRPSRAAARTSARRRSSSRT

SEQ ID NO: 108846 - protein, 223 aa, Triticum aestivum
  unsure (1)..(223): unsure at all Xaa locations
  Clone ID: PAT_TA_3264.pep
ALISRLLHHSLVHRVLGIPFHQIHIXRTTEGKPYLENGPPAFRNFNFNTSHQGDYVGIAAELLCLVGLDIVCISKPQGETTVEFLKNFSSYLTDHEWNCIGRAAGSIEMLSEFYRYWCLKEAFVKAVGAGVGFGLHRLEFHHVEWSNISVYIDGIESRKWRFCLFKLDEMHLASIAKGHPEDATHSFKTTLSDVVVEDEEFYAALEIPDETFTLQTAEQLTQF

SEQ ID NO: 108847 - protein, 213 aa, Triticum aestivum
  Clone ID: PAT_TA_3265.pep
VAAAVEASPVEVEEGRSKTVAAAVEASPAPVEKGRSKTAAAEVEAGPAEVEEGRSKTVVLVAVDDSDASYRALEWAVRHVAATAGMAGAGAVELVVLHAKPPTSLAVNMGGPGVPGDVVGLVEEDLRKKAEGVVGKARSLCAANSVEAVVDVVDGEPKHVLCDAVEKHHADLLVVGSQGYGAIRRALLGSVSDYCAHHADCSVVIVKQPGSKN

SEQ ID NO: 108848 - protein, 210 aa, Triticum aestivum
  unsure (1)..(210): unsure at all Xaa locations
  Clone ID: PAT_TA_3266.pep
RPTRPKYARPPNLPSEGLDEMMASEFVEWFEIACKEDPNSDEDLWNLAXGCSSRAYSYSSYDVNGFRFRSEISEKKRRRLKTVNTGVCLSSFISETEQLEYYGVIEEIIKVSFTAGRKIEMVLFKCRWFDPIKGVKPNAKLGLVEIKWSSRLSNFEPFAMAHQATQAYYLHYASSRRDLRDWRVVYTIQPSTSLSNFDDCANDPSTTDEY

SEQ ID NO: 108849 - protein, 158 aa, Triticum aestivum
  Clone ID: PAT_TA_3267.pep
MPQGTKPHGRDAPRFCLAEYLSSANYKRLPDDVKTPTDKDLESDEALWALYERWCKAHNKERDHADMARRFKIFKINADDVHHWNTYLPPDPVEAAIHREKREEAKLLRSKGQDVSYFDVWHLPSELGPFADGGDPFIAESNMRLLKEIEDAEGVKAE

SEQ ID NO: 108850 - protein, 58 aa, Triticum aestivum
  Clone ID: PAT_TA_3268.pep
QTEMKSDCKTYGIINKTKQNVISWFTSLPTLTADYDMHVYSIMFVEAFTAVQGSKTNM

SEQ ID NO: 108851 - protein, 159 aa, Triticum aestivum
  Clone ID: PAT_TA_3269.pep
LIKCRIFPDIQQVSRTNKISSYLTTSSLNVAAEAVGNEEGKKRYKAYICSDCGFNTQNIIKTVYLCFIFYRIVFVALLLPLSNHHALWNIDSPLVTFQLDQCLQQELVLPIISPGTTSSSPGPLLEPSTSYHLQLLLSSPANFSPLAQRLSPYHEIPNL

SEQ ID NO: 108852 - protein, 184 aa, Triticum aestivum
  Clone ID: PAT_TA_3270.pep
MSSAAGAGAGEHSSSSRPGKQREEGADDSNRKVDDEGDLSLELYGAEAGWVEARTSCPHLPAMPAASADELARVPAPDSHCSRCHHPSENWLCLICKDVLCSRFINKHMLCHYQETGHCIALSFSDLSVWCFACDSYLDAQSILELRPVYEVAHLLKFGERPPFRSLEVLDLSSGQNGGSSSSS

SEQ ID NO: 108853 - protein, 330 aa, Triticum aestivum
  unsure (1)..(330): unsure at all Xaa locations
  Clone ID: PAT_TA_3271.pep
MAAASASAGRAGMNASSALCVVLLVVMAAGGASAQLSTGFYSSSCPGALGTVASVVQSAVAKEPRMGASILRLFFHDCFVQGCDGSLLLDDTASFQGEKTAMPNNGSVRGFEVIDAIKVAVENICPGVVSCADVLAIAARDSVVALGGPNWAVKVGRRDSTTASFSGANNNIPPPTSGLANLTSLFAAQGLSQKDMVALSGSHTIGQARCTNFRAHIYNETDIDSGFAGTRQSGCPPNSGSGDNNLAPLDLQTPTAFENNYYKNLVXKKGLLHSDQEVFNGGATDPLVQYYVSSQSAFFADFVAGMIKMGDISPLTRNNGEIRKNCRKSN

SEQ ID NO: 108854 - protein, 62 aa, Triticum aestivum
  unsure (1)..(62): unsure at all Xaa locations
  Clone ID: PAT_TA_3272.pep
FPNRKPXISXTNLSNHVDLPSCILSXINSHHNKYSLRSKIIGVVLAQVEITETQLVDQIFRW

SEQ ID NO: 108855 - protein, 135 aa, Triticum aestivum
  unsure (1)..(135): unsure at all Xaa locations
  Clone ID: PAT_TA_3273.pep
MCFTIMPLYVKRNRRTLDEQPNTISGSNNTVRSGSTNVVSGNDNTVISGNNNNVXGSNNTVITGNDNTVTGSNHVVSGDKHIVTDNNNAVSGNNNNVSGSFHTVSGSPNTVSGTNNTVSGSNHVVSGSNKVVGVE

SEQ ID NO: 108856 - protein, 75 aa, Triticum aestivum
  Clone ID: PAT_TA_3274.pep
FFTSCFDVSFTLASQVKHKHEVHHCASNLRVFLFFLEVLANFHSLCQEYGPWYFNLLLILLCYLQHYLNSKFILS

SEQ ID NO: 108857 - protein, 366 aa, Triticum aestivum
  unsure (1)..(366): unsure at all Xaa locations
  Clone ID: PAT_TA_3275.pep
CGQTALMHACRHGHWEVVXMLLLFRCNVTRADYLSGRTALHFAAHDGLVRCVRLLLADFIPSGPLEDTASSVADGGDSQMNSGSSPTSSLGLKFNEPARVRYINKPADGGVTALHMAALNGHFDCMQLLIELGANVSAVTFPYGTTSNLIGAGSTPLHYAAGGGSLECCQVLLSKGASRLTLNCNGWLPMDVARIFGRRCLEPLLSPNSHTIIPAIQPSSYLALPLMSILNIAREFGLQHTVSSVDESDLCAVCLERSCSVAAEGCGHEFCIKCALYLCSTSNVRVEFTGPAGSIPCPLCRNGIMSFTKLPSTPTEGLKSSSALTFCNPCILNTRSVDSPATVCKAEIRRNRVAALSSELVCPLTC

SEQ ID NO: 108858 - protein, 111 aa, Triticum aestivum
  unsure (1)..(111): unsure at all Xaa locations
  Clone ID: PAT_TA_3276.pep
MSTDVAADVPAPEVEVTADPVVETTAEAAAGDAKPAKETKAKAAKAKKPSAPRKPRATPAHPTYAEMVSEAITALKERTGSIQYSIAKFGEDKHKAHLPXNFSKILSVQFK

SEQ ID NO: 108859 - protein, 261 aa, Triticum aestivum
  unsure (1)..(261): unsure at all Xaa locations
  Clone ID: PAT_TA_3277.pep
MPAASDGDGASPASTELAAPGKEELEPPTPAEETPTPRKTRLPRACNSKPRLPPPPPLERPRRRAAAGAAADETPQCRVVTPLVSEPEAPAELARWRLRCMWELGSVLNFLHVFRALLNITVELTAEDIEAALITPNGTLYDIHMPLLKSIPPITRMAMGRGTWVTXVLCRKTKXGWHWVAEGDLPXILHHNGAEIGMDKELEPSXRLLILKAICXDIRVEQDDIRXYIDTNVXVVIXSXFXKEQLGKSLGTQMQINPGHN

SEQ ID NO: 108860 - protein, 139 aa, Triticum aestivum
  Clone ID: PAT_TA_3278.pep
LDLLVPASGGLYGTPSLDLRIEAFVTSESEPRTGNDTHKRPCQQVWFKPWPSDAPVSPALGTNGWLWLGAVVSSSFAAFLLLVAVLQRFYIYPVDRDSYHVYPWAARTMLNLLFLGVSVAGVTGAAFLWSKRRSARVWT

SEQ ID NO: 108861 - protein, 447 aa, Triticum aestivum
  Clone ID: PAT_TA_3279.pep
SVRGPVPPVEVCPTVVQAKCRLRAGICHYKLNVDGQRRHDEGQPTITGEYGVVNTLYLTREFDHINTVLSPTTPGSRMDVDNDSFQRMGSLSDGALQEGSPRISEAAIQISRCRVAEYLNAHTGYDLLPDSGKVIALDINLPVKQSFHILHEQGIPVAPLWDSFRGQFVGLLSPLDFILILRELETHGSNLTEEQLETHTISAWKEAKRQTYGRNDGQLRSNQHLVHATPYESLRGIAMKILETGISTVPIIYSSSSDGSFPQLLHLASLSGILKCICRYFKNSTGSLPILNQPVCSIPLGTWVPKIGEPNGHPLAMLRPNTSLSSALNLLVQAGVSSIPIVDDNDSLIDTYSRSDITALAKDKVYTHIRLDEMTIHQALQLGQDANSPFGLFNGQRCQMCLRSDPLLKVMERLANPGVRRVFIVEAGSKRVEGVISLSDIFKLLLS

SEQ ID NO: 108862 - protein, 147 aa, Triticum aestivum
  unsure (1)..(147): unsure at all Xaa locations
  Clone ID: PAT_TA_3280.pep
MASRAGGDGREPINEQIVENICANMRCEKTQLYTKITKLKLEVMENALVFAPIGPWAPKSRCTRIIGGAWFEGTIREXVLPAVHRNKEGLEEXVVPRMKEALERKKQEITEFELXYKIRIRKGDNSANEEGSMKEASARGVLVRPAG

SEQ ID NO: 108863 - protein, 156 aa, Triticum aestivum
  Clone ID: PAT_TA_3281.pep
MADIEAGGKPATESDTATLIPNSGNLEGSSRATKTCRFKDDDELVEITLDVQRDSASVQAVRPVAAEAAVAAARKRYDRSKSTAAVALKGLQFVTAKVGSDGWAAVEKRFNHLQVDGVLLRSRFGKCIGMDGSDEFAVQMFDALARKRGIVKEVLT

SEQ ID NO: 108864 - protein, 260 aa, Triticum aestivum
  unsure (1)..(260): unsure at all Xaa locations
  Clone ID: PAT_TA_3282.pep
DVVVMPKTXSGQEKQVGTGLIFSPTPAMRRILLAALGIHFFQQATGSDSVVLYSPRVFQSAGITGDNHLLGATCAMGVMKTLFILVATFQLDRVGRRPLLLTSTAGMLACLIGLGTGLTVVGRHPDAKVPWAIGLCIVSILAYVSFFSIGLGPLTSVYTSEVFPLRVRALGFALGTSCNRVTSAAVSMSFLSLSKAITIGGSFFLYAGIAAIGWIFFFTFIPETRGLPLEEIGKLFGMTDTAVEAQDTATKDKAKVGEMN

SEQ ID NO: 108865 - protein, 284 aa, Triticum aestivum
  unsure (1)..(284): unsure at all Xaa locations
  Clone ID: PAT_TA_3283.pep
MEFDERCLKVQDPKFDCLLFDLDDTLYPLSSGISSHVKTNIEAYMVEKLGIEESKIENLGNLLYKNYGTTMAGLRAIGYNFDYDEYHSFVHGRLPYDNIKPDPVLKQILKNMRMRKLIFTNGDMIHAVRALKRAGPGGPASTGIICFETLNPAVPADAVXTRRRQIFDIAGHFAGVRQRRTTWPRTPVLCKPNVGAMEAALRIANVNPYKAIFFDDSVRNIQAGKRIGLHTVLVGTSQRVKGADHALESIHNIREALPELWEEAEKTEDVLYSDRVAIETSVTA

SEQ ID NO: 108866 - protein, 236 aa, Triticum aestivum
  Clone ID: PAT_TA_3284.pep
TRPEEEEDLQAQKEDLHWSTEILYGDIVWARLGKRQPAWPGVVVDPARQAAADAMPPQPRGGAVLCVMLFGWRAEFSDEKKYVWVRQGGIFPFVDYIDQFQGQTDLSSLKPGDFQRALEEAFLADQGFSEVPMDDSTAGQPVVCQSCPDELEEVTGSGELECQAQIKHYTSELQCESCGNCFPNKESNKLVYVMEQLACKHCARILRSKEYCGICLKSWQHKCDRRWVCCHGCESW

SEQ ID NO: 108867 - protein, 166 aa, Triticum aestivum
  Clone ID: PAT_TA_3285.pep
DTTERALHFDEAAAAGALEVTPVAVAYPAPHRPPEKKARVDVVDVDDSEPESGAVGRQGLVAVGSGVRVPGEVVIEVLRRLAPRAVAASAAVSRGWRDCARRVWRGAEELRLRAAGVSTIGTLLPRCPALSRLVVRMESDVDATMLACLAFSCPNMPSLEISMADS

SEQ ID NO: 108868 - protein, 67 aa, Triticum aestivum
  Clone ID: PAT_TA_3286.pep
LNKECCILPPNLVTEGVALNNQINTLSVTSTHTSCILQIQLWIEGHVPWIIKSIGDPCLRIVQHANN

SEQ ID NO: 108869 - protein, 126 aa, Triticum aestivum
  unsure (1)..(126): unsure at all Xaa locations
  Clone ID: PAT_TA_3287.pep
MATGVAPAPLPHVKVRGGGIGFTKSVDFAKVLSVPGALRTASSRGRALVVWSSSTESDTMELEPASEGSPLLVPRQKYCESIHQTRRRKTRTVMVGNVALGSDHPMRIQSTTSXQGVKEKEYKKGV

SEQ ID NO: 108870 - protein, 277 aa, Triticum aestivum
  Clone ID: PAT_TA_3288.pep
MSFQDLEAGNGVRGTPRRNGRAAGAGAGSSQAVASGVFQINTAVATFQRLVNTLGTPKDTPDLRDRIHKTRAHITQLVKDTSEKLKQASEADHRLEATPTKKIADAKLAKDFQAVLKEFQKAQRLAVEREAAYAPFITQAGLPQSYNSTEMNNGADKLAEQRTQLLESRRQELVFLDNEIVFNEAIIEERDQGIQEIQHQITEVNEIFKDLAVLVHDQGAMIDDIDTHIDNSVAATAQAKGQLSKAAKTQKSNSSLICLLMVIFGVVLLIVIIVLAA

SEQ ID NO: 108871 - protein, 381 aa, Triticum aestivum
  Clone ID: PAT_TA_3289.pep
EFGTSRGGAHRALLVPALLLAALLACSGGGVHGAGFNRYSFPKGFIFGTGSSAIQYEGAVNLRGKNIWDTFARTPGKIADGSNPDTANDFYHRYKDDLKLITDMNMDTFRFSLAWSRILPNGTIAGGINKAGVDFYNSLIDEVLARGLTPFVTIFHFDTPQVLEDKYGGFLSEKIIKDYVEYAELCFKLFGDRVKFWTTFNEPMIFCAFGYGSGSTAPGRCSPYVSKACGAGDSSTEPYIAGHNLLIAHAEAVRLYRTRYQPAQRGQVGIVQVSHWFIPYDAASDADRHAVKRSLDFMLGWFMHPVAFGEYPATMRRLVGRRLPEFTKEQSDMLKGSYDFLGLNYYTSNYAQAAARAPDRRQPSYGTDHRVNQTGYRNGVP

SEQ ID NO: 108872 - protein, 155 aa, Triticum aestivum
  unsure (1)..(155): unsure at all Xaa locations
  Clone ID: PAT_TA_3290.pep
EEAKPAVPNNKAVEKALAGTADFLIDLEDKRSIQVPGXPSTLVGLAIVTFAGVCYSLFAPAFNLATNDQWHTLRDGVPHLVVYTAYFYFCLSSLAVGVALNVWCLYRPVARVPRSTLRAYVAHGEGRGLALLAGLVSGLGNAFTFMARLAAGYAA

SEQ ID NO: 108873 - protein, 68 aa, Triticum aestivum
  unsure (1)..(68): unsure at all Xaa locations
  Clone ID: PAT_TA_3291.pep
MKREYQDAGGSGGGGGMGSSEDKMMVSAAAGEGEEVDXLLAALGYKVRAFDMADVGQKLEQVEMAMGM

SEQ ID NO: 108874 - protein, 322 aa, Triticum aestivum
  Clone ID: PAT_TA_3292.pep
LTQWLREKGFDEEAIGRMSKRCRNLPNLDAGEASGVWDYLLNDVKIEQRKLRYVVTKCPKVLTMSVNDKLVPTVQCLTTLQAKPGEIAQAIVKFPPILFHSVEEKLCPLLAFFQTLAISEKQLAKLLMVNPRLISYSIQAKFSQTVDFLVGLGINREVMIGKILTKEPYIMGYSIDKRLRPTAEFLKSAVGLQGSYLQRVIMNFPSILSRDVDKTLRPNLVFLQSAGFSKDQIMKLVAGYPPVLIKSIKHCLEPRVKFLVEEMGRDKGEVVDYPQFFHHGLKRSLEYRHKILKQMNSRCSLSEMLDCNQKKFAMKFGLIPVA

SEQ ID NO: 108875 - protein, 412 aa, Triticum aestivum
  unsure (1)..(412): unsure at all Xaa locations
  Clone ID: PAT_TA_3293.pep
MSQIQSLSRSCVLLAVLCGKHADKQQQRAPPGRSGPEAKRLRPSYPFPELSSAGRLEVHTLVNPTPEQFLEAQRLVQPNFFYIQGQQLEDEEIGSLVWGDADMSDPQSFVCLISPPFPTIVYLEVPIGEKLAQAVHSKRIPYVIYWRNSFSSYASXHFRNALLSVVQSSVSHTWDSFQLAHASFRLYCVRNNHVQSVKLGPRLLGDXPKVNVVTPENEMAEEEGSSSEVSPAIKIYDDDINMKFLLCGVPSALDSCLLGSLEDGLNALLNIEIRGSKLQNRISASPPPLEAASVPRGMVTMRCDMTTCSSSHVSLLVSGSAQTCFDDQLLESHIKNELIEKSQLVRALPNSEDKLSSTEPFTSMFTACGASTFEVWMTLPKWAAQVLKHLSPEISYRSLVALGVGCVNATPV

SEQ ID NO: 108876 - protein, 246 aa, Triticum aestivum
  unsure (1)..(246): unsure at all Xaa locations
  Clone ID: PAT_TA_3294.pep
MKRELLGTKPPAQSLLAVELTVASEFTCSLPSTTAPETRRCVGVGHVVYQVAGVVVEQTKSCCGCGGGAAQVRHRSTANMAQPGPQRSRSRGSNRGSSRGCPPSSTESRPHRLXRCSSLLESPPRCSSPLESPPRSPRSRISSLWPPCESPEPRQQPGSSRGRPPSSNASPPSPSRRSSSPERASPEPPEHESLGAPRSSSRSSSSASPPRFPGTSPAQPPARAHPSYLRIRRRGSPTRAQPRAEF

SEQ ID NO: 108877 - protein, 155 aa, Triticum aestivum
  Clone ID: PAT_TA_3295.pep
FITFRVNVHQAGQINSTLASLKGSFKFHGVCNCISQLEVCHQMQCVSVSLDAMWREDIKDTHRSIYAVALEQLITGRRTAAPLVYWSAVASMELYPSRRGAGGGRRGAGAGRRGGGGGRRRSGGRWAGRQAPVWRQRRNPSACEGRRRGCSLVPT

SEQ ID NO: 108878 - protein, 420 aa, Triticum aestivum
  Clone ID: PAT_TA_3296.pep
MAAHPVESEASSETDNHPLLIDHMENTAHLEIAIESPRDDVASSSTARREDNDGLDRLPHISESSSETTTASNSQSAPLARRDANRARRRQSPLNSSCWISIELVVTVSQIIAAICVLSLSRKERPHSPLFEWVIGYTVGCVATLPLLYWRYLHRNRPTTGQEPASQNFPPNSIPESNSHTTNSAPGMSEAGFVTDTNGVSQNNVLTRNLRAQAYADHFRMALDCFFAVWFVVGNVWVFGGHSSAHDAPNLYRLCIAFLTFSCIGYAMPFILCALICCCLPCIISLMSFREDLNQNKGATAEAINALRTYKFKTKKSRNGEGIEVGGGVVAAGTDKERIVSAEDAICCICLARYSNNDDLRELPCTHFFHKECVDKWLKINALCPLCKAEIDSGPTTAPAIGFGRRHSDNRVGNDIESQL

SEQ ID NO: 108879 - protein, 177 aa, Triticum aestivum
  Clone ID: PAT_TA_3297.pep
MAEESWEEGRGLDFLVSLGPDISATVFSLLDDPADLARATAVSRSWRRFVLANQFSKILCLWVYPEVSNFTRVELSSISSAHRNAGSSAFAGLEKLGRDHRVYMHLSHDLLSPYDPKDCISCCVRASSTDHLPEEAIENTLEHDEEWRPSYWSSGGQKDPAVPECLIYSLQSELCLV

SEQ ID NO: 108880 - protein, 112 aa, Triticum aestivum
  Clone ID: PAT_TA_3298.pep
MGVKGFVEGGIASIVAGCSTHPLDLIKVRMQLQGESSAAAAAVPQPALRPALAFQAGAHTVTLPHAPTPVPKPGPIGICTQILRAEGAAGLFSGISATMLRQTLYSTTRMGL

SEQ ID NO: 108881 - protein, 264 aa, Triticum aestivum
  unsure (1)..(264): unsure at all Xaa locations
  Clone ID: PAT_TA_3299.pep
RPRPRPRPVPMLGQIGICRRALRAAGAGGLGSAISATMLXPTLDCTTRMGLYDILKKRWTQENGGVLPLHLKIAAGLIAGGAGAAVGNPADLAMVRMQADGRLPLADRRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDAEF

SEQ ID NO: 108882 - protein, 233 aa, Triticum aestivum
  Clone ID: PAT_TA_3300.pep
GSKSKSPKIASSRKLGFQIDRKSPNRLDREMATAGVEDLFEGLAVSGTMPVRCGRKNKKGSSSSARSQEVEVAEVPMPSRRGGEKGFPKAAPPRRGGDKGSSRRGKEKRFPKGGSQEDAVIKTGRLDRKKGFRKAGSEEEEKKKRMPEEMVNDILSWEKPPRFTMFKSAGFFNKLRDELFEYQQEIKEEVEEKGYAELPADFKEYTKEADIKAYRKAYLKVFGTEPPPELCSL

SEQ ID NO: 108883 - protein, 202 aa, Triticum aestivum
  unsure (1)..(202): unsure at all Xaa locations
  Clone ID: PAT_TA_3301.pep
MAASCSFRTIVRAPPPPRGLAGARRSVRCCSSAAPAGASTSKLVLEVKERLEREHPGLPTGRSGRDDDEMILWFLKDRKFAVDEAVSKLAKAIKWRQDFRLSELSEESVKGLYQTGKAYVHDSFDINGRPVLVVVAAKHFPSKQDPLENEKLCAFLVEKALRKLPMGTDNILGIFDLRGFXVENGDLQFLKFLIDVFYYYYP

SEQ ID NO: 108884 - protein, 56 aa, Triticum aestivum
  unsure (1)..(56): unsure at all Xaa locations
  Clone ID: PAT_TA_3302.pep
HEGRSCQGSGLVTYFRKKGKETICTCVPCAGIGYXXKITYREGAENLDELDNGRPP

SEQ ID NO: 108885 - protein, 391 aa, Triticum aestivum
  unsure (1)..(391): unsure at all Xaa locations
  Clone ID: PAT_TA_3303.pep
NQFSIFVSRDSGNKKYSSVLAPGHHEGLKKSSDSGISSWDWNLSGQHSTYHALFPRAWTIYDGEPDPDLKISCRQISPFIPHDYKDSSLPASVFVYTLVNTGRDRAKVSLLMTWANSIGGFSHHSGGHFNEPFIGDDGVSGVLLHHKTAKDNPPVTFSIAACETQNVSVTVLPVFGLSGENHASAKEMWDTMSKDGHFNRENFNAGCSMPSSSXXETLCGRLVXGIDLGWKPHGRCTVAFALAWSSPKVKFQGACTGNRRYTEFYGTSERSSSIHLVHDALTKYRLWEEEIEKWQDPILKDEKLPEWYKFTLFNELYFLVAGGTVWTDGQPPAFSESSPAYQHKHSXKGTKSESVKXNHVXPAAEQSRWNTPKGEQASINSHGYSPEQPTS

SEQ ID NO: 108886 - protein, 349 aa, Triticum aestivum
  unsure (1)..(349): unsure at all Xaa locations
  Clone ID: PAT_TA_3304.pep
DLVRSITASAGATVNISEMVAALSNDVISQAVFGGKFPQQEEYLRALDEVFRLLGGFCLVDLFPSSRXSRWLSNGERHMKRSCARIHQIIAEIIKGRKESLDPGNGATDDEDLLDVLLRLQEEASLAFPLTTDTIGAVLFDMFAAGTESTSTVLEWTMSELVIHPEAMAKAQQEVRQVLGEKRAIITNRDLGELHYLRMVIKEVLRLHPPGPLVPRRAREDCKMMGYNILKGTNXVYVNVFGISRDPTYWKNPEXEFKPERFENNXIDYNGTYFEYTPFGSGRRLCPGMLFSTSXLDIVLANLLYHFNWILPDGASLDMSEKFGLTVNKRYDLKLRAVPHMWNYEVQSE

SEQ ID NO: 108887 - protein, 90 aa, Triticum aestivum
  unsure (1)..(90): unsure at all Xaa locations
  Clone ID: PAT_TA_3305.pep
GEGRSVQREEEGSHHAQEQDRAAEAGALPQREAPEGAGRGAGGGXXQGDGGEGAVYEHAREGDAGEEPGSSRGRGLLEDEEAQPGVPGGA

SEQ ID NO: 108888 - protein, 109 aa, Triticum aestivum
  unsure (1)..(109): unsure at all Xaa locations
  Clone ID: PAT_TA_3306.pep
XKQLLFNLHNPYTVHINHQNHTMLLARLVEKVLACLSRPVKPSPPEAEAALGGRRHEAAQGPGDVQLELASLERRPLLLVAAAAIAVAGVPVLHCTSLCLLARAFRSKW

SEQ ID NO: 108889 - protein, 180 aa, Triticum aestivum
  Clone ID: PAT_TA_3307.pep
MAPSASTGQKVNLKGYKTLPHAIQLVTMMSGTSSASTLTIGDQNKKFKVSRALTWMVVICIPATFIAVTAGSAYRMYNKPIWAAGFPSRLPVVLMLGAYLAVVNLALGYLTLYLPQAPFAVWKALDDVGLRLIGLAVILISGPVLLSAQAWLHIIWACLLGVLIAAILAFCVCLARTYSK

SEQ ID NO: 108890 - protein, 360 aa, Triticum aestivum
  Clone ID: PAT_TA_3308.pep
AASPPMPMTVGGWVGTFPPFSYIAPVPGLSAPARHHPMDIKPGTSAGLQHPALPPLPVRPKRCATHWYIAQQIQYHQRITKMNSFWPTTAAAAAAAAAAATRSAPFFGPRGPFNMGVVPPAEAASLLANPMQGSYPVRAHAPLQETKAPSMVPSPFQGSLSKDKASSSSASVAESNQRKQPPALEAQQSSPMPPNMMQAPTFIFPFNQHAAAVAAATAAANRMGDTKSSGTSSAMPSSATAHASAAHPGAPAMNLSFANMQPGDAQFLAILQNGYPFQLAAAHAGGAPSYRGMAPPGAGVPYFNGHVYSPHMLNPSQQQGTQQQNHQKNPCQACLVPLRSISHNNHKGCWDMHQMLMLLL

SEQ ID NO: 108891 - protein, 85 aa, Triticum aestivum
  Clone ID: PAT_TA_3309.pep
LVCRLENLLGTTCSHTMTYAETQIVSSSISWCLFRSGRCEASDPLHHWFVMCIYTQLIYVLLSQQVCHVCGKGNIDFSKKKKKKK

SEQ ID NO: 108892 - protein, 624 aa, Triticum aestivum
  unsure (1)..(624): unsure at all Xaa locations
  Clone ID: PAT_TA_3310.pep
RSSKKEDVGGKTYQDNLGDEFRVGAQELGXFVNGTKKVPATLDDYRKLVVPVIEEYFSTGDVELSVSELRSLGSDQFHNYFVKKLISMAMDHHDKEKEMASILLSALYADLLDSSKMSEGFMMLLESTEDLSVDIPDAIDVLAVFVARAIVDEILPPVFLTRARALLPESSKGIEVLQVAEKSYLSAPHHAELVERKWGGSTHFTVEEAKKRIQDILREYIESGDTDEAFRCIRELGLPFFHHEVVKRALILGMENLSSQPLILKLLKESTTGCLISSNQVSKGFSRVADSVDDLSLDVPSAKTLFDKLLSTAISEGWLDASFCKSAAPGEDMWNASSEKVKHFKEESGHIIQEYFLSDDVPELIRSLQELSAPEYNAIFLKKLITLAMDRKNREKEMASVLLSSLSLELFSTGDIMKGFIMLLQSAEDTALDIVDAPSELALFLARAVIDEVLLPLNLDDISSKLRPNSSGSQTVQMASSLLAARHSGERILRCWGGGTGWAVEDAKDKISKLLEEYNTGGDLKEACQCIRDLGMPFFNHEVVKKALVMAMEKQNEASILALLQECSSEGLITINQMTNGFARVKEGLDDLTLDIPNAQEKFRGYVELATERGWLLPSFASLP

SEQ ID NO: 108893 - protein, 132 aa, Triticum aestivum
  Clone ID: PAT_TA_3311.pep
PFPPRARLAPPPQTPPSSEMPLSSPSPSPSLFLSPTPFLRCPPRLPGLLAAAPRYLRPLRYARFSPPDSRPAGGPAAGLGPPPLRDGCCSAPRPRPCAGPPAARGPHRSWPPTTPRPATPGGPASSTPAVAG

SEQ ID NO: 108894 - protein, 460 aa, Triticum aestivum
  Clone ID: PAT_TA_3312.pep
NGTRILFPLMTVEEAVANKKLFMLDYHDLLLPYVLKVRKLEGTTLYGSRALFFLTADGTLRPIAIELTRPKSKRKPQWRQVFTPGCDGSVTGSWLWQLAKAHVLAHDAGVHQLVSHWLRTHACTEPYIIAANRQLSQMHPVYRLLHPHFRFTMEINAQARAMLINADGIIEGSFAPGEYSIELSSVAYDQQWRFDMEALPEDLIRRGMAVRKENGELELAIEDYPYANDGLLIWDAIKEWALTYVEHYYPCTADIVDDEELQAWWTEVRTKGHADKQDRPAWPELHSHENLARALATIMWVTSAHHAAVNFGQYPMAGYIPNRPTMARRNMPTEMGGDDMRAFVEAPEKVLLDTFPSQYQSAIVLAILDLLSTHSSDEEYMGTHEEPSWKQDGVIRQAFDKFKERTRDIVEQVDEWNNDPDRKNRHGAGMVPYVLLRPSDGDPTDEKMVMEMGIPNSISI

SEQ ID NO: 108895 - protein, 85 aa, Triticum aestivum
  Clone ID: PAT_TA_3313.pep
ARSRFRVETSGIQSFTSRTAFYLVFSHDPTTLATSSARPCYRLCSSGSQFFTIYSFLSIAVFANTAVYKSRGKIMNSFPAEIFNI

SEQ ID NO: 108896 - protein, 231 aa, Triticum aestivum
  Clone ID: PAT_TA_3314.pep
TWCSFKSLLLAAVATTSVLAAPFDFLTERDDGNATALEKRQSTPSSEGYNNGYFYSWWTDGGGSAQYGVGEGSRYSVTWRNTGNFVGGKGWNPGTGRTINYGGSFQPQGNGYLAVYGWTRNPLVEYYVIESYGTYNPSSGSQRKGSFTTDGGTYDVSTSTRTNQPSIDGTRTFQQYWSVRTQKRVGGSVNMQNHFNAWARYGMNLGQHYYQIVATEGYQSSGSSDIYVQTS

SEQ ID NO: 108897 - protein, 137 aa, Triticum aestivum
  unsure (1)..(137): unsure at all Xaa locations
  Clone ID: PAT_TA_3315.pep
FAGLGFLSWYLAGKITVFDRRGHVAKLCVVILPLLLAAVIAISRVDDYWHHWQDVFAGAILAIVCLLNLMXQTTIIHPMAAGFWPHAHFRDISEREEESQRRRATEMSNSGSTAIVPRQGETGANTSRTLDAMESGT

SEQ ID NO: 108898 - protein, 73 aa, Triticum aestivum
  Clone ID: PAT_TA_3316.pep
VAASDSLKSRFTKLKFIVTDKLYLVLVGAALKSGKMQLLIVCALFYVLFLRAPSFMRRMARVAAPPAGGNESE

SEQ ID NO: 108899 - protein, 220 aa, Triticum aestivum
  Clone ID: PAT_TA_3317.pep
MSAAAAAVAVPDEAEAEAKPSSSSEEVKEPEPGTEKQEEKPALVLVAEDGVEVRIAEPAARMSQMLRHMMEDGCADGRIPTANIHSDILEMVVEYCEKHGPYYDPEASERDRYPFPPFPIELTPTVSSIKPVTYVDPDPHGLKDWDSDFISLDNSTLFEIILAANYLNIEDLLDLGTSAVADKMRGKKPEEIREIFEIENDYTPEQEAEVRKENAWAFED

SEQ ID NO: 108900 - protein, 101 aa, Triticum aestivum
  Clone ID: PAT_TA_3318.pep
VCCCSLIYVMCQAGVFKTSFSEMWAYIYMDVFAATPQGCKARGSQRVEPLRGLGFAPGPASPGFPVTSRLSPLEQSQGRICSIVYPWVERFFLRLHHLVVV

SEQ ID NO: 108901 - protein, 234 aa, Triticum aestivum
  Clone ID: PAT_TA_3319.pep
MSNMVFLEEALKPGSTIPCYIQPSATLGAPLLRRDVADSIPMSTGNFIKILTMFAPASNDMATKIWSTLDDCEHPRAIKGETKACVSSVESMVEFAASVLGVSTYNLAAFSSPDVPVDGVMTGRGYKVAAVTRVREAGDTMTCHRGSFPFAMFMCHAVNPTRVYSVTLEGEDVDADGAGQRMEVLAVCHLDTSDFHPAKMPLHVKPGDAPLCHFISRDSILWAPATPASAHAAA

SEQ ID NO: 108902 - protein, 315 aa, Triticum aestivum
  unsure (1)..(315): unsure at all Xaa locations
  Clone ID: PAT_TA_3320.pep
MEQPPSSPPPPAAATATAAPTPAPAPSSAPIILSDSPPAAAAGEPALTAAQKALRSKPARAPEDPDKKNKKLKDVEISFPIVYGTISFWLGKKASEYNSHKWTVYIRSATNEDLSVIVKRVVFQLHPSFTNPTRVVEQPPFELSESGWGEFEIAITLYFHSDVCEKRLDLFHQLKLYPEEDAGPQSTKKPVVVETYDEVVFPEPTEAFFLRVQNHPAATVPRLPPGMTLSSPGPMELMPHDKKRFDTKDHSLSQWFSNFSEADELLKLAAARQXQVQAHIAKLRXRQLSMIEGMPQQFKKSIPWLVNFGALANGN

SEQ ID NO: 108903 - protein, 90 aa, Triticum aestivum
  Clone ID: PAT_TA_3321.pep
DPRVREIVQFACTRFKAEYPIFDKVDVNGDNVAPVYKFLKSRKGSLFGDNIKWNFSKFLVDKEGHVVDRYAPTTSPLSIEKDIKKLLASS

SEQ ID NO: 108904 - protein, 233 aa, Triticum aestivum
  unsure (1)..(233): unsure at all Xaa locations
  Clone ID: PAT_TA_3322.pep
MPSRPAPLVHRLRLLRSAVVCSSSALLPCSRPRLAIPFAQPPLRGPAFAAASSPLLRSVGARFSLFSSMAAAASSASSIHDFTVKDASGKDVDLSTYKGKVLLIVNVASQCGLTNSNYTELAQLYEKYKDQGFEILAFPCNQFGGQEPGTNEEIVQFAXTRFKGEYPILDKVDVNGXDNVAPVYKFLNSXGDNIKWDFSKFXIDKEGHVVXRYAPTTSPLNIQKHIKKLLASY

SEQ ID NO: 108905 - protein, 123 aa, Triticum aestivum
  unsure (1)..(123): unsure at all Xaa locations
  Clone ID: PAT_TA_3323.pep
WITANLFTLVYVIVMRRPTVRKLFNFPALEAQSAPALNSALDMFGGSKAVPSAKPSLSLTELEEIRRELAYMAAQPRGSPEWRKLMALYKHCSSGIADAAALGYRAKKXEKKEKSRGKSRKGR

SEQ ID NO: 108906 - protein, 100 aa, Triticum aestivum
  Clone ID: PAT_TA_3324.pep
LHADNARDLEASHSRISKRIKMQTQSCVQMAEEAEKEHKKMIDNYSQQADEIKASDKKLMTEVQSSSSRVCKVTLPEMAKSVARAIDGLRSRYNIPATTA

SEQ ID NO: 108907 - protein, 229 aa, Triticum aestivum
  unsure (1)..(229): unsure at all Xaa locations
  Clone ID: PAT_TA_3325.pep
ARGKGVGHLAGILHDFLERPNDVVDGTTDGMLYTLSREELLELFVTVSSQLSLLWNAFLKFHRTNKTKILDYLRDIWAVDRKAEWSIWTNHSKIEIPHRYLRSMSDDPPHRQHSLLRVSGSRKFHEDPVQNSASRAELHRKSIAQMKINXXSVQDMHIYADPSRVPVVLIEQXSWXVPQHGSNKDLASSSSEQKDTIVLPKLQGESLALKNINGKKSGRVLRAVIFVHG

SEQ ID NO: 108908 - protein, 261 aa, Triticum aestivum
  unsure (1)..(261): unsure at all Xaa locations
  Clone ID: PAT_TA_3326.pep
MALLLRRGAAVAARTLRAAAASSASTSVXHRLPTAGSLAAARNLPTTQFFLLEIRRGFAKGKKSKNDSRSDTVEAAPDIGPTVKSAATAQMDTAVVALSRELSKLRTGRASPGMLDHIMVETGDVKVGLSRIAVVSVLDSHTLSVMPYDPNTMKSIENAIASSPLGINPTPDGSRIIAAVPPLTKETMQAMCKVVTKSAEDFKQSIRRARQKALDTIKKSSSSMPKDDIKRLEKEVEELTKKFIKSADDMCKAKEKEISGS

SEQ ID NO: 108909 - protein, 156 aa, Triticum aestivum
  unsure (1)..(156): unsure at all Xaa locations
  Clone ID: PAT_TA_3327.pep
GQPSRLSPLRPAAARPPPRPAPSPPPRPAPPQLLQPPPGAHAARPAASHPPRPAPSPSHRPSLPQKQQSPPVAQEPKPATKQPPPXPLPPTSHISLHPNPSPAPAFLPXPPSSPSPGWPPRTARGGMRGGRRVGAGEQAGRSSGDARKSRIATRQS

SEQ ID NO: 108910 - protein, 196 aa, Triticum aestivum
  Clone ID: PAT_TA_3328.pep
MWDSGCKINPPLAEEILCMEKHHRRINFFCLDSENDQGQATQANDCFSRSCPIPCFPYDYPDSKAYSSFMTEEAAVFDKAAEYRPAAKRPPRVPVPPSWHHIMASLNKEDGTVRCLEVDDLKPSDTVLPECFSLNSNCGDSGSSPTTVVASFQLFVPRTIQTLRHYVKELDMMSLSSSSEDGKSILMNPNWLLVAR

SEQ ID NO: 108911 - protein, 343 aa, Triticum aestivum
  Clone ID: PAT_TA_3329.pep
MAPPRVHLLLALALCLAFARADAAVRELRVGYYAQTCPRAEEIVRRVMARALAREARSVASVMRLQFHDCFVNGCDGSVLMDATPTMAGEKEALSNINSLRSFEVVDEVKSALEEQCPGVVSCADIIIMAARDAVVLTGGPNWDVRLGREDSLTASQEDSDNIMPSPRANASALIRLFAGYKLTVTDLVALSGSHSVGEARCFSIVFRLYNQSGSGRPDPHMDPAYRQALDALCPLTGDQNVTGGLDATPVVFDNQYFKDLVHLRGFLNSDQTLFSDNEGTRRVVTQFSQNQDAFFRAFIEGMVKLGELQNPRKGEIRRNCRVANGGRPPLEKQVAPFRVLDF

SEQ ID NO: 108912 - protein, 145 aa, Triticum aestivum
  Clone ID: PAT_TA_3330.pep
MPQLEEIVSTAGGAGSPPPPLWFLVFLALGLHAVVVSAATFLAWLYRAFLRRGQDLGLRYGAWAVVTGATDGIGRALALELARRGLHLVLVGRNPAKLSRVSKEAQEAAPSCMVKSVVFDLAGDATELSLGAARVAAAVKGLDVG

SEQ ID NO: 108913 - protein, 267 aa, Triticum aestivum
  unsure (1)..(267): unsure at all Xaa locations
  Clone ID: PAT_TA_3331.pep
AVRRLQHSSSCGGLPGAPSPRAGWILSTSCSARNQWTNSECGLILHTGLVRDYLPDDAPEVLVSIMPGTSCSDELPPALPRCGPRGPSAVCEAGFXQHRLNSVAPASVQSXVHFSVFVFLAGSPVAVVSWGAQCAGLLVGSKSSALSPGFGTAQIVGSPQCITMWEAVNDGKHLNMSVTMPSXEVGSVSGGTHLASQSACLDLLGVKGPHDLSLEPPARHLAPVVAGGVLAGQLSLLSARAAGQLLKSHMXYNRSSRDMCKAASLSS

SEQ ID NO: 108914 - protein, 231 aa, Triticum aestivum
  Clone ID: PAT_TA_3332.pep
ALLASASGCLAAAGAGEREGWLDDPAVLLSLGPRARDLAVASAARSVLGIVPVAGGGGVTVKPALGPDDGRISAVEWVPLDAEGAQGEEGMALVVGTDAGWLLFYSLAGDLLHKQSIYPAKILKLNFSERKENAWEDSGSDELSVVFPGVIARCDGADLQIMLQKSFQEVKSRMWKDKFEQEDGEDTSSFEKIPLQILERKQVQPLCLMRQLFGLMPPPRLALQSSQRHYC

SEQ ID NO: 108915 - protein, 146 aa, Triticum aestivum
  Clone ID: PAT_TA_3333.pep
MTGQRLYQGTWVMEGWIPGIVQIQNGGGFTPRRGDVILASPPKCGTTWLKALAFATMARGAHPPAAPDHPLLRHTPHDCVPFMEVIVSGGWGSKLDALPSPRLLSTHMPYSTLPAPVPEDPVCWSAYGCRLPGVMGLAIWLFLFGD

SEQ ID NO: 108916 - protein, 176 aa, Triticum aestivum
  Clone ID: PAT_TA_3334.pep
MSQPSHPYPLRPPTRRLSSAASGGARGAGHAVRCAAAKEAILYALEHDEMFNSEEVIQWESGKTINSIAAAQGIRIRRRCRPRCPSEGSGPGPAAPPSIPGRTVWDKELEVSQRKAKKPLKSVVESSEHAPPARDFIGALTAAHRRNGVPALIAEVKKASPSGGVLRENFNPVEIA

SEQ ID NO: 108917 - protein, 208 aa, Triticum aestivum
  Clone ID: PAT_TA_3335.pep
LSKALQKTNILIKDILKKKPCSDVSECQLPGRSSRVPPASAFFKNFLEEDSLKSSLQVLEKEYVNGLDTKGELDARMFANDEDSLLGSGSLSGGALKLPGTKRKYDDVMASPTKSTASRAPMSPPRFCPSPNGNSFCNSKMAPFTPVSTAMTTAKWLRSAISPLPSKPSGELLRFFSACDKDVTDDITCRAAIILGAIFTGSSFGERM

SEQ ID NO: 108918 - protein, 147 aa, Triticum aestivum
  unsure (1)..(147): unsure at all Xaa locations
  Clone ID: PAT_TA_3336.pep
PYPPAAPRPHPVPTLPGGRIAXLASPSPPSPAAPLPLPPPAPCPSLPFLPPPPRASSGLAGSCRPPHQPSGKPPLAARATRVGTPRPTRLAASSTRSSPAPPATAAPPAPAPSPPPRPPSRRTRAACAASPRRSPRSIAAASARPGV

SEQ ID NO: 108919 - protein, 146 aa, Triticum aestivum
  Clone ID: PAT_TA_3337.pep
MSWRRGGGGGDGAVARRWVLLLCAGSFSLGLLFTSGMWTLPEATEVAKPNERRGKEAELAAIDCDSTKVGQKQDFRDTLQALDTHNAVQTLDKTIANLETELSAARTLQESFLNGSPVSQEYKASESTGRRKYLMVIGINTAFSSR

SEQ ID NO: 108920 - protein, 151 aa, Triticum aestivum
  Clone ID: PAT_TA_3338.pep
MRCEMEAQDDCGKWRQIPAFGDWNMWEEMPVTQYFEPAATALAAAHAGDLVVVPLFAPHPAAYPYSVDKCVVRVKKGEQDDKPNAKPRCRRRQGKKEQQQRRKKPKAKRAAAAAAVDEDLYKISPNVICKVQKKKLLRNLLGGCLGLNCIA

SEQ ID NO: 108921 - protein, 260 aa, Triticum aestivum
  Clone ID: PAT_TA_3339.pep
MLFMNFKPTNGRPANDTPYGKPANNTPYGRPANDAPYGRPNNKPHDSVDYFSKRREYPSGSPFASDAPPSASYDRYAASARLPTREMPLPVSPGADYMSHRSYHDHMPTDSYSSRGIQQLGLSRTGNSNMQQLGVTRAGNSNAYDYTEALGQAPGPLVCQWPAPLTGHSSPAAVLWIPNSSLESIVGAGGVNLAEIRQISGARMKLLEARPGSLESIMEIQGMPDQVRVAQSLLQGFIGANSQSVQPSQSSRDVHYPRWN

SEQ ID NO: 108922 - protein, 293 aa, Triticum aestivum
  unsure (1)..(293): unsure at all Xaa locations
  Clone ID: PAT_TA_3340.pep
EAPPFDEVDVQALAHAVELTRQGAIDSLKFAKGDLYQAFQNELCRMKMDLSLLDKLVHEYCIYRGIVQGCSHALPGTADMQCSQNIDVSFINNQGANNEAQLDCESAXKQDGGCCTSDITHHDSWSKRLRRVRSSTSGQGRRKRWRGRADDLNYAFETPVDANRDTLSPAFDMDEDVVIGEHDSVLDTGLSDTRNMQDQKYEVILEMRDLTRKGMASKVVDEINSIDPDFFSQNPILLFQLKQVEFLKLVAGGDHVAALKVASAHLGPLAASNQALLKPLKETLATLIQLNED

SEQ ID NO: 108923 - protein, 89 aa, Triticum aestivum
  Clone ID: PAT_TA_3341.pep
AAMAPESNGSGAGGGARRVEVDEVDNIAVFRDAVELMFQADAPWWLARAGVSRAIGVLEARMRCTSSFPCSYSHPSPPRPSPLAVVRRC

SEQ ID NO: 108924 - protein, 188 aa, Triticum aestivum
  Clone ID: PAT_TA_3342.pep
MGQSKPVLVLLLLAVSTAASSGKPLLTKITKGGAATALYTAPLSAGRPLVLDLSAPAITTPCSGQTTTVTLSANSTDGSNPLSLVSLAATATCAAAPSGAVGVAGLARSSASFPAQVASTQKVANSFALCLPSDGRTGFTGNGVGAAIFGGGPFFLAPPADRPSITTLLSDGVPLRQPFAGNPGYFVS

SEQ ID NO: 108925 - protein, 133 aa, Triticum aestivum
  unsure (1)..(133): unsure at all Xaa locations
  Clone ID: PAT_TA_3343.pep
MKERKPAAPSALARILATCASQAKDYGRCIAAKVPEIEHNMCSKEFLALRACMQTAVKNKXLKFKASVVWCEPPFSVISXSQMQGGLSSPGALSHAYVQHPPLRCDIPDIKGLFYDDANKFLVAPTADRILYW

SEQ ID NO: 108926 - protein, 207 aa, Triticum aestivum
  Clone ID: PAT_TA_3344.pep
ITRTTDSSFAVDSGGSRPIRGSARAIYEPDDASLPVASYYVTNSTRWGVSNIGRFMDSSNGSYIIYTSRRFTNTLDSELFQTARMSPSSLRYFGIGLKNGMYSVVLQFAEIFFPDDQTWKSVGKRIFNIYIQGDLKETDFDIKKQTNGKSYTAVQRQYTVEVTNNFIDIHLFWAGKGTCCIPDQGFYGPSISALSVSSYGTVTCAIN

SEQ ID NO: 108927 - protein, 335 aa, Triticum aestivum
  Clone ID: PAT_TA_3345.pep
DAWADAWVLIDRFLKRKMFEDAVDLFRFAMGGTEKPSAQDFVFLLKKLVVRDDMDLKLVMSVVRIYQKAGNEVKSSVFDAVIKSLRSVERLGESGRVLKAMEDGGFAPDSTVHGKAVLAMCDAGNLETAHKHLARVEKSGHKLDPPVWSALVQKYSLGDDVDMAVSCFPEMLERRSGNQVGSALEVLVYGLCRKKEAKEAFKVLKDLVLEKDVVPWQSTYKYLIHKLIRQGHLKEAFDVLGLMKSNGFPPYINPFITHILKSGTVDDALGLLNAMSSEEFPSRTVYMRLFQGLFKEGRHEIAQQLLSVSPGSVQNHADVLDLFYKMKIEEPTAAL

SEQ ID NO: 108928 - protein, 495 aa, Triticum aestivum
  Clone ID: PAT_TA_3346.pep
GSSRRRLSCRLPVCCCRTRCEPGRGGARLGGAGGGAPGGPGPMGSALAAPRTLTHGGGPAFFSWQLAPLFRVRGLVFPSRDSTEGCCLVAGSPAVGACGLRAAGQRRRLVPGHDAWLEDAFDRAAQLYLSYYRSIPKSLERATAHKLMVAMLNHDERFVEPSPHSLEKLTLQSVKEAVMNQFVGSNMEVSVVGDFTEEEVEACVLDYLGTVSAAKSSNKEEHIEKISFLPSPSDLHFQQVYIKDTDERACAYIAGPAPNRWGFATEGKDLFNDIRSSSADAEISAPANSGKTHINVRNHPLFFGITLSLLAEIINSRLFTTVRDSMGLTYDVSFELNLFDKLDLGWYVIAVTSTPSKVHKAVDACKGVLRGLHHNKIVERELDRAKRTLLMKHEAETKTNAYWLGLLAHLQSASVPRKDISCIKELTTLYESATIEDLYLAYEHLKVDDSSLFACIGIAGAESGEEVNDDEPELGLPGMVPMGGRGLSTMTRPTT

SEQ ID NO: 108929 - protein, 163 aa, Triticum aestivum
  unsure (1)..(163): unsure at all Xaa locations
  Clone ID: PAT_TA_3347.pep
TKVAKHSIAPLSLYLLDPHAKXQAAKFLVTLALGDIFQHEALARASDSVSACRALVSLLEDQPTDDMTMVAICALQSLVMHSRTNRRAVAEAGGILVVQELLLSPNVDIAGQAALLIKHLFSNHTLQEYVSNELIRSLTAALERELLSTSSINEVILRTIYVI

SEQ ID NO: 108930 - protein, 189 aa, Triticum aestivum
  Clone ID: PAT_TA_3348.pep
MGSVNFKIDSGTSMSCPHISGVAALLKSMHPNWSPAAVKSAMVTTANVRDEYGGGRVSEAAPYKQANPFDYGGGPVDPNRAAHPGLVYDMRPSDYVRFLCSLGYNNSAIASMVQQHTPCQHSPKSQLNLNVPSITIPELRGKLSVSRTVTNVGPVTSKYRARVEAPPGVNVTVNPSLLTFNSTVNRLTF

SEQ ID NO: 108931 - protein, 68 aa, Triticum aestivum
  Clone ID: PAT_TA_3349.pep
YKHNQMVILIQTDGVKQVRFIRGVLGPPSGPAGTQLKAKRCRLLPTPLYSFLGPFIKGGQESNLVMQV

SEQ ID NO: 108932 - protein, 127 aa, Triticum aestivum
  Clone ID: PAT_TA_3350.pep
HAPSSLHIIQHHGAHEKLPSRRGQTESRNSLARTHTHYRGKLNQGKKESQRKPKTSRQIIPQPISPSSSSCPPVAPRHLLRTYGRSRPRELGPCSSLVLQDHVVLGRQADARPHMFSSMALCFPTRP

SEQ ID NO: 108933 - protein, 192 aa, Triticum aestivum
  Clone ID: PAT_TA_3351.pep
MHPCSVCIPLTALSSRRPEPLSMLPVEWRRTGMKGSPYFGLNDTMENLLASVDKNEAEISPSTLYAIACVMEGVPFINGSPQNTFVPGLIDLAIKNSCLIGGDDFKSGQTKMKSVLVDFLVGAGIKPTSIVSYNHLGNNDGMNLSAPQTFRSKEISKSNVVDDMVSSNAILTEPPHRPLPCHRPPWRTSPHR

SEQ ID NO: 108934 - protein, 513 aa, Triticum aestivum
  Clone ID: PAT_TA_3352.pep
MFIESFRVESPNVRYGAGEIESEYRYDTTELVHESHDGASKWVVRPKSVNYHFKTNTTVPKLGVMLVGWGGNNGSTLMAGVIANREGISWATKDKVQQANYFGSLTQASTIRVGSYNGEEIYAPFKSLLPMVNPDDLVFGGWDISSMNLADAMTRAKVLDIDLQKQLRPYMESIVPLPGIYDPDFIAANQGSRANNVIKGTKKEQMEQIIKDIREFKEKNKVDKVVVLWTANTERYSNVSVGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKSTIVLHNTCEDSLLAAPIILDLVLLAELSTRIQLKAEGEDKFPSRPAPPLRCHPTRKPLSSSLPLASTQRDLALHRCYTVQLFIERIRFCTQLVPNRHVLSG

SEQ ID NO: 108935 - protein, 147 aa, Triticum aestivum
  Clone ID: PAT_TA_3353.pep
QVEGSSDDPVPDDGVEYDTSVQSSRDNVHLYDFHIVYSFSYKVPVLYFRGLQSGGQLLTLDEIKKDLPSHSLQLLNESKWTFITREEHPHLSRPWFTLHPCGTSDWMKLLLHKPGDKDRSLQYLSAWLSVAGQAVGLKIPLKLYCSS

SEQ ID NO: 108936 - protein, 235 aa, Triticum aestivum
  Clone ID: PAT_TA_3354.pep
KAVRQLISMISSDNRHVVEQACLALSSLASDISSAMQLTTRASVKPIEAVLKSFDDEELISVLQVVVTLTFVSDHVAQKMLRKDVLKSLKALCAHKNSEVQRLSLFAVGNLAFCLETRRTLIHSESLRDLLIRSTFSQEKRVSKAAARALAILGENENLRRAIRGRPVAKKGLRILSMDGGGMKGLATVQMLKQIEQGTGKHIHEMFDLICGTSTGGMLAMALGIKQMSLDQCEE

SEQ ID NO: 108937 - protein, 89 aa, Triticum aestivum
  unsure (1)..(89): unsure at all Xaa locations
  Clone ID: PAT_TA_3355.pep
MAKAGGGLIWATAEDLARNRPVVLSMYRQILRALNSPALPLGHAARLAKKAECRAIFIFGXEERSLHNIQDLLDAARHTLGLLNRGRLP

SEQ ID NO: 108938 - protein, 209 aa, Triticum aestivum
  Clone ID: PAT_TA_3356.pep
MAVPLVLVLLVAMFTGSDAMYCVCKSDANPAAMQKAIDYACGKGADCTQITSSGPCFQPSSVVAHCSYACNSYYQKNAGMGATCDFMGVATLVAADPSAGSCKYPASASGVGTGAGTGGMGTGGTGMGTGGMGTGTGSTGTGTGVSTGGMGSMTPPGATSTGMPGSPFGGGAYGPSGMNQDYNAAAVGRRVASAGLLVAAAAPLLLHLI

SEQ ID NO: 108939 - protein, 287 aa, Triticum aestivum
  Clone ID: PAT_TA_3357.pep
MAAPLVLILLVAMFTGSDAMYCVCKSDANPVAMQKAIDYACGKGADCTQITSSGPCFQPSSVVAHCSYACNSYYQKNAGMGATCDFMGVATLTGADPSAGSCKYPASASGVGTGAGTGGMGTGGTGTGTGGMGTGTGTSTGAGTGVGTGTSTGGMGSMTPPGATSTGMPGSPFGGGAYGPSMNQDYSAAVGRSAAWPPRGLLFGGSRSRSSSSAGDAAGGPLVGGRKGASAIPAGPMHFRRRFDGSIGRTGSVVCVCLSMSTSTLIKLTTPCGVCTGAGRGRVDEIW

SEQ ID NO: 108940 - protein, 132 aa, Triticum aestivum
  Clone ID: PAT_TA_3358.pep
AIMGAGDLNIQTEDGNIGMPSNVCCVIVEYLSGCALKIILIKNRRKKLSCKVVVQISVDLARGNGPPMPCSSRIGAKSPPPPPPSPCVQQRPREELEPQRWSMVPSPSSLAREAWAAETAGFVRPSRCRPST

SEQ ID NO: 108941 - protein, 125 aa, Triticum aestivum
  Clone ID: PAT_TA_3359.pep
GIRHEAQSNERASTFCSDHPMGSRSCSYVFLLGLCSLLLVVLSGQRTLARDTPVSTATALAPFVHAPAKGDAGGHRADVDKPRVSDEKPTITGIIWRPVPKIHCPSIFCGTKAATATAPAATAHP

SEQ ID NO: 108942 - protein, 119 aa, Triticum aestivum
  unsure (1)..(119): unsure at all Xaa locations
  Clone ID: PAT_TA_3360.pep
WRDVAQSHDAAASVLRADLQRVLDAQAVRGGGDGQDQDDAESCCWGENQAPVCAEEEEAEVGTPAPTGVGRCKGCGDGAVVVLLLPCRHLCVCAXCAASAXACPSCGCAKNGSVCXNFS

SEQ ID NO: 108943 - protein, 240 aa, Triticum aestivum
  unsure (1)..(240): unsure at all Xaa locations
  Clone ID: PAT_TA_3361.pep
HASEFDHLXKLIQLTFIPLVRYCPRERWDEWVLLLLEYLFFYCEDIFRYAWLSLIHEGRAKVPAFFGDLYGPEEKLKKSVAPLLIKFTRSVSSLLKVLASEELNSGLPDLNCPKSDLKSISSSSLMGYLLLHNCFGRFSMYLFGCLVDYQSAKEALPFFHALIRLAVATDDERLKQFILNEMLPTLVRFDDRRPPSGISRLKSESNSGIEVSSMKDIVCLCQEIYNVYLQNQVTMTNGEM

SEQ ID NO: 108944 - protein, 246 aa, Triticum aestivum
  unsure (1)..(246): unsure at all Xaa locations
  Clone ID: PAT_TA_3362.pep
MGSTGSPSVAALPTSGLLPPIRTPRSAPAEWKTDDDSAVAAAEEEPVTPSARLFEAIYIVVMVGLGSPVNLAIFSAGIAAQLARYPRFRSIQVTDGCKSPRWACTEVNVDDHMIVPTLDPAAVEADPDRAVEDYVASLQALPMDCSRPLWEFHFLDFPTSEXXSTVVFRVHHSLGDGMSLITLLLASARSAADPTRLPAMPEQPARTGAIYEPRHRQPLPSGALAAFVAWVWPYLALAWNTVVDVI

SEQ ID NO: 108945 - protein, 117 aa, Triticum aestivum
  Clone ID: PAT_TA_3363.pep
HSMNHSVSAPEAAVVPDAAVAPVVSRGREREARLMRYREKRKSRRFEKTIRYASRKAYAETRPRVKGRFAKRTGTADADGLEEHEEMYSSAAAAVAALMAPGPDHDYGVDGVVPTLV

SEQ ID NO: 108946 - protein, 141 aa, Triticum aestivum
  Clone ID: PAT_TA_3364.pep
FRIHRILISKGGATHVDIACDQDLVKLALELTNLPICVSSVDPSAFQSAVEAGAQMIEIGNYDSFYDAGIEFSSEQILNLTRETRKMLPDITLSVTVPHTLSLPDQMRLAELLEEEGADIIQTEGGKCSSPTKPAVLGLIE

SEQ ID NO: 108947 - protein, 88 aa, Triticum aestivum
  Clone ID: PAT_TA_3365.pep
MSSVFSGDETAPFFGFLGAAAALVFSCMGAAYGTAKSGVGVASMGVMRPELVMKSIVPVVMAGVLGIYGLIIAVIISTGINPKAKPYY

SEQ ID NO: 108948 - protein, 174 aa, Triticum aestivum
  unsure (1)..(174): unsure at all Xaa locations
  Clone ID: PAT_TA_3366.pep
MSGSAGSPPYAAELAAAKKAVALAARLCQTVQQEILQSDIQSKADKSPVTVADYGSQVLVSLVLNMEVTSGSFSMVAEEDSEDLRKDSAEEILEHITDLVNETLAEDGSYNITLSKEGILSAIDTGKSEGGPSGRHWVLDPIGFLXRGGQYAIPLALLDEEQSVXGRVGDDQIL

SEQ ID NO: 108949 - protein, 126 aa, Triticum aestivum
  Clone ID: PAT_TA_3367.pep
MLHPTSCAGPGARLFPVVWPMRSLRASSTTDGKAARPLPKLTLFRQFYVVVIGYLYFTRIIVYALKTITNYKYRWVSVAAEEVATMAFYMFMFYMFKPAERNQYFALDDDEEEAAEMALREEEFEL

SEQ ID NO: 108950 - protein, 358 aa, Triticum aestivum
  Clone ID: PAT_TA_3368.pep
MSRPAGNPSYAAELGAAKKAVALAARLCQTVQREIVQSDIQSKADKTPVTVADYGSQVLVSLVLNKEITSGSFSMVAEEDSEDLRKDGAEEILERITDLVNKTLAEDGSYNISLSKEAILSAIDTGKSEGGPSGRHWVLDPIDGTKGFVRGGQYAIALALLDEGKVVLGVLGCPNLPLTSISNLNGSSSGDQTGALFSATIGCGAEVQSLEGSPPQKISVCTIDNPANASFFESYEGAHTMHDFTGSVAEKLGVQAPPVRIDSQAKYGALARGDGAIYWRFPHEGYRETIWDHAAGSIVVTEAGGVVKDASGNDLDFSKGRFLDRDTGIIATNKQLMPSLLKSVQEAIKEKSQAPSPL

SEQ ID NO: 108951 - protein, 228 aa, Triticum aestivum
  Clone ID: PAT_TA_3369.pep
AGRFGLDHLFSNAPDAIVEAQTKSQSDNRKARALAWVDERADPDPSLHHTQTGETLCSSPYQPASLATRPPRSSTGKEARPGSKGGARRARCRRCSGGDETAPLLRLPRRRRRPRLLMHGGRTYGTAKSGVGVAVHGTSCGPELVMKSIRARSSWRGVARNLAGLSHHPVIISTRELQTPRPRPYFPSSVSASAHLLIRGSPCVAFAGPPPAGHGTFGIVGGCWVVMG

SEQ ID NO: 108952 - protein, 484 aa, Triticum aestivum
  unsure (1)..(484): unsure at all Xaa locations
  Clone ID: PAT_TA_3370.pep
MLHPVHRLPATPSRPAVHPHVSPAPPSLRLRRVAGTRPTTPVVCCSGFVGSLPVANQGSEFEPRSRSIYGGRGSVAIDPRFMASKNSTRGRGKHLASPSASLNHAPSPRFRHRRGSRFIVRAESDFYSVLGVSRNASKSEIKSAYRKLARSYHPDVNKEPGAEQKFKDISNAYEVLSDDEKRAIYDKYGEAGLKGSGMGTGDYSNPFDLFESLFEGFGGMGGMGGGRAARNRPMQGDDESYNLVLNFKEAVFGVEKEIEITRLEGCNTCDGSGAKPGTKPTTCKTCGGQGQVVSSTRTPLGIFQQVSTCNTCGGTGEFSTPCKTCGGDGRVRKTKRISLKVPAGVDSGSRLRVRSEGNAGRRGGPPGDLYVFIDVLSDSVLKXRDGTNILYTCKVSYIDAILGTTVKVPTVDGVVDLKIPPGTQPGTTLVMSKKGVPLLGKSNARGDQLVRVQVEIPKRLSSDERKLIEELANLNKAEPANSRR

SEQ ID NO: 108953 - protein, 177 aa, Triticum aestivum
  unsure (1)..(177): unsure at all Xaa locations
  Clone ID: PAT_TA_3371.pep
AWSRPRYVDDDIGDGFSFSGGKYAEAEGPSKSDEWFAQGRMVKAHALYGNKEKAKDPFFGLTMGSGSQSSGDVFNWFCAEAGSSSNPTVLLIHGFPSQAYSYRNAYSYRNVLPVLSDKYRSIAFDWLGFGIXSDKPQPKYGFDYTLDEYTSTLGIVNRCCCSWISSPMLSRVLRSKL

SEQ ID NO: 108954 - protein, 365 aa, Triticum aestivum
  unsure (1)..(365): unsure at all Xaa locations
  Clone ID: PAT_TA_3372.pep
SICRLFSYEELKLATSNFSPDMLIGKGGTSHVYKAQLYDGTLYAAKILKPSVDALQEFITEIETVTNLQNENIVSLRGFSFDIACPRPGYDYMHQGSLDKALHGKCEYSLSWEKRNKIAIHIAKALEFLHHGGVTESVIHGDVKSANILLSEDFEAQLCDFGLAKKVSASTPHLTCTDITGTFGYMAPEYFSHGKVNKKIDVYAFGVVLLEIISGRKPIITGCAKGQESLVGWARPLLSSGEIKQLVDSALGNDYXDCDEMERMTLAASLCTRTSSDSRPEMPLVLKLLEGDDETVQWARSQMCAGSDVPDEEAMTPAXPNMQSHLNLALLGVDEEEDTLSRCSTERTADTSADGGYWSRSSSFD

SEQ ID NO: 108955 - protein, 259 aa, Triticum aestivum
  unsure (1)..(259): unsure at all Xaa locations
  Clone ID: PAT_TA_3373.pep
MAADGADSDLEEQLKDVGARLQEAPDDSDGLLKLLXDVEKYLLRVXQSPASKAHFAAVRPAMDALIKNELLTHPNAEVKLAIASCISEVTRITAPEAPYDDNIMRDLFSIIVGTFQNLDDIESPSFARRISILETVAKVRSCVVMLDLELDDLILQMFNHFFTTVTSNQPEIVISSMVTTMKLVIDESEEIQTALASYLLQKARNEERETSPASFELAEKVISSCEDGKLKPIFLQLLQVQGNPLDEYSKIVTLVCEGD

SEQ ID NO: 108956 - protein, 95 aa, Triticum aestivum
  unsure (1)..(95): unsure at all Xaa locations
  Clone ID: PAT_TA_3374.pep
MALSSVFRRVNIKELISNVPVYTSSTETSGGMSLVFRRWATKKXTAGSTKNGRDSNPKYLGVKKFGGEKVEPGNIIVRQRGTRFHPGNYVGMGKD

SEQ ID NO: 108957 - protein, 82 aa, Triticum aestivum
  unsure (1)..(82): unsure at all Xaa locations
  Clone ID: PAT_TA_3375.pep
AFRRVNRRVNIKELTSNVPXYTGSTETSGXGMSLVVKRXATKNDXAGSTKNGRESNPNSEGXVKRFGGRERWNQGNGIPVHQ

SEQ ID NO: 108958 - protein, 622 aa, Triticum aestivum
  Clone ID: PAT_TA_3376.pep
MEGAAGRERDPLLRSEIHGFITYADLNFEKLKAEAASRWFRPNEIYAVLANHERFKVHAQPIDKPVSGTIVLYDRKVVRNFRKDGHNWKKKKDGKTVQEAHEKLKIGNEERVHVYYARGEDNPNFFRRCYWLLDKEAERIVLVHYRQTSEENAIAHPSTEAEAEAPTMNVIQYYTSPISANSASVHTEISFSPLAPEEINSHGGSAFSSDTGGSSLEEFWVHLLESSMKKDTACGASVAFSQQIKCGTKNSGNDTVAAAEVHANHAGALEHQVDQSQYPLTSDLDSQSQQFATSLRKTPVDGDIPNDVPARENSLGLWKYLDDDSPCLGDNIVSNGKIFNITDFSPEWACSTEHTKILVIGDYYEQYKHLAGSNIYGIFGDNCVAANMVQTGVYRFMVGPHTAGRVDFYLTLDGKTPISEVLNFEYRSVPGSSLHSELKPLEDEYTKSKLQMQMRLARLLFVTNKKKIAPKLLVEGSKVSNLIRTSREKEWMDLWKIAGDSEGTSVHATEDLLELVLRNRLQEWLLERVIGGHKSTGRDDLGQGPIHLCSFLGYTWAIRLFSVSGFSLDFRDSSGWTALHWAAYHGREKMVAALLSAGANPSLVTDPTAVSPGGCTPADLAA

SEQ ID NO: 108959 - protein, 209 aa, Triticum aestivum
  unsure (1)..(209): unsure at all Xaa locations
  Clone ID: PAT_TA_3377.pep
LLSDSCVPLHSFDYVFNYLMGTNISFIDCFQDPGXPHGNGRYSXEMLPEIRGEETPERGAQWGPQSTPKDMLCWIPGRTTFYYKKFXAILXSQQDGRNCIAXDQHYLPTLSNMVDXQGGIANWSVTHVDWSEGKWHPRSYAVADVSYDLLKNITAVDETIHVTSDDKKLVTQKPCLWNGSKSPCYLFARKFYPETLDSLLKIFTSYTSV

SEQ ID NO: 108960 - protein, 241 aa, Triticum aestivum
  Clone ID: PAT_TA_3378.pep
MGATASVLSLPVAASFPGAATAIAGAAGCFALGYFLALARLPIHAAAAPDSGEDDSEEDSDEDDDENSGRAWPAKRAAGRKRTGLRLLFWSRNVVTKSDSAREAERAQAQTASAPLEIENLAKIIEDFKMVLVVRNDLKMGKGKIAAQCSHATLGLFKKLQQRAPKSLRRWERCGQVKVVVKVESEEDMLVLQGRAKSMNLPTHITIDAGRTQIAPNSRTVMAILGPADMVDDVTGGLKLL

SEQ ID NO: 108961 - protein, 155 aa, Triticum aestivum
  Clone ID: PAT_TA_3379.pep
RGGPGLSARRAPTRSRKGQSRRSHRLPCGLDLEVIAQQPPSPPPTPGRSERPPLVFVHGSFHAAWCWAERWLPFFSRAGFPCFALSLRAQGESSIPSDTVAGTLETHTGDIADFIRKEVPVPPILIGHSFGGLIVQQYISCLQGSEPFHPKLSGA

SEQ ID NO: 108962 - protein, 130 aa, Triticum aestivum
  Clone ID: PAT_TA_3380.pep
RTQIVLTVSCGWTDRRQCEARTGSAPQTGLTGHAPPGRSIQAGAAAARPHLLAQPGACGFFLALESSDACGEDSRVSARPFSRSQICAHLRLRPGLGPQAGLQLSRRTAPDPSGLHLFNQDQGESGSGHC

SEQ ID NO: 108963 - protein, 246 aa, Triticum aestivum
  unsure (1)..(246): unsure at all Xaa locations
  Clone ID: PAT_TA_3381.pep
MGLISGGVFFKILAFLCFITLSQGRNHSATPDLPPLRKASSFSKIQHEAYDYIIVGGGTAGCPLAATLSKKYKVLLLERGGSPYGNRNISXLRNFHICLTDESKNSPSQGFISTDGVINSRAKVLGGGTCINAGFYSRANRRFVKDAGWDEELVNQSYPWVEERIVYWPKIAPWQAALRDGLLEAGVSPYNGYTYDHLFGTQVGGTIFDEAGYRHTAADLLASANPDNLRVLLHARVNQVIFKTRH

SEQ ID NO: 108964 - protein, 128 aa, Triticum aestivum
  unsure (1)..(128): unsure at all Xaa locations
  Clone ID: PAT_TA_3382.pep
NNQFGPSPDFENMNCVLPKLMLCSSPCIYVISPDMRSHQFHRMRSHPLGRCTSWQTPFKYDLWPGSGARRLYLHASVEGTSRKYCCFPIVKVSMLFRFQYVNKHTGIFIRAKITNGNLXSSXYIFYNN

SEQ ID NO: 108965 - protein, 278 aa, Triticum aestivum
  Clone ID: PAT_TA_3383.pep
METGGSKREGDCPGQERKKKVRRRSTGPDSVAETIKKWKEENQKLQQENGSRKAPAKGSKKGCMAGKGGPENSNCAYRGVRQRTWGKWVAEIREPNRGNRLWLGSFPTAVEAARAYDDAARAMYGAKARVNFSEQSPDANSGCTLAPPLPMSNGATAASHPSDGKDESESPPSLISNAPTAALHRSDAKDESESAGTVARKVKKEVSNDLRSTHEEHKTLEVSQPKGKALHKEANVSYDYFNVEEVLDMIIVELSADVKMEAHEEYQDGDDGFSLFSY

SEQ ID NO: 108966 - protein, 201 aa, Triticum aestivum
  Clone ID: PAT_TA_3384.pep
LYTQVGDGNADHGCWERPEDMDTPRTLYKITADSPGSEAAGEAAAALAAAYLVLKEDGDKAFASRLLAASKSLFELANNYRGSFQSSCPFYCSYSGFQDELLWASAWLYRATKDGKYLDFLRQNQGSSNPVNEFSWDNKQVGAQMLATQEYLKGRRELDRYKANLDSFVCALMPDSGNTQIRTTRGGLLFTRDSVNMQYTT

SEQ ID NO: 108967 - protein, 224 aa, Triticum aestivum
  unsure (1)..(224): unsure at all Xaa locations
  Clone ID: PAT_TA_3385.pep
GSCNSLVALDLSHNDITGPIPSTLGNLTSLQAVDLSQNRLNGTLPVELSNLPSLHIFDVSHNLLSGNLPNSRFFDNIPDYFLSDNSGLCSSRKNNSCGAVMPKPIVLNPXNSSSNPLSQSTPSSPSSKHHKKIILSVSTLIAIAGGAAIAFGVITVTVLNRRVRSAASHPKPAIALSDDYLSRSPENDASSGKLVMFGKGSPEFSTCWHALLNQDCELGRRGFG

SEQ ID NO: 108968 - protein, 198 aa, Triticum aestivum
  unsure (1)..(198): unsure at all Xaa locations
  Clone ID: PAT_TA_3386.pep
PRGHSSDRASACGSGLEAVADGGPATAAEATPTPAGGVRVERVRARSAVTRSFAPYPLTLPPPPSGAPSSPGAVSLSPCAFGPVPVSASQFTCGVPDAGGGPSAGSSQASPSVHAAGGALRPGHGRGPALGGDALPAVLPGPLACGSTARXPVRESPPGAGDSNLVIVNWFTSGRYESGEKWDFNFYKSVNHILLEEY

SEQ ID NO: 108969 - protein, 321 aa, Triticum aestivum
  unsure (1)..(321): unsure at all Xaa locations
  Clone ID: PAT_TA_3387.pep
MARQWAAATLLCLAVLAAASVLAAAVEGAVTYDRKAVLISGQRRILFSGSIHYPRSTPEMWEGLIQKAKDGGLDVIQTYVFWNGHEPTPGNYNFEGRYDLVRFIKTAQKAGLFVHLRIGPYICGEWNFGGFPVWLKYVPGISFRTDNEPFKAAMQGFTEKIVGMMKSEELFASQGGPIILSQIENEYGPEEKEFGAAGKSYSDWAAKMAVGLDTGVPWVMCKQEDAPDPVINACNGFYCDAFTPNSPSKPTMWTEAWTGWFTEFGGTIRXRPXVEDLSFAVARFVQNGWAPFYQPXHCIIGGTNFGXTGWEXPFITTKPMM

SEQ ID NO: 108970 - protein, 191 aa, Triticum aestivum
  Clone ID: PAT_TA_3388.pep
SARAAASFASSNCQDPSTRAATHPTRDIAVLGSSINYVVMEYFARGWKATVWSISTNSLPGEGWGIRYHLDSSNLQGLEGEPATAPYIGLPKLSLQDDGTVFFLKQVDYRDPHQPAWVLAVDMRNKTVQKVAKFIPSGLYVDYETSRISKYLKVAPGTKQITKRPGTPLLKSPSKKHTGDTDDPMTAIDVC

SEQ ID NO: 108971 - protein, 291 aa, Triticum aestivum
  Clone ID: PAT_TA_3389.pep
EGLMGGIGDLRQVEAKYPALLFKQQLTAFLEKIYGMIRDNLKKEISPLLGLCIQAPRTSRASLIKGSRSQANALAQQTLIAHWQSIVKILTNYLNVLKANYVPSFLISKVFTQIFSFINVQLFNSLLLRRECCSFSNGEYVKAGLAELEQWCIYATEEYAGSSWEELKHIRQAVGFLVIHQKPKKTLKEITNDLCPVLSIQQLYRISTMYWDDKYGTHTVSSEVISSMRIMMTEDSNNAVSSSFLLDDDSSIPFSVDDISKSMTEIEVTDVDMPPLIRENSGFTFLHQRKD

SEQ ID NO: 108972 - protein, 253 aa, Triticum aestivum
  Clone ID: PAT_TA_3390.pep
MEVDPSPSPSPPPPPMSTPGYFDPESSRLREEYRRYRKRLSSSNDSPMLGTSFSRFSEARALHDGSSIPRRPNAGLLLEEVKQEAADYSDIDGLNGPKLLDGGSGRKAARSTLNLVKLEDDMPREGETTFTAFASLLDSAIQGLMPFPDVILQFERTCRNASESLRYAAIGKVRMVEDKLMQQKAQLLLDEAASWSLLWYLYGKANEELPEGLFMSPTTSHQEACRYVATDLTAQLCLRIVLWLEGLASESLD

SEQ ID NO: 108973 - protein, 96 aa, Triticum aestivum
  unsure (1)..(96): unsure at all Xaa locations
  Clone ID: PAT_TA_3391.pep
PTRPRTRGPRATPKKKPTAHHSPLSPRXRTLALSPSQPRTPLLLLDPPPPPSGSRSAATPXSRSRESSPPSSCSRPCPSLPLTPRRQRRRPSTSPT

SEQ ID NO: 108974 - protein, 171 aa, Triticum aestivum
  Clone ID: PAT_TA_3392.pep
SVVTYSLSRLSEFLSPIRTVRLTRDRATDAAAIRRLLAGGDLVVCPEGTTCREPFLLRFSSLFAELSDDIVPVATECRMSMFHGTTARGWKGMDPFYLFMNPRPQYTVTFLDRLPAEHTCGGGGRSSHEVANHVQRLIASALSFECTGFTRKDKYLALAGNDGVVGPSKGT

SEQ ID NO: 108975 - protein, 91 aa, Triticum aestivum
  unsure (1)..(91): unsure at all Xaa locations
  Clone ID: PAT_TA_3393.pep
MTTGSNADHYGPPSYPQRRPHYGGAPPSYGSSASFRGCCCCIFMLXIFLALLGXLPSPLVVVLAVKPREPQFDLDQVAVQYLLGGPAPGLR

SEQ ID NO: 108976 - protein, 147 aa, Triticum aestivum
  Clone ID: PAT_TA_3394.pep
AEINFGGETAIAKTAGLVDPDAGLVDYVETLVRKPETEFNVVVLQLNGIDQPKEAVHVLNVGRLRMRLSKGKTVVAKEFYSSSMQLCGVRGGGEAASQAMFWRPRSDLSFAVAFETARERNTAIMLARRFAIDCNIILAGPGDKTPW

SEQ ID NO: 108977 - protein, 198 aa, Triticum aestivum
  Clone ID: PAT_TA_3395.pep
QVQRCAEDRTILITTYEGTHNHPLPPAAMAMASTTSAAASMLLSGSMPSADGAGLMSSNFLARTVLPCSSSMATISASAPFPTVTLDLTHAPSGAPNAMPLNVARPHAPGQFHVPMPGGGMAPAETGGPNLTVSAAAAAITADPNFTVALAAAISSIMAGQHAAGNSNANNSNNNTSNNNVTTTSNNTTSNNTNSETQ

SEQ ID NO: 108978 - protein, 245 aa, Triticum aestivum
  Clone ID: PAT_TA_3396.pep
MDKGHLGGGGGGGGLLALDASPRQLGFLNLLSPAPFHRSMEADDGGGGGGGGRGRRSIEVDFFSDEKKNMKKSRASAGADAEDHKDQASAAGLAIKKEDLTINLLPGNNTRSDRSMVVDDDGASRADQDRNGRNTGELAVIQAELSRMNEENQRLRGMLTQVNNSYHALQMHLVALMQQRTQMPPVQPQQPPTHEDGKNESAIVPRQFLGLGPSGASADVAEEPSNSSTELGSPRRSSSNGKRDP

SEQ ID NO: 108979 - protein, 258 aa, Triticum aestivum
  Clone ID: PAT_TA_3397.pep
GWPRPSRCRRTCCTTSPSSLGCRCPPTRWTPGSSRSIGRPGRARAPRYVSSSPPLPPPLPPPSPRKAPLSPPGPRPICMDKGHLGGGGGGRGLLAVDASPRELASLNLLSPAPFPRRQEADDGGGGGGGAGRRSVEVESCPHAETDSKEGGASAGGRAEDRGAQPSPSRRACPTNKPTANRYTGTSTRSTRGSALSHDHRSPRQASCPTPSAQRRLRSPRTRTSPWPSPRPSRRSWPASTPPATATRTTATTTPVTTM

SEQ ID NO: 108980 - protein, 272 aa, Triticum aestivum
  unsure (1)..(272): unsure at all Xaa locations
  Clone ID: PAT_TA_3398.pep
TLASSAAPSPLSSPPPRRVAPPNSGPPPFRSFFRESCSEDEVCRPCGNSIPRRAHKXRAQPESRKKYGLLEKHKDHILRARAYQRKEDFIRNLKEKASFKNPDEFYFKMMNSKTVDGIHRPKPEANNKYTEEERMLLKHKDMGYIFQAVQSERKKVERLSSTLHAVDDKRSNKHIYFAEDREEAKEIRSRIGESSSAPQFGNIPSRIKRKTASSYKELESRKERVKNLEKLYADMALQKELKKPGRKRKLREEEILNSASQPVYKWRAQRKR

SEQ ID NO: 108981 - protein, 255 aa, Triticum aestivum
  unsure (1)..(255): unsure at all Xaa locations
  Clone ID: PAT_TA_3399.pep
ERVVFVGDSMSRTQWESFICMLMPGVEDPKTVYEVNGNEISKTIRFLGVRFASFDLTVEFFRSVFLVEQRPAPRHAPKRVKSTLRLDKMDNISRKWVNADVLIFNTGHWWTPTKLFNTGCYFQAGRALKLGTTIDAAFRMALQTWASWVEKRVDLNRTHVFFRTYEPSHWSDLNQTICEVTEKPSPEAKGNDKSELGDILGDVVASMNVPITVLNVTLMGAFRTDAHVGRLXSYPPTILDCSHWVSPWEFQDAWE

SEQ ID NO: 108982 - protein, 239 aa, Triticum aestivum
  Clone ID: PAT_TA_3400.pep
ARGQRRLEFSGAALGFRMEPEEAEAVLETIWDLHDKVSDAIHALSRAHFLRAVRRRAGGKAPGVVHIKGVPADGDEAADLNAVAEEARSLHAIRAALEDLEDQFECFLAVCSQQQAERDIALARLQQSHIMLTIRLKEHHGNNHKVIDEALDFVHNVYHDFWSFLSVNNPEKSRAHSGANSTKETGDGSDFLGWMVSSSLDVVRNSFNMKNIGGFLGNTAVLAVGMITMLQLHLSSSGE

SEQ ID NO: 108983 - protein, 215 aa, Triticum aestivum
  unsure (1)..(215): unsure at all Xaa locations
  Clone ID: PAT_TA_3401.pep
PVQVAAVAGEKRAAALTSGSIYVVSAGTSDYVQNYYVNAMLAAAYTPDQFADALMQPFTAFVERLYGLGAXRRIGVTSLPPMGCLPASVTLFGGGGGGXGCVERLNNDSLTFNAKLQAASDAAKKRHSDLKLVVFDIYNPLLNLVADPMSAGFFESRRACCGTGTIETSVLCHQGAPGTCANATGYVFWDGFHPTDAANKVLADALLLQGLQLIS

SEQ ID NO: 108984 - protein, 367 aa, Triticum aestivum
  unsure (1)..(367): unsure at all Xaa locations
  Clone ID: PAT_TA_3402.pep
MADHAADEEEPPVLLDRAARATRGKRITKLVEEEVELDEAFWGQEALKEDEEDDNYQEEQDAGDVFDSDFDEDEPQPDDDPEKEVSERLPIKKRLFFPGKTMKKMKAKKKKKKNKVIKLEDDEGIDDKNPDKTTSSKQSDVPDEWESEKTIRKSTRTSVIVRQAEREAIRAEKQATAKPIKKRKEGEEKRMTQEEMLLEAAETEIMNMRNLERVLAREEEVKKKXAVVQKAVYEGPTLRFHSRDGESRLEFINGASFGSELCTTSTPYPEKSVCVVTGLPAKYRDPKTGLPYATMAAFKIIRESFLKEEPDKKRPNMSNMGELFESVAGEHSTPKKKRIESRSPISGDLRHGGRFRRIPALDVMDED

SEQ ID NO: 108985 - protein, 162 aa, Triticum aestivum
  Clone ID: PAT_TA_3403.pep
SPPAAFPPPPRRPPPPPPPPPPFQAAASSSSTTSSPPSASSAASPPTRSPATPVSRCEEETMKLDVNALRYLSKDDFRVLTACEMGMRNHEIVPAELVDRIAGLMHGGTYKMLRNLGQIKRVHHDANKNLGYPGTLLRLAPNSVLGKDQIYFRSHGGWKMLA

SEQ ID NO: 108986 - protein, 139 aa, Triticum aestivum
  Clone ID: PAT_TA_3404.pep
LRGPLWIRDARAPALGGGPTDPPHTLRTVGRGRCWWRGGRRRPVSPLCNVDECLLPSCSGELTRQSTPWSWLRWFGLCSWTGRNLRTACRCWQRRRLWVPFPSWGAAMALIMSLLELRGKPLFRPFGTGDGGVTASLPS

SEQ ID NO: 108987 - protein, 235 aa, Triticum aestivum
  unsure (1)..(235): unsure at all Xaa locations
  Clone ID: PAT_TA_3405.pep
MLHTRLSSTDNASTTLNGRQEGLGPMHTPGMVSEHSGMRNHQHRALDAARNDNIGSFGNAASGNKDEGSIISDILSLEFDPWDESYSTANNFVKMLNESEKNDALFNAPSWKSKGHXNESRFSFARXDNQRNFQDSSFRNCGTDQNFSLLSQNSHGNSYQNGVAFQSPEEDFSKSNPLAMSDIATAGSSRSKISAPPGFAAPARVPPPGFSSQDGLNPPPGFSSGFSSQDMLNHP

SEQ ID NO: 108988 - protein, 372 aa, Triticum aestivum
  Clone ID: PAT_TA_3406.pep
MAGSVRCSAAARSYSITLLPGDGIGPEVVAVAKDVLSVAGSKEGVELRFQEMLMGGAALDAAGVPLPDETLAAARASDAILLGAIGGYKWDNNEKHLKPETGLLNIRAGLGVFANLRPATVLPQLVDASTLKKEVAEGVDIMVVRELTGGIYFGKPRGFGTNDKGEETGFNTEIYSVAEIDRIARVAFEVARKRGGKLCSVDKANVLEASMLWRKRVTAIASEFPDVELSHMYVDNAAMQLVRNPKQFDTIVTNNIFGDILSDEASMITGSIGMLPSASVGESGPGLFEPIHGSAPDIAGQDKANPLATILSAAMLLKYGLGVESAAKRIEAAVTETLDNGFRTGDIYSPGTTLVGCKRMGEEVLKALESQK

SEQ ID NO: 108989 - protein, 125 aa, Triticum aestivum
  Clone ID: PAT_TA_3407.pep
ASCGSRTPSPRSGNCRGPGSKERPLGLSFPRGPDLLDCTARTNLEMLSKHYYEAASSWVVFFVPENDADMAAYNDFMNYLGDKQRAAVCKLGERSTLFLVPPSDFSEHVLKVPGKVSISGVILKF

SEQ ID NO: 108990 - protein, 226 aa, Triticum aestivum
  Clone ID: PAT_TA_3408.pep
MNSRSYNKLDTANDKMDFNTRGNTAFNGTLDRNQSGVSANPSTASKPAAHSQIPMDFSTRGNTAFNGALDRNQPGVSANPSTASKQAAHSQIPSDKKPRPKKEDFADKGNPNHMTKRLVNPAESPVLTPTKAASRGMNSNTQEKLSDSALTIPQGSADSPRSNSLDSCMSGHVKHHTGGDCRWEAVQLASSRDSPLSLVHFRLLKRLGYGDIGSVYLVELRGTDTF

SEQ ID NO: 108991 - protein, 259 aa, Triticum aestivum
  Clone ID: PAT_TA_3409.pep
VFVHYLILPTTLFAGEQRKLVLDESTTRQAMQLFKETKIILLSSMSSWGSGSPEEIERSWCACVLYCVSKLGNAGKAKEDRGITLRQILRAFDLKIVDFFKEMPQFCIKVGFILTGLYGSDWEKRLELQELQANLVHLCSLGRHYRRAYQELFLLNDGKPANNSSELNVQQASEYYDFGWLLFLVLRNQASSAVKNLLTSTTELVSVLAVLIIHIPVRLRNFSIEDSSCFAKKSDKGVNLIASLCERYLTSEDELSKAL

SEQ ID NO: 108992 - protein, 263 aa, Triticum aestivum
  unsure (1)..(263): unsure at all Xaa locations
  Clone ID: PAT_TA_3410.pep
MELTNIPHLASSSSFFFSSCRSRRRTGRAVITALAAGSRCSADSACPEPIEQHNVDSLSVASGPANTQCYRRRGFAAVALLPFLLPHVDMASAADSYDGSIIQNGVRNVLSKVKAAGVLRLVFHDAGTFDISDKSGGMNGSIIYEADRPENAGLSKSLKILRKAKEGIHQVQQVSWADLIAVAGXAKQLHPGGGPEIPIRLGRLNPSTAGSEPVTSLKETLGVXGLENIISQKGLSALGPAVSPGAQPIGGKGSGSSALSPNP

SEQ ID NO: 108993 - protein, 79 aa, Triticum aestivum
  Clone ID: PAT_TA_3411.pep
PRARSAPLRHLSFSLFSFLLLPGSSSPPTHLSPSLCSRKRPWPSAKPDRALPPSAIRRAGQPPLRRGPAAIPPPQISPD

SEQ ID NO: 108994 - protein, 326 aa, Triticum aestivum
  Clone ID: PAT_TA_3412.pep
MADDGASGAGGSTARDGADGPEPATIEINIKTLESQVHKLRVDKNETVLNLKEKIVDVAGIPVEQQRLIFRGRVLKHDHLLSEYHSEDGYTLHLVARRTAEGQHSSETPEANPNANASGAGNGAMLGDYMSRTVRDILGNFLGMPGGVANATFSVPLNHPPPDGANNGRAQPGQAPPGFSILNHQIHVSQLPPSGAIPRNMVVPDSMTTLLEYINRMDQVLQNNGVPPSVDSNAQEPPTPATDDAYLNQSFPSPEVLASVVERAQQLLGGSASSALSHLAQRIQTDAATADPSVRSQIQNESAQLGVAMQHLGSMLFELGRTMMTL

SEQ ID NO: 108995 - protein, 179 aa, Triticum aestivum
  Clone ID: PAT_TA_3413.pep
LRLNRWLDTFPFLGMIWSCEEVKHPTQGQIARTKQPSIEHEIMDPFSATMFAPEWVIGSRLDLHRKLLQQLTVLACQSAIEQLVPFPSGKSGVQALFQAFDLLREILFRRINPRALCAAASSDGGAGTGRLAAVEEPRELHLLLQRAAAEPPRHALERRRRHGLVSWDPCPCVSSPAGA

SEQ ID NO: 108996 - protein, 168 aa, Triticum aestivum
  Clone ID: PAT_TA_3414.pep
SLLQAHYQRRYNGVLAANFPAAPLRKFNYTGTPPNNTFVTHGTRVVPLAFNTSVEVVLQDTSIQGAESHPLHLHGYDFHVVGTGFGNYDAANDTAKYNLVDPVQRNTISVPTAGWVAIRFVANNPGVWIMHCHLDVHLSWGLSMAWLVNDGPLPNQKLPPPPSDIPTC

SEQ ID NO: 108997 - protein, 333 aa, Triticum aestivum
  unsure (1)..(333): unsure at all Xaa locations
  Clone ID: PAT_TA_3415.pep
MAGQGSYSRLAADEAAAVISGGGGDDYDSKKLRLLGYEPQLKRNLSLLSNFSVTFSIVSVLTGITTLYGTGLQFGGPVTMVYGWPIAGAFTTVVGLAMAEICSAYPTSGGLYFWSARLCSERRWGPFASWLTGWFNIVGQWAVTTSVDYSLAQLIQVIILLSTGGNNGGGYLASKYEVIAIHAAILLSHALINSLPIAWLSFFGQFAAAWNMLGVFVLMIXXPXXVPKRXRANXVFTNLNTXNSAGIHSHXYIFLLGLXMSQYTLLXYDASXHMTEETKNAXKNXPIGIISAIGISNRWRXGIILXVPLPXKDIPSLLSPDXKAGGTPSPYRP

SEQ ID NO: 108998 - protein, 320 aa, Triticum aestivum
  unsure (1)..(320): unsure at all Xaa locations
  Clone ID: PAT_TA_3416.pep
MSATRPDHRRHQSPFLRDLSSPISSSFRMPPASVRREAQASTPPPPPPLLSLDDLSRHSPSPPPHTPPQAAMSPSPPPPRGGLFSTPQRSNGSPSPAAWWSPSREEKARDSSPVDGVVHQQQSPATASAQQPQQQQQQVALITLPPPREVARPEMPRDSVLSTGRVDEEEWVTVFGFLPVDTNFVLREFEKCGLVLRHVPGPRDANWMHILYQSRHDAQKALAKHGQQLNSVLIIGVKQVDPWQRPYLNENTDDTYNGGMSXPFPSQAVAPSGFATRNALAPLPSNPMQNGNESNRGASGAIASPAKSVLSKVMDVMFGL

SEQ ID NO: 108999 - protein, 87 aa, Triticum aestivum
  Clone ID: PAT_TA_3417.pep
GRVGGRVGFFLHCRKQHHLLTFLLKKHSKSTIKTLAATQSKLICLVEKYMLPGTGVTPHPAERLDGRPATTARRNHFGERGCQRASV

SEQ ID NO: 109000 - protein, 114 aa, Triticum aestivum
  Clone ID: PAT_TA_3418.pep
TQLKENNNCLRLALYLDPDAFSESFQQKSQPVVAPERVLSITCGCWFCSADGLLSGHHHGCSSCGLLHHPSHGHRRSPSPSHTTPPLPHLWVREELREHRSRTNSSGRAAVAWL

SEQ ID NO: 109001 - protein, 89 aa, Triticum aestivum
  Clone ID: PAT_TA_3419.pep
FCRVTLIDNFLRNTNTRVHLFWDGVNLLEETASKYYFFLIPDYFTEISLAVHLCGRASLSLEILQLSLIGDLNGIALNQNVHSKVYSPI

SEQ ID NO: 109002 - protein, 176 aa, Triticum aestivum
  Clone ID: PAT_TA_3420.pep
MGMVTAAALLASSPQTPLLRGCLPGLPRLRLRPASPCVSALRSNNFVQRCYIANVEVEVSNVNKEEEAFDDHPSLPPGCSIPVVNILGDVLDSSPFPPHDSAQHHADFEELPALSEGEQQTLAATPAHPAGLYALAVCFAPGLLVLLLSAFAWPAALAILHPSLLPVAIVGFFGKL

SEQ ID NO: 109003 - protein, 253 aa, Triticum aestivum
  unsure (1)..(253): unsure at all Xaa locations
  Clone ID: PAT_TA_3421.pep
IAARTRQRWRRRRPSSPCPTPSPLPLIAPSSRPRAGTLHLHRRRLLPLSPSSSCSTSTSASSSSSSPVLLRDDELDHQEEPPPASEADSRPRRIALFVEPSPFAYVSGYKNRFQNFIKYLREMGDEVIVITTHEGVPDEFHGAKLIGSWSFPCPWYQKVPLSLALSPRIIGEVARFKPDIIHASSPGIMRLGALGVASVRCVPLVMSYHTHVPIYIPRXYTFSWLVKPMWLVIKFLHRAADLTLVPSVAIGRD

SEQ ID NO: 109004 - protein, 175 aa, Triticum aestivum
  Clone ID: PAT_TA_3422.pep
HSANPLSSSCRPHGAAAPASSPPVALPSPSRLFSPSSVAEAATMLESAAPALDPSGRSRRSMQRSPVPPPPASAAGARFSALPSLLLLHCREGRGLLCAAAPAPPAPTLTLALLLLVKVHTRPGGQGVSSTTSDVFSQIQKVEFSFLIGTVRSAKVYRDLNEFWNKEYNNHKDGG

SEQ ID NO: 109005 - protein, 72 aa, Triticum aestivum
  Clone ID: PAT_TA_3423.pep
TIKFRQATRDALTIWPVMFPFAPLHVLGERYSEPRFGFIPLLITSFCWISNCKFYFQEKMRLLFCSTTFILG

SEQ ID NO: 109006 - protein, 341 aa, Triticum aestivum
  unsure (1)..(341): unsure at all Xaa locations
  Clone ID: PAT_TA_3424.pep
ANSARGPRVRPRVRSLLSVLDIRGTREAHLLASMKKRQSCLFEGMKKHLEDGCVVALTASSDSSRSETSSGNRYSPKPSSGDGASPLSDIDSASVPTYLAGNLQNASSAIGIEVGRRSDEKMLKWERLQALDKWIWTSFYSSLTAVKCGKRSFKESLVHCESCHDLYWRDEKHCRICHSTFEVGFDLEERYAIHVATCREPEDLYDVPNHKVLPSQLQALKAAIHAIEARMXPTAAFAGLWMKSSHNLWVKRLRRTSSLPELLQVLVDFVGAIDEDWLYQSSSAVSFSSYLDDITVYFQTMPQTTSAVALWVVKLDALIAPHLAQADSGRGLGKGSIQTRA

SEQ ID NO: 109007 - protein, 200 aa, Triticum aestivum
  Clone ID: PAT_TA_3425.pep
MQSMDLVSPSEHLCYVRCTYCNTVLAVGVPCKRLMDTVTVKCGHCNNLSFLSPRPPPMVQPLSPNDHHHPMGPFQGCTDCRRNQPLPPLASPTSSDASPRAPFVVKPPEKKHRLPSAYNRFMREEIQRIKAAKPDIPHREAFSMAAKNWAKCDPRCSSTVSASNSAPEPRIIVPGPQLQERATEQVVESFDIFKQMERSA

SEQ ID NO: 109008 - protein, 86 aa, Triticum aestivum
  unsure (1)..(86): unsure at all Xaa locations
  Clone ID: PAT_TA_3426.pep
MAAAPTPQPLLPVTNPSSGGGGSAPSAGSGLTGSAPPAPAFRLFLSRVSDTARRSLADRRPWXELIDRSAISRPDSLSEATSRLRR

SEQ ID NO: 109009 - protein, 263 aa, Triticum aestivum
  unsure (1)..(263): unsure at all Xaa locations
  Clone ID: PAT_TA_3427.pep
LSXHGPRNSLFVVTLGWFVDCVRRNMRLDESLYSIKNIGENGLPLGESNRLVGLPVNEKSCLPPMIFQDKACSDTTRKHQLQAHREEPEHDXFVFTNETIYIDPGISGEMKKKISDAATSEDAKLLDHWFIGCHATYVVCEDASVKRYVGHSDNIVTPFWILKTVKEKNLQRLVHLSSDLARHVAVVLENFHISQENTYPGCAPALTSSELPARRGFPVTCLGRHVFGVAAYKGRRDRRLRRLLSGEVPIHPLTPVTLLDSIC

SEQ ID NO: 109010 - protein, 203 aa, Triticum aestivum
  unsure (1)..(203): unsure at all Xaa locations
  Clone ID: PAT_TA_3428.pep
MQAQNQRIISKTSILLGNGNVAKTXLLWEDSKQTMTVLLLLAVIYYQLFTCGYTIITAMAKIFSLTALFLFIHGMLPANVFGHKIEKLEPSNFHISQVEAHHIACSVSSSWNSLVGVLKSLCRGNDWPLFLKVVFFLLVVSILSAMSSEAAFKIGFHIGIPLIFIGFKAYEKWEDTIDSLVGDACSFVLQFTPIQISSRQKQT

SEQ ID NO: 109011 - protein, 82 aa, Triticum aestivum
  Clone ID: PAT_TA_3429.pep
MASTVESPTSSCVSSDTEEEAAAVTKPMVVVGCPQCLMYVMLSGAAEEQPRCPRCKSPVLLHFLHGAAADVASTNRQQPSKS

SEQ ID NO: 109012 - protein, 307 aa, Triticum aestivum
  Clone ID: PAT_TA_3430.pep
MASGSEQPQAETEPEAVELVLFQVAECYVYLIPPRKTAASYRADEWNVNKWAWEGALKVASKGEECIIKLEDKSTGELYARAFLREGEPHPVEAVIDSSRYFVLRVEENIDGRQRHAFIGLGFRERTEAYDFQAALHDHMKYLNKKKTAEEMVQHYENTSSVDYSLKEGETLVLQLKNKESGSKTKSAFFEQGLNKLSFNEKANTKEATVSLKLPPPPPSPVSPTDSGVAMSPFKAEFPSQEQPGTGDARDAAAPFKAEFPSQEEALDDTVEARAEAAPRNQPAAADKSKQGSVDDEFDFGDFQAAA

SEQ ID NO: 109013 - protein, 412 aa, Triticum aestivum
  unsure (1)..(412): unsure at all Xaa locations
  Clone ID: PAT_TA_3431.pep
AVTSPTVLAPITRTISXGLAAPGSSWPEMKIDRNLPGDNSSAAVLFDKEKATTKDQCPNSEEVEAQAEAEAAASAVAVAAICTDEAVGTAASASDKNSFSSKDLTRLTAGGAITGQPGQSSGEEPLTVALPADLSVDTPSMSLWPSLPSPQVPGPTLSQFPIAQPSHVSCFEMNTMLGAHPFAFGRSDESAGTLGQQPQRSNALPSAQLGAWPSMVDSFYRPPTGFAGPFISPGGIPGVQGPPHMVVYNHFAPLGQFGQMGLGFMGATYIPGDKQPDWKQNQGPSVGVSQSDPNNQNVLPGQVTSPSFPTQVPHLRATSIMPIPSPLTMFDMASFQXSSAKIQVQPCWPRVPMHSVPLSXVQLQQHPIDGIAASQXVDNVVIDKSSTNXRFQEPSTSDSNKSSQYSCLQSRC

SEQ ID NO: 109014 - protein, 126 aa, Triticum aestivum
  Clone ID: PAT_TA_3432.pep
QAAAGYTDTTPAEQPAADGTKVKVPPGEGKATTPEQKFIEKVNQAFKKALDAANAAAPDDKFSVFDAAFNREIKQCLAGMSAKFISMIDRAFKIAYNSAVAATNAQEKFSCLVLTLTEALRFIAAT

SEQ ID NO: 109015 - protein, 377 aa, Triticum aestivum
  Clone ID: PAT_TA_3433.pep
KTLLEESKDPMKIVKEQESLHVEGVDMSATDEPDEPISPAMDGLLKIHKRITDGSDGESGQLQRGASNVGPTRLLVPASQAGSLIGKQGATIKSIQDSSKSVVRIVENVPPVALNDDRVVEIQGEPLGVHKAVELIASHLRKFLVDHSVLPLFEQQMKMHSVQREQPMAAPQHWAPPQPWVPPPNLPPGGPGYGGNPQFMPPRPQDNYYPRPDVPPMEKQPHYGISAYGREAPPSGTSGNQPPLHVASQVHNMQIPLSYADAVIGAAGASISYIRRHSGAAVTIQESRGAPGEMTVEIIGSASQVQTAQQLIQNFMAEAAPQTRPPASNPPAPPVDPGYSSYPPPPYGAPPTGAGGPAPHNGGGYGGGSSYHPSYGY

SEQ ID NO: 109016 - protein, 193 aa, Triticum aestivum
  unsure (1)..(193): unsure at all Xaa locations
  Clone ID: PAT_TA_3434.pep
GLPNYVGDKRNPQISRPLPSPSAVVRVACERASERAPPSSVFPARSASVQPTPRAWLCCCFCVSWLIIFFVFCPYFLGIILICGDFSVILPRPRSGGGSVISAPGLPNPLARGLDYNHPHFFHFAPGYVPAPVSFRFSSFSRHWRLLHAPKIGCSSSLRPNPFPXWVKVLNCXNCCXSGXTWLAFXEXXVXAR

SEQ ID NO: 109017 - protein, 78 aa, Triticum aestivum
  Clone ID: PAT_TA_3435.pep
MKTNVSLFYQVSLKCFKHYSRYRRNQQALIWLMNFASPDNPTRCKTFPRTGTETPGPSNEQERPGGHNEATHTTMAGM

SEQ ID NO: 109018 - protein, 78 aa, Triticum aestivum
  Clone ID: PAT_TA_3436.pep
KQDPKKRPNPDPQPGPGPPRNPGPQEPGPKPPGNPGPQEPGPGPPRNPGPPGGTGPHPPGPPPPGPPCPCGSIAPIGT

SEQ ID NO: 109019 - protein, 154 aa, Triticum aestivum
  Clone ID: PAT_TA_3437.pep
MASSLKVAEDLLEVVDRRAKSVATELSDEQTAPQPSGPNGQEGQAKRGKPREKGPVELTTGDAGNRTAAQKERKNRQPPRERIKIEKIKPSARADSSNDDAIAIPSASEPEVTSVDVKGANAESTSDKVENATVDLKNDTAANAIDNAVEVQSM

SEQ ID NO: 109020 - protein, 140 aa, Triticum aestivum
  unsure (1)..(140): unsure at all Xaa locations
  Clone ID: PAT_TA_3438.pep
GKPVAVSWNSVQKARAVLEEEKIKTTGHGDSSFCATTLQSETPRSVLMSSSLIMTDRSVTPNGDSAVQVTRIEKSHEGGNHLPLFQTGSGRPIAISKSSVKRATAVLEPRNIAKELEDEAQXDGGHDTPMFKTGFKKLNK

SEQ ID NO: 109021 - protein, 432 aa, Triticum aestivum
  unsure (1)..(432): unsure at all Xaa locations
  Clone ID: PAT_TA_3439.pep
AASAALRLALVAYGERQDAHLEVRYTDVDYLVFSDAAASVAAGGSPFARATYRYSPLLAFLLLPNSLXHPAWGKLLFSAADLLVGLCIDAILELRGVPARTRIWCVVAWLFNPFTSTIGTRGNCEPVVCAAMLWILICLMKGXRVLQAAFWYGLIVHFRIYPIIYAIPFVIVLGKNYAGPAGRPVLTQWSSKQQLQSDKARENVEEPTSLLATLWNFLSSLITRDTILFGLFSGSMFFAWTGVFFYLYGWEFLNEALLYHLTRTDPRHNFSIYFYHIYLHHQQGFSSIQRLASFLPQLIVQLALIIRFSRDLPFCMFLQTVAFVAFNKVMTAQYFVWFFCLLPLILPWTGMKLRWKGLVCALVWMGSQLHWLMWAYLLEFKGRNVFVQLWAAGLVFLAANTFVMIMVIRHHSHTPLFSAPAGPRTKIAAKKE

SEQ ID NO: 109022 - protein, 321 aa, Triticum aestivum
  Clone ID: PAT_TA_3440.pep
DIYLWAIPDIFSAENSSSSSNQNLPLQRLNLGYKLDKVPIISLRWVPARGKSGRLYINGFSEHAYLYQVLILNEESESRIVKMVLPLTEACQGMEFVTGLSDPNKQRQTVLVLLLKSGQICLYDDSEIERYLLQSQSRSPPTLPSHSFVKQPYGDSGINVAKFYTSDRTATANEDYFSTLASKYPWLLSLKDKGQISASLSNIHKTRNLYITGHMDGTISFWDASCPLLLHIFMMEQQHEDNTSSRARITSLHFDTSSSILISGDHGGTVRVITFKKDSSDNILSILQGKQGDNYDARSIKLKGAVTSTSMISNSKHFAVG

SEQ ID NO: 109023 - protein, 380 aa, Triticum aestivum
  unsure (1)..(380): unsure at all Xaa locations
  Clone ID: PAT_TA_3441.pep
MFPVTGSPKCVAFRSKHTRKYLGSVHVGSEESAVGGGRFFEELSDGADDVDVLASPYTRFYLEPSKEHDGLLHVRCCHNNKYWVAKHGGEGSGHWIIGIVNEPNDDLSKPSCTLFEPVPLTDGDNNLSIRFFRPQQTTSSESEMVMEKETAEEAYLRLGTGGHEKTVDQVKSLHDFSAIDLSKQLVLPKYVAFKGDNDMYLRPRFVQKXSYLEFSSCARADSTVVNTIFPNYANGNVRIKSNHFNRFWRLSPNWIWADSADSSSRDPAALSRMVMLPDYIGLQNLGNSRYCKRLTADRKTSCLNAAVDTITLEARLRVEEAVLSREIYGVVFKLSEARIYGEKPITFPSMTSTNDTNEPHAKTLTLKYEETQGQDLELDC

SEQ ID NO: 109024 - protein, 73 aa, Triticum aestivum
  Clone ID: PAT_TA_3442.pep
DNAAWIGAALVLCGSLTVQLFGSAPEKSQKVESCSGNTFESPLKRQDHLSLSAIPVDSSKNIGSQVERKDKTL

SEQ ID NO: 109025 - protein, 123 aa, Triticum aestivum
  Clone ID: PAT_TA_3443.pep
DFEILAFPCNQFLRQEPGSDQQIQDFACTRFKAEHPVFQKVRVNGPDAAPLYKFLKASKPGLFGSRIKWNFTKFLVDKNGKVINRYATATTPFSFEKDIQKALEEEPSESQTKKEEESSDSQK

SEQ ID NO: 109026 - protein, 187 aa, Triticum aestivum
  Clone ID: PAT_TA_3444.pep
MGASESVLETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKANKPGLFGSRIKWNFTKFLVDKNGKVINRYATATTPFSFEKDIQKALEEEPSDSQTKKEEESSDSQK

SEQ ID NO: 109027 - protein, 300 aa, Triticum aestivum
  unsure (1)..(300): unsure at all Xaa locations
  Clone ID: PAT_TA_3445.pep
MGASESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKVXKLAKPGLFGSRIKWNFNYVSFFYKEWEKVINRYRNCYPIIFPLRRKTSTLGSLRRYPADSQKKKDAGILRLAAIRHLQSIPVEIYLCQFSQVKFLSWFAPWFDRCFLLFVTCSYVSKGCVATNYLSVWVPWFCFGCFCRGTQDIDELESYAVYGSFVFGLIKIHVMHLGPGYSKTRAEFGT

SEQ ID NO: 109028 - protein, 277 aa, Triticum aestivum
  unsure (1)..(277): unsure at all Xaa locations
  Clone ID: PAT_TA_3446.pep
DTPLTPIADGGNSPFTYIIVDSQTKTRTCIHTPGYPPMKPEELTKENLFAALHGVEMVYFDVRLHETALLVAEECXASQRKIPILVDAEKKREGLDDLLNFASYVVCSANFPQAWTGASSTPVALVHMLLRLPNLKFVIVTRGEKGCLMLERSMTDASETEETDVEDLLESLEQKVDLSSSMAKCVASKSNLRISADGVGSMSGRLLMGTAEAIPSEELIDTTGAGDAFIGAVLYGLCTGMPVEKMLPFAAQVAACGCRALGARTGLPHLTDPRLSL

SEQ ID NO: 109029 - protein, 524 aa, Triticum aestivum
  unsure (1)..(524): unsure at all Xaa locations
  Clone ID: PAT_TA_3447.pep
MAPPVAGFGQGGGGYGGGMGYGGRGRGGGGGGPGGFRGGGGRGGSNGRDGLDSLSLPKADFRGLIPFEKSFYVECPAVQAMSDTEVAQYRQLRDITVEGREVPKPIRFFHEANFPDYCMQAIAKSGFVEPTPIQAQGWPMALKGRDVIGIAETGSGKTLSYILPGLVHVGAQPRLEQGDGPIVLILAPTRELAVQIQAEATKFGSYSRTRSTCIYGGAPKGPQIRDLRRGVEIVIATPGRLIDMLEAGHTNLRRVTYLVLDEADRMLDMGFEPQIRKILAQIRPDRQTLYWSATWPREVETLARQFLQNPYKVMIGTAELKANHSIQQIVEVISDHEKYPRRSKLLXDLMDGSRIFIFFETDDECDKVTRHLRMKVTHLSCMYADDGHSEFADVQEIKCEINFDFPTTIEDYIHRIGRTGRAGATGMAFTFFTHSNAKYSRNLVKILREAGQVVNPALEAMSKSAGSMGGVGNFRSRVRGGFGGSGKCCYSIGIRLYFTIKGPRRVRWWCVWWCPFRIKYHALS

SEQ ID NO: 109030 - protein, 197 aa, Triticum aestivum
  Clone ID: PAT_TA_3448.pep
FFFFFFFFFFFFFLNKGTLKHFIVLEHGKTGALQFVMQNRKETASELLVVSYFDCYRRGIHCIKRDKEEVTIPRAKISGFHTHRIQKQTTTGDRSRWRKGGSGRRRGRRGTRRRRAGRRSPPPRTARWIRGPSCGPSPPPRPPWRRTRCRCACSPLPPSRAQMTSSAPRSGDGDVMRWETTGKARADDLFRTSLRRR

SEQ ID NO: 109031 - protein, 84 aa, Triticum aestivum
  Clone ID: PAT_TA_3449.pep
FFFFFCMYGLPVRRACRSSHLEDFLKCLMLSLTRIASCGCSPYKNFGQSEEKDIAWKKCRGWRSIETPEGGSIRVLFMSPWWRW

SEQ ID NO: 109032 - protein, 155 aa, Triticum aestivum
  unsure (1)..(155): unsure at all Xaa locations
  Clone ID: PAT_TA_3450.pep
LTLQPLSRALRNPATATATPLTPLPPPPPARRHISAARHPPLPDRRLSGLATAGRHTIILMQPSQNSSSRTFMDYNSINHALDGICGLYERKIREXLNPMIPNITCDITDLYNFIDGLADISALVYDHEIHAFLPYDRQWIKQKLFQHLKRLAQR

SEQ ID NO: 109033 - protein, 120 aa, Triticum aestivum
  unsure (1)..(120): unsure at all Xaa locations
  Clone ID: PAT_TA_3451.pep
SLPPCLPSPVPCLVSPASPPSLLAPLASSAPCPGARPGPAPPHGRSALVSVRRFHPPPVPCLREPWPTPAPPPXRRPPSPAPRRPPPPTGAPPGPPSWPSGHLSPAPPPPRRRGAPTSAS

SEQ ID NO: 109034 - protein, 170 aa, Triticum aestivum
  unsure (1)..(170): unsure at all Xaa locations
  Clone ID: PAT_TA_3452.pep
MSMEDSAQPAGAASAGERASSPSPSRRLPDFLQSVRLKYVKLGYHYLITHGMYLLLTPLIVLIAVHLSTLSPGDVADLWTHLRFNLLSVIACSTLLVFLSTVYFLTRPRSVYLVDFGCYKPGPERRCSRETFMRCSKLTGNFTEXNLDFQRKIXLERSGLGEDTLLPSRL

SEQ ID NO: 109035 - protein, 501 aa, Triticum aestivum
  unsure (1)..(501): unsure at all Xaa locations
  Clone ID: PAT_TA_3453.pep
MSLEDSTPPAGAGASAGEGASSPSPSRRLPDFLQSVRLKYVKLGYHYLITHGMYLLLTPLIVVIARHLEGAEVSEPSEGAEQPLXWTRSTHSRWTFPRFPRLLNSFACSAIPPGTASEQILPLNSTVCNLTLESSGMAEDTYIPPALVTVPPNPSMELARQEAQVCMFGAIDNMLAKTGVKPKDIGILVVNCSLFNPTPSLSAMVVNHYKLRGNIVSYNLGGMGCSAGLLSIDLAKDLLQVHPNSYAMVVSTENITLNWYFGNNRSMLVSNCLFRMGCAAILLSNKRSDRRRSKYELVHTVRTHKGADDKCFSCVTQEEDDSGKVGVALSKDLMAVAGDALKTNITTLGPLVLPFSEQLLFMVTLVGKKLFKMKIKPYIPDFKLAFEHFCIHAGGRAVLDEIEKNMDLTDWHMEPSRMTLFRFGNTSSSSLWYELAYSEAKGRIRRRDRIWQIAFGSGFKCNSAVWKALRSVNPAKEQNNPWMDEIDTFPVVVPKVSKVVE

SEQ ID NO: 109036 - protein, 172 aa, Triticum aestivum
  Clone ID: PAT_TA_3454.pep
SSDHGHWCPGDQVLLAGEAWPAVAAAREGVPAQPDPPLRPPATRQAVDDARPAGPLLSRRTAPAAYQGARCQQQLSRVNERRRQQERAAAGSVTITGGRWQRRQAAEAAVHAVKLLLRARRRGLPGLHQGQQRRPGRGQPRRRCRCRPARPWPAASRAEGHVKIHPLCTVKV

SEQ ID NO: 109037 - protein, 391 aa, Triticum aestivum
  Clone ID: PAT_TA_3455.pep
RPPPPPPRPPPAFQRPVLCLRGRSVELSVGIQHDWSYRPLVHDVLSFKLNKLKLPTEKYDLDDSDPFWVANSWSPFPKVAEEIEAQLAKYKQDVDAGRPPSGAPPGRAEPVRAGRIRCPLLLPAPGPPPPGLTVRKKMIDKHTKIATAVLGHIKERSLDRYYECENDMLVNGTGPRFGRLRLLRGKGTKEDKLRPARPVLPSCGPPPPSELEQVEAALRGSDGALSAFQYVKRIKSLNTQFAAASSTASRSNIVDWAEKLYGQSISAVTAGVKNLLSDGRQLALTRTVEALMEGKPNPEVDNYLLFDPRAPRSGTGGQFRGPFREAIVFMIGGGNYIEYRSLVELGQRSQPSKHVIYGATEILNGVEFIQQLAELGQKAGLGGGSSNLPPQ

SEQ ID NO: 109038 - protein, 184 aa, Triticum aestivum
  Clone ID: PAT_TA_3456.pep
SMISLIEGMGEDIIIHLEGQHLSPRVILVDPLVKTHISMKMFGMVPRGHILTWSPRLLDTLSMVLLVCALALTITSSRHFLEGTVLVIMTSHHFLEGTATETLLGRGVVIHVITMALVLVIPRPLPMPMPMPMPMPRPLPQLNMVGVHSDHTIEAAGILEAVITTTRWYHNFRWCRVTLVFGLV

SEQ ID NO: 109039 - protein, 567 aa, Triticum aestivum
  Clone ID: PAT_TA_3457.pep
LSWAKVQDAQVHLDRLTQERDAINARKKKQKAAFDEYWEKLEAARKEEGEARAAHAGKRNVLDGVRSTIGKLNQATSVEEIDELIVRKQRTMEHETISLKEEKLFIKEINDLKAQRKQACSNMGSEAEMSEAFHQKDHIHEQHKTLKKEADLLFKNLKSLEENRKKIQKSFEDERAALRKLNDDLYAANELRQQAYENWVELRGEPGKKNKYFFMYKKDRDAAGKLLSSGDIDGLQSYCNNQVEGFMEMWNKDDDFRRLYVEANQISTLRRLGTHDGRSLGPDEEPPVIPSNNYSRRPNNPSQLTVSSPNVPITTKEAAPEKSTAVVVPVEEDSFPVLPPTQTHKQAKPKAAGSGSSQKEITPAPAPAPEVVDVKQIEKEKARLAEELELARKAEELARKEEELRAQRAAAEKEQLRLEQIAKAKEAEERKKKKAEKAQERAEFKARKEAEMKEKKKAKKSKKVGTTPADLASGQTNSAAIPAADTESNTPENTKDPDVPQPQPIIIKRIPKPIVRQLQPMPAPLRNKFKRRTRQYIFIGVAVALAVVALILAGRTLDLPGLSSLRF

SEQ ID NO: 109040 - protein, 201 aa, Triticum aestivum
  unsure (1)..(201): unsure at all Xaa locations
  Clone ID: PAT_TA_3458.pep
KGSRSRRKIDILGLMVSIIGSKDQLVNEYRVMLAEKLLSKSDFDIDSDIRTLELLKIHFGESSMQKCEIMLNDLIDSKRTNSNIKTSLLNAPGNCCWGKRRQKFLMMFLDATIISSNFWXPPIQTEVLAVPAXLDKLLSDFAQKIXHKIKTPRKLLWKENPGTVKLELQLEDRSMQFTVVPAPAKCGSEKQAGLKFTESIL

SEQ ID NO: 109041 - protein, 181 aa, Triticum aestivum
  Clone ID: PAT_TA_3459.pep
VVPEEVLEELKNDDGTVALRMMDHIPPQKADEDMKKNTMMMVEQSKVLKTPRAEKKTKRELFDALRQELETPVLEKASKAVWELILDNGGLGKEITETVEKVFCRLSGIDVMPPPASTSGAPQEKQTNMAVEEDQKDMEMDASEPSSSSRKRPFSDISVKGAGAIPNGGATYQHDDHEDGN

SEQ ID NO: 109042 - protein, 254 aa, Triticum aestivum
  Clone ID: PAT_TA_3460.pep
MANCRAFALVLLFCALSCQAAATYAPVPAKEDFLGCLMKEIPARLLYAKSSPDFPTVLAQTIRNSRWLSPQNVKPLYIITPTYASHIQSAVVCGRRHSVRLRVRSGGHDYEGLSYRSEKPETFAVVDLNKMRAVLIDGYARTAWVESGAQLGELYYAIAKNSPVLAFPAGVCPTIGVGGNFAGGGFGMLLRKYGIAAENVIDVKVVDPNGKLLDKSSMSPDHFWAVRGGGGESFGIVVSWQVKLLPVPPTVTVF

SEQ ID NO: 109043 - protein, 412 aa, Triticum aestivum
  Clone ID: PAT_TA_3461.pep
MLPTKRADGAEDSGDAAAKKARVGESAAEAGSEAMVAGEPVAARPNGNGVAESDEDLHSRQLAVYGRETMRLLFASNVLVSGLNGLGAETAKNLALAGVKSVTLHDVENVDMWDLSGNFFLSEDDIGKNRAAACVEKLQELNNAVLISALKEELTTEHLSKFQAVVFTIVPRVRAVEFNDYCRSHQPPIPFIKTEVCGLFGSVFCDFGPEFTVLDVDGEDPHTGIIASISNDNPAMVSCVDDERLEFQDGDLVVFSEVSGMTELNDGKPRKIVDARPFSFCIEEDTRNFGIYAKGGIVTQVKEPMILEFKSLRECIKEPGNFLLSDFSKYQRPPLLHFAFLALDNFRQKFGRFPVAGCDQDARKFVEFTASINEAAIDYKMDELDEKLLQHFASGSRAVLNPMAAMFGGIVG

SEQ ID NO: 109044 - protein, 237 aa, Triticum aestivum
  Clone ID: PAT_TA_3462.pep
MPPLLTLSSSPVLPPRARFRVSASADVGATGRAAAASNGFPPFLPRAVERIRDGAALRLAKRIERVPVQTGFSKSPIPSSCVRPLKQQQSADPVVLLHGFDSSCLEWRYTYPLLEDAGLETWAVDILGWGFSNLETRPPCDIVSKREHLYQFWRSYIKRPMVLVGPSLGAAVAIDFAVNYPEAVSKLIFIGASVYAEGTKDMTRMPKFVPYAGVFVLKSLPLRLFATRLAFYYIPDG

SEQ ID NO: 109045 - protein, 104 aa, Triticum aestivum
  Clone ID: PAT_TA_3463.pep
EWAPEIPFADITNFVPWSIKRTSAGCVFRSSKFPSCATQVETTLLFYHDLESYELYDNNDSQVQQELVQKIWKVFKTILEETGKLREETKEGISIAKSIVIILD

SEQ ID NO: 109046 - protein, 239 aa, Triticum aestivum
  unsure (1)..(239): unsure at all Xaa locations
  Clone ID: PAT_TA_3464.pep
QELRTGLPSPPQPSRSSEIRPDPSRSLATAGAAARSRKRVEATVLKRARDGSAVTRCEACNKDVAIVLIDLHSCSLDSKIRLSLESQVVEKSVEIQEKKRKTPSAAAGGKGKKKSKADGDGAKKPKAKRPPTAFFLFMKDFRVEFKASHPEEKGVARRXAKQQGTMTEEEKKPYNDQAKASPAQFANGEGSAENNVGDEEKADADAEEVEDAEQEVDKPEDAPEEEEEEEEKNELDDDI

SEQ ID NO: 109047 - protein, 219 aa, Triticum aestivum
  Clone ID: PAT_TA_3465.pep
MNEVGDAALGSSFILDAGESIVALDGDKPVLPVVHHIGISAWPGPLILTTHALYFQSIRVGYGDKIVKYDLAPDAYLVIKRDRPGPLGVRLFDKAVMYKSSTLTEPISFDFPEFGSPARRSYTFAATREVMQRNSCITQLILFDLPKVAALSRATRRFVIYSAVLGALLGPPSRVGSALTFGLADLPPDADLVFEPLFTGPFRLRLSALALLATEPAVD

SEQ ID NO: 109048 - protein, 117 aa, Triticum aestivum
  unsure (1)..(117): unsure at all Xaa locations
  Clone ID: PAT_TA_3466.pep
PXPPRHSDPLRPRPLRRLIPSPLPPGDRSGTRGSSKQSWSRDRQHERSLFDLCRLLYCSMVLSSHHHHLLPLFVAFSPKLGRGAPATQDYRFKISRFGFGVKYSGFLHLDQCPVHAK

SEQ ID NO: 109049 - protein, 162 aa, Triticum aestivum
  Clone ID: PAT_TA_3467.pep
MPLFSSKFAPLIPRLRRLSTAAATAAGEDPKLSRIADELLALSSAELDDYSALMRLKLRLSLTSNPAAGLGPGAAGDAASGSAGAEEAAAVKTAFDVKIEKYDAAAKIKIIKEVRAMTDLGLKEAKELVEKAPVVVRAGLPKEEAEALAAKLKAAGAAVALE

SEQ ID NO: 109050 - protein, 100 aa, Triticum aestivum
  Clone ID: PAT_TA_3468.pep
GPVRVAVAHMTTGFPSPRLGAQEGHRRSLRLLHHQIGAGTPPSSSLTSSSSFAADARHRPIQTLRSTPTLDKLAIHPLAITRLTPLLVPRSTMLLTTPTC

SEQ ID NO: 109051 - protein, 221 aa, Triticum aestivum
  unsure (1)..(221): unsure at all Xaa locations
  Clone ID: PAT_TA_3469.pep
MRQAPRSPLSTSPPATHPAAAAPRRFAHTPPPPATPPATLPSAPSPIRRDGSRSTAAFMVAFSISILGFVRSPISTTLPQITGRLYXTWGILWSFREAQSHILVTSLIISWSITEIIRYSFFGMKETFGFAPYWLLWLRYSTFLVFYPIGLLSEVGLIFVAIPSMKSSWKCRLMMPNKWNFSFDYRYELALTMALYVPGFPYLFRYMVAKRKKVLSARKTA

SEQ ID NO: 109052 - protein, 214 aa, Triticum aestivum
  Clone ID: PAT_TA_3470.pep
MEYRNKMVLAPMVRAGTLPFRLLAAEYGADITYGEEIIDHKFVNCQRVINESLGTTDFVERGTDSVVFRTCPQERDKVVFQIGTSDAVRALKAAELVCNDIAAIDINMGCPKAFSVSGGMGSALLSKPELIHDILTTLRRNLNTPVTCKIRLLNTRQDTVELARRIEKCGVPALACPWEERSKDRPRDPAKWDEIADVVSALSIPVIANGNVFE

SEQ ID NO: 109053 - protein, 57 aa, Triticum aestivum
  Clone ID: PAT_TA_3471.pep
RRQGTAPPTKAVSLTKVVSPDKLRDDEEYEDILEDMREEGRKYGKQNEIHGLAFILF

SEQ ID NO: 109054 - protein, 240 aa, Triticum aestivum
  unsure (1)..(240): unsure at all Xaa locations
  Clone ID: PAT_TA_3472.pep
MRAKLWMGFAPFLSKRYISTCGTSSLPPSSSSLVIQPWLFIGLGNPGEKYQSTRHNVGFDMIDAFAVSQGISLTTHHFKALFGEGVVDGVPVLLAKPQTYINLSGESAGAFAAYYKLPLHRVIVAYDDTDLPCGVLRLQPKGGYGRHNGLSGXKSVIYHFRKNREFGRLRIGIGRPPGQMDPKAFVLQKFNKTGRERIDSAIKEGCDILKMVVTKGLTEAARASNVDQKYKHLVSHDQQP

SEQ ID NO: 109055 - protein, 189 aa, Triticum aestivum
  unsure (1)..(189): unsure at all Xaa locations
  Clone ID: PAT_TA_3473.pep
AAAQAKKKSKXILKPIARQDPPIIHDNRRGRFPAELSXLDPLARLSASGTESNFSDAAMEASASLAPLQLEARSAFQPSTAASSRIAVSSSESSFDSPDLHPFRVSSCTADEMLGVITPHAAQSHIEFTRSTSDGYEASGGEDSDRIPSRIVHRSSNWANSLLHSGQAGPAPDQHMPLSEGFLNNSRSG

SEQ ID NO: 109056 - protein, 250 aa, Triticum aestivum
  Clone ID: PAT_TA_3474.pep
MPSPNDPPAALPLTLDLEDFKGDFSFDALFGSLVDELLPEFHGDDAAGVPPPPPPLLGAAPPVFPAVDELLGLFKHSCKELVDLRRQIDKRLLNLKKEVATQDAKHRKTLGELEKGVDGLFDSFARLDSRISSVGQTAAKIGDHLQSAESQRETASQTIDLIKYLMEFNSTPGDLMELSPLFSDDSRVAEAASIAQKLRSFAEEDVGRHGVTSAVGSANASRGLEVAVANLQEYCNELENRLLSRFDTAS

SEQ ID NO: 109057 - protein, 253 aa, Triticum aestivum
  Clone ID: PAT_TA_3475.pep
RQDFREELEILGSIRHINLVNLRGYCRLSTAKLLIYDFMELGSLDSYLHGDAQEDQPLNWNARMKIALGSARGLAYLHHDCSPGIVHRDIKASNILLDRCLEPRVSDFGLARLLVDNETHVTTVVAGTFGYLAPEYLQNGHSTEKSDVYSFGVLLLELVTGKRPTDSCFLNKGLNIVGWLNTLSGEHRLEEILDSRSGDAEVEAVEGILDIAALCTDADPGQRPSMGAVLKMLEEEILSPCLSELYYEQHLEL

SEQ ID NO: 109058 - protein, 129 aa, Triticum aestivum
  Clone ID: PAT_TA_3476.pep
PTPGRCHAALSSVHLPPRRPQPLPAPARSVLPPPMPPPCPTTFCLLRRFAGPPPVCFPPPPPLSCPSRPPRHARQWRWYCAGGRDVGTPHRRRCLCPLPASSTIPSPRSPSTTRNRQYGDCGYAARRRT

SEQ ID NO: 109059 - protein, 214 aa, Triticum aestivum
  unsure (1)..(214): unsure at all Xaa locations
  Clone ID: PAT_TA_3477.pep
PCGRTHWLDVSPTTTLSSSPSPPARASQQAVRPSKRVRSGXPGTASGXGGGGSGGGSAXGGGSYPMCQVDDCRADLTSAKDYHRRHKVCEIHSKTTKAVVGNQMQRFCQQCSRFHPLSEFDEGKRSCRRRLAGHNRRRRKTQPTDVASQLLLPENQENAANRTQDIVNLITVIARLQGACAPTLPGTPPLPDLDLLALFSGSVFSGDNANSLAK

SEQ ID NO: 109060 - protein, 244 aa, Triticum aestivum
  unsure (1)..(244): unsure at all Xaa locations
  Clone ID: PAT_TA_3478.pep
MPRGPWNLKMFVEHYSRCESVRESAVLRDKGNPPGSDAFDSTVPVRIRVEELNSLNNRFKSRPSXIKTRAVXELDDDIMMTCXDVEKGFGVWXREHPERMVGFYPRMIDGDPPQYRNERYARGKKGYNLILTGAAFMDSEFAFRRYWSEEAGEGRDYVHKNFNCEDLLMNFMYANASSGAGGRTVEYVHPAWAIDTSKLSSVAISRDTQKHYDVRTKCLAKFSSIYGPLPQKWEFGRRQDGWDK

SEQ ID NO: 109061 - protein, 455 aa, Triticum aestivum
  Clone ID: PAT_TA_3479.pep
MAEDGEKAAAAAAVGGVAGGGGGEAEQEREEQSVKLFVGQVPKHMTEAELAAMFKEVALVDEVTVIKDKATKASRGCCFLICPSRDEADKAVNAYHNKHTLPGAASPLQVKYADGELERLEHKLFIGMLPKNVADTELTDLFSKYGNIKDLQILRGSQQTSKAGCAFIKYEMKEQAVAAIEDLNGKHKVEGSSVPLVVKWADTEKERQARKAQKAQLQSPNMPNGRPMPQSSVFGALQMGYMPQYNGFSYQPPGTYGLMQYPLSPMQNQGPFQNMGQPVNQGNSIRGVNPELSPNSGPRSFNPMHLGSPYPAVPGMQYPGSYPGGPMNNRPFGNPHNPLKVPSANVNLIAFSPRSNGGGQTQTEGPPGANLFIYHIPQEFGDQELSDAFQRFGRVISAKVFVDKATGSSKCFGFVSYDNPVSAQSAIAMMNGFQLGGKKLKVQLKRDNNKLSKPF

SEQ ID NO: 109062 - protein, 99 aa, Triticum aestivum
  Clone ID: PAT_TA_3480.pep
QLLLDRIIPRQPYANKQCPPLLQDRGKTALWGARSRRGMIRMAAARGHKVQRMYLGRDHAMRLSMIMPTLFIQRCLQGKKKSVCITYLQVERIDFFFST

SEQ ID NO: 109063 - protein, 200 aa, Triticum aestivum
  unsure (1)..(200): unsure at all Xaa locations
  Clone ID: PAT_TA_3481.pep
SAGMRRMGYNRSSKRCKEKWENINKYFKKVKESNKKRPEDSKTCPYFHQLEALYRNKAALGSPSGAGGALALPPPAVHANAAPQERIEAFTVAAPISQTAPQQPPVAKNDASNAGNGNGNGGGASAGAPGGXKGWRRATAAAGSSSAKQAATRXAKKPEGIMKETTMEQRQPQPQXXAXHXAINNLQPYRPTDQFRKKSF

SEQ ID NO: 109064 - protein, 170 aa, Triticum aestivum
  Clone ID: PAT_TA_3482.pep
MASIFWGGAQADEVADFDEHDPTPYGGGYDITLTFGRALPPSDEICYPISTASTSSSSYDSHGAAEQHRRRPQDQDSHGSAGHGRRPEESHGSAAGYGHGRKAHDDDDDDGGAYRKPKPSHGDDDDRPSYGRKKNDDDDDDERRSRYKKRDDDDDDERKPRHKKCDDDDD

SEQ ID NO: 109065 - protein, 132 aa, Triticum aestivum
  Clone ID: PAT_TA_3483.pep
MARDCKEKGWCQGDGDSGGRRKLYADDKDAEREDECGICLEACTKMVLPNCNHAMCINCYRDWYTRSQSCPFCRGSLKRVQSRDLWVLTGDEDVIDPVTLEKENVRHFHSFIDSLPLIVPDNLLLVYYDYLV

SEQ ID NO: 109066 - protein, 244 aa, Triticum aestivum
  Clone ID: PAT_TA_3484.pep
SARGSMPSLPSFSSCAATHRSPDPHLPLVSTLALPSTEKERGAEPHARSRSSLRPPASSPARAFFPCCNRRDPAIVAPFCRCSAAAPPHLVSLASADHQGRNTDKQQLTRTRCPPLLPSLSFSLAHPRLTSLSLCLNQDPALPPHLLLRATSSWSSTTSLALDPACSRQPSCPSRGRTLHLRRISHRCKPPAPALLRLSGGGGRISARPHRSAPSPCRRPLFSFSSREHQRTLSCPRVSARVGH

SEQ ID NO: 109067 - protein, 33 aa, Triticum aestivum
  Clone ID: PAT_TA_3485.pep
FRNLYDNIQHNIKRYMNKRIYMQMCIHTSFMQY

SEQ ID NO: 109068 - protein, 151 aa, Triticum aestivum
  unsure (1)..(151): unsure at all Xaa locations
  Clone ID: PAT_TA_3486.pep
MYPAGAMVAAAAAPARQAASRVDKATSHLLMGPDWAVNLEICDIINADVWQTKDVVKAVKKRLQHKDPKVQYYALTLLETMMKNCGEYVQXEVAEQHVLQEMVKIIQKKNDMXLRDKILLLLDSWQEAFGGPGGKYRQYHWAYLESKAGQV

SEQ ID NO: 109069 - protein, 154 aa, Triticum aestivum
  Clone ID: PAT_TA_3487.pep
LPLPLPPPSAVSSRKRSKQNIGVLAAGRGFQSTVHAMLDDDQSFTEGISSPIAAHILDFCDDGGGGGDLFGAVNAASDVFAASSEDASSSFTATPPLCSHGDNMSSGAAAATTTASFSPLPSLDSTLSALLEEDQPPGPDAELLLPIDYAFAAA

SEQ ID NO: 109070 - protein, 137 aa, Triticum aestivum
  Clone ID: PAT_TA_3488.pep
MASSSSNGCRICSSSSHKSKQCPRTQCGTCGGKGHVSSICTSHTSGGPLCFRCGLPGHRSSNCWGYSTGHCANCNGVRHSEDECASLVLNPICPNCLKNHYARDCPDGKLSGHSLGTCHFCAVPGHNAPDCPQRRRE

SEQ ID NO: 109071 - protein, 267 aa, Triticum aestivum
  Clone ID: PAT_TA_3489.pep
YFVEVSTTEISILACMHMNGYNQSDSPISMPVWLETLDLGGCGTQHLILSRADGVLTHLSPSILGRCTDGEAPVQPHVASSRGQPPPRYPYLCRASPPRTAGHPRPLLFCTQPPGWGLTRVGSSTALAAAAAPALLPATYARSGITARGAGCRRPAPDPTGSRTWQRPRYCTSSAGEEAGREGSGARGREAAEDRGAAEAGRRGWEKRGVPGGGVWRARRPWRSLVQGREKGGRGEVGDKEGKPGRKGARRADLAARSGRRPADAWV

SEQ ID NO: 109072 - protein, 180 aa, Triticum aestivum
  unsure (1)..(180): unsure at all Xaa locations
  Clone ID: PAT_TA_3490.pep
ALYFKAGLLQHLVDKVPDQFLLNTASWRFLIPRLYRKYPNKDMLLNISAISPPSVRINVGRIDTTVDLDVIVIVLGSDDIVPVACISLSVAVSGRASVSGNNLVGEVELNYFSFDLKWSDIGKLHTXIVQSVMRIVLKNLFRALCELRILGQGFPLPIIKGFVIRDAYILTSYSSIIVSS

SEQ ID NO: 109073 - protein, 236 aa, Triticum aestivum
  unsure (1)..(236): unsure at all Xaa locations
  Clone ID: PAT_TA_3491.pep
SIKHHPTIAPKQLPTVLLVVCATLLALAPPLLAGDPDMLQDFCVADYKSLDGPLRLNGFPCKRPETVTADHCYSAALAVPGDTGNPVGSAVTAANVEKLPGLNTRGVSMSRVDYAPWGVNPPHTHPRATDIIYLLEGPLDVGXARLPASSLPAPAALVFPPGSADHPKNSSGATASANPALTRHPPGTLSPPRPSFGRSPQAPPGVLPTARQGRAGLRRPVGAIFPPSYLALHLHA

SEQ ID NO: 109074 - protein, 331 aa, Triticum aestivum
  Clone ID: PAT_TA_3492.pep
RRPPLTIESSENPPSQFILSKSHTENLVETLPTREGWATPLVLYSNCWIRANSLKDSMAVKDKLKPRPDDIILAAHPKCGTTWLKALLFTIVNRSRYTFTDHPLLTRRPHQVVPYLALRPGDLDIVETLPSPRLLSTHLPLSLLPSTVSTLGCRIVCVCRDPKDAFISRWHFEKRMNQGMSIGMDEAFTMFCEGCSPYGPFWDRYLEYWKESLARPHEVMFLRYEEIVSDTPKVISKLASFLGVPFTQEEDSNGVVEQIEDLCGFTSLSNIAANRPSRVEHEQAGEKLVVDPTSLFRKGKVGDWVNHMSKDMGDRMDQLVAEKFKGSGLIF

SEQ ID NO: 109075 - protein, 222 aa, Triticum aestivum
  unsure (1)..(222): unsure at all Xaa locations
  Clone ID: PAT_TA_3493.pep
TRSSQTVSDYSCNGRHVITMTRNLDRPIIGSVLQTMFGVSPTHQSWSPEHNATVVDYTWEHRTHTIWGRSQETKSLSFVQKDAARRNVLLTTLNYTITSPVEVXWRSLAAHGGENITXKKRRHVEFIQRGNPPTFKLERVVSAMSRLDYNKAMYLLRSSDHDMYAIYMLVYQASQELEASLVCFKDPPFPWLSVSLSGVFVFGFFFVYSKRDSLFRSKRKQL

SEQ ID NO: 109076 - protein, 171 aa, Triticum aestivum
  Clone ID: PAT_TA_3494.pep
DVTFSVGGETFQAHKIWLAMRSPVFKAELFGPMKEKRMRCLTIKDMQPAVFKALLHFIYTDSLPDLDDLEGDDKCEMIRHLLVAADKYAMDRLKIMCQNILGKSLDVENVATTLALADQYSCDKLKDVCIEFIASSDKMDDVVATKGYANLKRSCPSVLIDALEKRSRPRI

SEQ ID NO: 109077 - protein, 96 aa, Triticum aestivum
  Clone ID: PAT_TA_3495.pep
MEAPSSSPTLQDHLSRPTGPLHLKVWEGVCIALGVFMAVIFFLTVWLTMRSRKRTKRASANIPVTQIPAISKEINEVRVEQVPATDFGAHDGVLLT

SEQ ID NO: 109078 - protein, 206 aa, Triticum aestivum
  unsure (1)..(206): unsure at all Xaa locations
  Clone ID: PAT_TA_3496.pep
ASHQGLPPAPRGLPPIEVAFDSNGNGILTGSGKGKATTRAQQITTRSSRGLSXLSESEIEKMVREAELHSQKDQERKALIDITKHLQTPPFHSIEKRLGEYERAKIPAXEIASEIETAXADLRTEMASDDIEKIKSKMEAANKAVSXKIGEHMSGGGPAEGGVVGGSHERRVAGRRLTNCPRCRITRRRRRQAAPASQASSNTVIS

SEQ ID NO: 109079 - protein, 116 aa, Triticum aestivum
  Clone ID: PAT_TA_3497.pep
MEAAAELAQRLRAAANDRLAGQEPLLLVAAPLLALLAARAVHAAAVDVADRGLRTVLITLAMAGVKLCEKLQTRSASSENNVPTELPAVGIPDRVIGDLQALKDKDVRWHGKCSGA

SEQ ID NO: 109080 - protein, 140 aa, Triticum aestivum
  Clone ID: PAT_TA_3498.pep
HFEVNILQPMALRHYLPASGHQPALSSNQTTSNKYHLHEIIDRRTTLRSQHPQTNGSLALSSSSWLSNLIVGSCLNAISSICSSNFEGCWRCRGCGRCVELPRAGNSDDAFGLRAWGRKSRQHPHSHTEAGSKRLRPCGR

SEQ ID NO: 109081 - protein, 178 aa, Triticum aestivum
  unsure (1)..(178): unsure at all Xaa locations
  Clone ID: PAT_TA_3499.pep
MAKVHPNLAVPSLGMVAAAARDDEPVTLTVWRKSLLFNCRGFTVFDASGNLVYRVDIYASDSRAEVVLMDAAGRPVLTVRRKKAISLLGDQWLVFPGEETRAPPLYAVKRTPQYMRGGGKSTAHVAACGGRRRRRAXGAAGGARCRGGASYARRCCAVYVGRRRTVPEVRPFRAGAHR

SEQ ID NO: 109082 - protein, 119 aa, Triticum aestivum
  Clone ID: PAT_TA_3500.pep
HAADLFTRLLNHPDGIHAPGDIAGKSSERPSGLLPHQMRGSLSQYSLLTLVGYSSSSCIACSNAVLREYRSRGLDFVMQVINEPTYLEDLTGLTELMKSADYSRVEWVDEVDDEEFADM

SEQ ID NO: 109083 - protein, 131 aa, Triticum aestivum
  unsure (1)..(131): unsure at all Xaa locations
  Clone ID: PAT_TA_3501.pep
AGRVGTPSTLPRLRPQTKRGSSTDSNPSQDAAAAQPLAGAEAAAARRRRRRRRGGGGAAVGXEQSAEAKADKAPGGRPERSIHLIPLLTFLCFLLLFLCSHAPSSSDMSSFGGGGGGAGGRKAGNRRLMML

SEQ ID NO: 109084 - protein, 444 aa, Triticum aestivum
  unsure (1)..(444): unsure at all Xaa locations
  Clone ID: PAT_TA_3502.pep
PPCIWQTVELFARMLHHPXGIHAPGDMAGMDTEHQLGLLPHQMRGSLPRCDLSTVISNSSNDCTACSNIVLSEYRREGLNFVMQAINQPTYLKDLTGISNLIKSDTCLKLPASFPVNSGKLSSARCLLLGAGTLGCDVARILMDYGVRTLTIVDSGCVVVSNLARQSLYTTKDRKTPKATAILEHLKERCSSVEVEGIQMEIPMPGHPVSSKEAAGVLKACERLQELVAAHDAVFLLTDTRESRWLPTLLCANENKIAITAALGYDSYLAMRHGAGPGINSEGSDMVAAMNKLSAEDVLGRQRLGCYFCNDVIAPVDSVSNRTLDQQCTVTRPGLASIASGHAADLFTRLLNHPDVIHAPGDIAGTSSERPXLGLLPHQMRGSLSQYSFLSLTGYSSSGCIEGAFAEFRKSGCGDLVVVIKVLNYLAYLEDLTGLTKLVESAGV

SEQ ID NO: 109085 - protein, 161 aa, Triticum aestivum
  Clone ID: PAT_TA_3503.pep
ALEWWTGAGWGFFFCARLLLAQPSLGEAASTSVAAAASASASVKLGSKPDAFRRQGQAWFCTTGLPSDVTVEVGGMSFHLHKFPLLSKSAVLEQLIEESSDQEECIIKLSDIPGGAKSFEMVARFCYGVKIELSSSNVVHLRCASEHLQMTEEISDDNLIA

SEQ ID NO: 109086 - protein, 54 aa, Triticum aestivum
  Clone ID: PAT_TA_3504.pep
MVSTRGYMGHGLKYIMRFTQSTLHSTMRNSDAMFLNNLYICFYIEIKFHHNFAI

SEQ ID NO: 109087 - protein, 175 aa, Triticum aestivum
  unsure (1)..(175): unsure at all Xaa locations
  Clone ID: PAT_TA_3505.pep
WFKKXYKPPVFDEKYQTSLADVDAAFGDSEEKQVKEEIEGQPASMNAFELISRHEGLKLDNFFEADKKYRRETRFTSQCPPEEIISRIEEAAKPLGFDIQKKNYKMRMKNLEAGRKGNLNVATEVFQVAPSLFVVELKKAKGDTLEFQKFYKTLSAQIKDVVWVCESEAEERGST

SEQ ID NO: 109088 - protein, 472 aa, Triticum aestivum
  Clone ID: PAT_TA_3506.pep
MEVGRQASDETLHLVLETLQSAIKSGGEQSTSIEPVISPIILDVWAQHIADPFISIDAVEVLEAIKNAPGCLEPLVSRILPTIATILSKSKIQPDGLVAGSLDLLTMILKNAPAAVVKAVFDTCFTSTIQIVLESDDHGEMQNATECLAAFISGGRQELFVWGGESTLKMLLSAASRLLNPELESSVSLFVGSYILQLILHIPSHLSPHIPELIAAIVRRMQTSDIAGLKSSLVVIIARLVHLSAPNVDQFINLLLAIPAQGYGNSLAYIMSEWSQLQGEIQGAYQIKVTTTALALLISTRHPELSRIEVNGHLVKTSAGITTRSKARVTPDNWTKIPLPSKIFALLADTLAEIQEQVGDDADNIDEEDSDWEEVQNGDATPHDIVYSASVPSNANPSVEHLNAMAKVFDEDEDDSYDDDLAKADSLNEVKLLDFLTNTFVNLWDSDRPLFEYLCQGLTNPQRVAVQKVLRK

SEQ ID NO: 109089 - protein, 200 aa, Triticum aestivum
  unsure (1)..(200): unsure at all Xaa locations
  Clone ID: PAT_TA_3507.pep
MPSARSGGASRRAPATRPCAPYIRSGSFADIGPRRYMEDEHIRIDDLSAHLGSLLGCPLPSAFYGVFDGHGGPDAAAYMKRHAMRFLFEDREFPQALQVDDIYLQSVEECIRSAFLQADLALADNLDISRSSGTTALAALVFGRQLLVANTGDCRAVLCRRGIAMEMSRDHRANYAEECQRVAAXAGFIEDGYLNGVALR

SEQ ID NO: 109090 - protein, 279 aa, Triticum aestivum
  Clone ID: PAT_TA_3508.pep
MGGDYYHACCGDPDPDLKPEGPQVPYIGNKEPLSALAAEFQSGSPILQEKIKLLGEQYDALRRTRGDGNCFYRSFMFSYLEHILETQDRAEVERILKNIEQCKKTLSGLGYIEFTFEDFFSMFIEELQNVLQGHETSIGPEELLERTRDQTTSDYVVMFFRFVTSGEIQRRAEFFEPFISGLTNSTVVQFCKSSVEPMGEESDHVHIIALSDALGVPIRVMYLDRSSCDTGNLSVNHHDFIPAANSSEGDAAMGLNPAEEKPYITLLYRPGHYDILYPK

SEQ ID NO: 109091 - protein, 267 aa, Triticum aestivum
  Clone ID: PAT_TA_3509.pep
SGNPGFLQSQFQQLHLHNPPAPPQQGHQVIQQSHQEMQQQLSSGCHRISDVDSSMPGSESASQSQSSFYQQNLLEGNNDPSLHLHNGFRNFSSQDSSNLVSLPRTDQLMAPEGWPSKRLAVEPLGHIESRSVQPKHENVNHQSNMSHFAGTLAPQSARDSSSVQAYGANVDNQFLSSSFAFQDGMAGARGGSSSGTVSMAIPLLRYSGEDLPPADTLATSSCIGESGTFNSLDNMCGVNPSQDGTFVKVYKSGSPGRSLDITKFSSY

SEQ ID NO: 109092 - protein, 179 aa, Triticum aestivum
  Clone ID: PAT_TA_3510.pep
MGWAIALHGGAGDIPRTLPPERREPRLATLRRCLDLAAAALRAGRSALDVVELVVRELEDCPHFNAGKGSVLTSDGTVEMEASVMDGTDMRCGAVSGLSTVVNPVSLARLVMDKTPHIYLAFDGAEAFARDQGVETRDQSHFITEENIERLKNAKEANRGADRLHPIQLHPPNQRSQRR

SEQ ID NO: 109093 - protein, 227 aa, Triticum aestivum
  Clone ID: PAT_TA_3511.pep
KLIEQLEHQISNIILEEREEMALRKAEMEATKAENMIAHRDEIYSRPKRTWFATEKEKKLLAKAAKESLDQVKGGSVVVSAQQAEDLRLKEKRRREREKNLPRKKRRKLEAQREMLEEEKEDEEEAQESKGGKKAKSSQSVVDVAYRRAKSMKATGKTGIRASKGKNDKGSKQPSEKGQTRQEEMHELFQNDMSEWKQGRSLKKKDTSFAKKSKNSFKSKSRYKRRK

SEQ ID NO: 109094 - protein, 236 aa, Triticum aestivum
  unsure (1)..(236): unsure at all Xaa locations
  Clone ID: PAT_TA_3512.pep
MEKPAAQAPGKAASEEKQLDDKELELERERKLKKEQKAREKEEKKLKAKQKETARLQAQATSDGPKKSEKKQKKKAAGDENPEDFIDPETPSGEKKSLAPQMAKQYSPSAVEKSWYSWWESAGYFGADPASTKPPFVIVLPPPNVTGALHIGHALTVAIEDAMIRWRRMSGYNALWVPGVDHAGIATQVVVEKKLMRERKLTRHDIGRDKFISEVLKXKDQYGGTILGQLRRLGAS

SEQ ID NO: 109095 - protein, 160 aa, Triticum aestivum
  Clone ID: PAT_TA_3513.pep
EQVASRPSKQAAMAIGTRDLGAGAGFGHSKARGDLPHPHLPARCPPSRRGIKAPEPQPGSRPDTTAPCGRRPPSPGWPLRMPTRKGNGYDDGGFEDDVGGAGRAGRNDAGANRGRHRENTTAATQAEGPAAANGAHHNANPAQEPRPHGGHKEAAYRPAG

SEQ ID NO: 109096 - protein, 198 aa, Triticum aestivum
  Clone ID: PAT_TA_3514.pep
MASRRQAAAAASDALAQEHKGDAKPVRRPKAAAGQQPAARPRPALIDLSNRMSSRAALAVPNRPKAVAVAAVDNCRKAIKKQKENNRVKPEVIVISSDSENEKKNPGKRATSWRAPPLTAILTKCSRESDGVISSTKKVSATYNIDKADAHNELAVVDYVEDIYRFYKSTEGSSRPLCTYMSSQTDINERMRAILIDW

SEQ ID NO: 109097 - protein, 116 aa, Triticum aestivum
  Clone ID: PAT_TA_3515.pep
NQRSLLRTVELYLLVTFSLGGFTVKMTIMPLPLISPLRKRTVRRFVPRLHRTSSWSLCHPSLQVMPGWLACLVLFLCLRARINIPARVPADWSPSSPIVVPLPVVVPLLQVVMLLV

SEQ ID NO: 109098 - protein, 158 aa, Triticum aestivum
  Clone ID: PAT_TA_3516.pep
MSLIPRGKAFDPFSLDLSDPFDGFPFGSGGISSFFPSFPRASSETAAFAGARIDWKETPEAHVFKADVPGLKKEEVKVEVEDGNVLQISGERNKEQEEKTGTWHRVERSSGKFLRRFRLPDNAKADQIKAAMENGVLTVTVPKKEVKEPEVKSIQISG

SEQ ID NO: 109099 - protein, 210 aa, Triticum aestivum
  Clone ID: PAT_TA_3517.pep
MATAAVLASREGKGRHYIPSSVILDLFGQIGPSRNATTATSKTSTGLPIAVTFCAARPPVLSHFSFSSAACPEPEGLSLAPKVISADADLVLLRVPVQPFGDSNPMFSDYFVYRAHSQIPKLDLLPKSAPYYFGDKEIAILSCGDGKYAVASLQTLGMCTFKLHVYRSRPDGKPGSWTSKLLDVELNVKELPRDNSSSISLASQMLTYHR

SEQ ID NO: 109100 - protein, 328 aa, Triticum aestivum
  Clone ID: PAT_TA_3518.pep
MAASAKMMTKSSAEPGKSVTLVFEQGRLAVEEKEIKVGHNATPPVPVLIVAPKDAGTYPVAMLLHGFCLENHHYKHLLRHIASHGFIMVAPKIHQTIMHTGQHDINEAAKVADWLPDGLPSVLPKGVKPELLKLAVAGHSRGGHTAFSLALGHAKTRLRFSAFIGIDPVAGQGKDSHLEPTILIDNPSYFDMAARPVLVIGTGLGEVGKTIHNIPILPFSHWPPGAPKGVNHVQFYGKCRPPCYYFVTKDYGHVDMLDDDAIGLHNLFCKRGDGCKDKMRRCVAGIMVAFLNAALGEKHDGDLEAILTDPAVAPIMLDPVKHHPTSPK

SEQ ID NO: 109101 - protein, 201 aa, Triticum aestivum
  Clone ID: PAT_TA_3519.pep
MAAQSLLFAAAAPLFQAPASARPFQSLRIVCTPEGATAAARALVVADATKKAVAVLKGTSQVEGVVTLTQEDDGPTTVNVRITGLAPGLHGFHLHEFGDTTNGCISTGPHFNPNGLTHGAPEDEVRHAGDLGNIVANAEGVAETTIVDSQIPLTGPNAVVGRAFVVHELEDDLGKGGHELSLSTGNAGGRLACGVVGLTPL

SEQ ID NO: 109102 - protein, 205 aa, Triticum aestivum
  unsure (1)..(205): unsure at all Xaa locations
  Clone ID: PAT_TA_3520.pep
MAAQRRLLFAAAAPLFQAPASARPFQSLRIVSTPGGATAAARALVVADATKKAVAVLKGTSQVEGVVTLTQEDDXCPTTVNVRITGLAPGLHGFHXLHEFGDTTNGCISTGPHFNPNGLTHGXAPEDEVRHAGDLGNIVANAEGVAETTIVDSQIPLTGPNAVVGRAFVVHELEDDLGKGGHELSLSTGNAGGRLACGVVGLTPL

SEQ ID NO: 109103 - protein, 303 aa, Triticum aestivum
  Clone ID: PAT_TA_3521.pep
MGGGVMRTAAKVGLAGGAAAAAGRFRNVAPSFATAPAAEAAAAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSSDSVESPEKFEEASPEYALPTASPLSDFVDNAKKTMMEMVDNITNFFQDLFHNPAEAEAGPGSSSKKPSFAEMAAGGSFMALAMAVILVVLFKRA

SEQ ID NO: 109104 - protein, 157 aa, Triticum aestivum
  Clone ID: PAT_TA_3522.pep
AAPSPSPAAGPSLAPTPPPRPPLAPPPGPGPPPPRPPAPAPPPPLARGAPGAVPGPPPRAPAGGAPSAVGASGLRAPVLCGFSCALWRDALLVAGLPEQVPPWPCGLCLYVLKKEMQKSDHHEQNLTSPRGLIHKVLRRTSSRRSPTAAEQDPSPVF

SEQ ID NO: 109105 - protein, 322 aa, Triticum aestivum
  unsure (1)..(322): unsure at all Xaa locations
  Clone ID: PAT_TA_3523.pep
ASRRRRANRIAAAAAAAAELXDGLPRFEKNFYVEVPAVAGMTAEXXSSAYRRRRXXITVEGNDVPKPVRDFRDVGFPDYVLQEITKAGFTEPTPIQSQGWPMALKGRDLIGIAETGSGKTLAYLLPAIVHVNAQPILAPGDGPIVLVLAPTRELAVQIQQETTKFGASSKIKSTCIYGGVPKGPQVRDLQKGVEIIIATPGRLIDMIESHHTNLRRVTYLVLDEADRMLDMGFEPQIKKIVSQIRPDRQTLYWSATWPKEVELLARTFLFDPYKVIIGSEELKANHAICQHVEILSESQKYNKLVNLLEDIMDGSRILVFMD

SEQ ID NO: 109106 - protein, 155 aa, Triticum aestivum
  unsure (1)..(155): unsure at all Xaa locations
  Clone ID: PAT_TA_3524.pep
MKRVVASPGRWSGMALRRRPCAXAAALLFCLVFGFRYSNYXAYFYMKLALILQLMWSLGLACKDIFALRNKKDLHTPDNLFIIVMVDWVVATFMFSGACASASLTIFFMWDVNFCETYSKLACRHFVLSVVLAFITWLLQAASSFSAFWLLVSFS

SEQ ID NO: 109107 - protein, 286 aa, Triticum aestivum
  Clone ID: PAT_TA_3525.pep
MPAPAVRLPSSRYACSQLCLGSPHVGPSLVNSGPYCLLADTQASGNKRKVTAFIGGLDLCDGRYDTPQHRLFKDLDTVFENDFHNPTFSAGAKGPRQPWHDLHCKIDGPAAYDVLKNFEQRWRKASKFRDRFRKVSRWKDDALIKLERISWILSPSPNVPNDHVSLRVSKEEDPENWHVQVFRSIDSGSLKGFPSDCKEASKQNLVCRKNLIIDKSIHTAYVRAIRSAQHFIYIENQYFLGSSYEWPSYVNSGADNLIPMELALKIATKIRAGERFAVYIVIPMWP

SEQ ID NO: 109108 - protein, 294 aa, Triticum aestivum
  unsure (1)..(294): unsure at all Xaa locations
  Clone ID: PAT_TA_3526.pep
FLCCIFSSCEQKWSAMEAAGDEETPLLHHHPPSGLYQNGDSSXYTCDATVDVDGQPAAKASTGDWRACFFVLGIQFSECLAFFAISKNLVTYLTSVLHESNIDAARNVSTWIGTTFFTPLVGAFLADTYWGRYKTLVVFLSVYIVGMLVLTVSATLPSMMQSSNHGEIHRIAVYAGLYLTALGNGGIKPCTSTFGADQFDITDPAERVKKGSFFNWFFFAITVGSLLSTTVIVWVQDNVGWGIGFPVPMILTSLGFAVFIASRRIYRYKSTGESPMTTASRVVVAAARNRRLEL

SEQ ID NO: 109109 - protein, 353 aa, Triticum aestivum
  Clone ID: PAT_TA_3527.pep
HEEQASPPAGSARNRKVVLREYISRAPREDDMALVDGGAVPLRVPEGAAGPAVLVKNLYLSCDPYMRGRMRDFHGSYIPPFKPGSVIEGLGVARVVDSTHPGFVAGDIVSGMTGWEEYSLIDKPEQLNKIQQSGIPLSYYLGLLGMPGFTAYVGFYEICSPKKGEFVFVSAASGAVGQIVGQLAKLHGCYVVGSAGTNEKVKLLKDKFGFDAAFNYKEEPDLTAALKRYFPEGIDIYFENVGGPMLDAVLLNMRMHGRIAVCGMVSQHGMTDPAGIHNLFCLVPKRISMKGFIQSDYINLFPQFVDYMTKHYKDGKIAYVEDMSIGLENAPAAFVGLFSGKNVGKQVVCVSQE

SEQ ID NO: 109110 - protein, 284 aa, Triticum aestivum
  unsure (1)..(284): unsure at all Xaa locations
  Clone ID: PAT_TA_3528.pep
RPIQPLPILQPFGYQALCKMFRDNYFDEDSNLKIGKKEATLIGNLCAFQFWQRMFKDKYRQEYLKMVADTQEPTAYHAFISKQEEHEGAFHNLLPAALNNISEIYDDVMCTLHRFRPSFLVEIDPPKYLLPSEFHHVCLHHKVLEPEDMNSLSLESESSHLGSQRKCAATPYVSATDFGVTLTVVVLKALIKEMKTQLAEDNVVSCRERVSGYAQQTVESEMCVFFIRGSCTRGNTCPFSHSSRAPKPVCKFFLTLQGCRNGSSCSFSHDCGSSNMKTSSITSX

SEQ ID NO: 109111 - protein, 87 aa, Triticum aestivum
  Clone ID: PAT_TA_3529.pep
MAQHGFLSSLRSHLRSPPPPSHIQPRRGYHVELGAREKALLEEDVALKRFKSYKNSVKRVSKIGNVLTLVVFAACSYEVVALATSTQ

SEQ ID NO: 109112 - protein, 273 aa, Triticum aestivum
  unsure (1)..(273): unsure at all Xaa locations
  Clone ID: PAT_TA_3530.pep
MAPTRLPLLLLLAATVAAAADLSVYHNVHPPSASPLESIIALARDDDARLLFLSSKAASAGAASAPVASGQTPPSYVVRAGLGSPAQPMLLALDTSADATWAHCSPCGTCPASSLFVPANSSSYAPLPCSSSMCPILQGQPCPDRDPFDSAAPLPSCAFSKPFADASFQAALASDWLHLGKDSIPNYAFGCVGSVSGPTSNLPKQGLLGLGRGPMALLSQVGNMYNGVFSYCLPSYKSYYFSGSLRLGAAGQPRAARYTPMLKNXHRSSLYYV

SEQ ID NO: 109113 - protein, 158 aa, Triticum aestivum
  unsure (1)..(158): unsure at all Xaa locations
  Clone ID: PAT_TA_3531.pep
SLFHAPDCAPSGYTSLGAFDTCFNTDEVAAGGAPAVTIHMDGGVDLALPMENTLIHSSAXAAGVGEHAEPHAGATPLACLAMAEAPQNVNSVVNVVANLQQQNLRVVFDVANSRVGFARVRRPVPTRDDISSRVYAVINRIISHAFGCTYVRTCACDC

SEQ ID NO: 109114 - protein, 126 aa, Triticum aestivum
  unsure (1)..(126): unsure at all Xaa locations
  Clone ID: PAT_TA_3532.pep
DVSSLIPSMRSAEQSMDACLRRFRATRRMILYYEDVIRDDNVSSSAISYRIRSYHPSGXVGDEALLLEWFGLQALSRVQEFLGLPVRRLSSRHVKIHTSPLPDLVDNWEDVRRTLKPTEFARLLDG

SEQ ID NO: 109115 - protein, 174 aa, Triticum aestivum
  Clone ID: PAT_TA_3533.pep
MAPRSAALAVVAVAATLLALCGSTEAHTQLGAYNKTCPQAEDIVFKEMTAVLAKSPGLAGSLLRLFSVDRLLGDREGSILLDSTANNTAEKDSPLNKGLRGYDVVDSIKAKLEAACPGVVSCADVLALAARDSVRISKGPYIPMPTGRQDGNRSSAADVAPNTPKPGANVTDLI

SEQ ID NO: 109116 - protein, 127 aa, Triticum aestivum
  Clone ID: PAT_TA_3534.pep
PPPIHSPIFVRRNPSAPRRDLRAGTRAPPPAESAPPSCPGAKHAPDTPPLLPRAGPVQAPRPAPSSVRRRTPPGSAPRRPRAPTPRQGTRRPPAACRPRRIRARSVTSPAVRGSLCRTIRSLDRSML

SEQ ID NO: 109117 - protein, 114 aa, Triticum aestivum
  unsure (1)..(114): unsure at all Xaa locations
  Clone ID: PAT_TA_3535.pep
SLXXTAXHXXRRAIPRSSPPXSSSPPPTGDGGERGSLGWNFGDLVHSVELLLPNFSTDFLVEWKVKKDNEFICGSYRCEQSIRDALRSVFAGHNEILNVWKDKVKKKKKRLLED

SEQ ID NO: 109118 - protein, 258 aa, Triticum aestivum
  Clone ID: PAT_TA_3536.pep
IQDDAEAGGWYEGSSIIGLSYSVCRNLAKGEGKDGEMQRNLLLEKPGLLVLDEGHTPRNKKSLIWKVLAEVSTEKRIILSGTPFQNNFLELYNILCLVKPKFAKDFACTRLSKKGVASTSQSRAAPYVEEDEGKEFWSSLRISNITDEHITEIREKLGPFVHIHNGDILQKSLPGLRESVVILNPLPRQKEIIAMMEESAGKGFLDAEYKISLASIHPFLVTSTKLSDTEASVVDKMKSVRLNPCEGVKTWFVFEIIR

SEQ ID NO: 109119 - protein, 298 aa, Triticum aestivum
  Clone ID: PAT_TA_3537.pep
MAAAASANPGTAYKLLLSCPEGLPRSRVSVRFDPSIDRIPHPDASLEESIGEIWNQRLQQNPSLYNGTKFRYGGHALHRSDESNQEYCVSLHLGLTDYRTFVGTNLSPLWEKFLVPSQDDSVCCQHMSNPLGNGAIVETSDEKIIVLQRSNNVGESPGHYVFPGGHSEPQEVGILAHQNDEKDVAGLTERISDEMFDGIIREVVEETGVPASSLTEPILIGVSRRETNVRPAAFFYMRCNIDSSAITELYARAQDGYESTKIYAVSVKDLRDMSQRLPGCHLGGFALYELMRNASESL

SEQ ID NO: 109120 - protein, 295 aa, Triticum aestivum
  Clone ID: PAT_TA_3538.pep
RCGRGHPVRLRVPRRGLDPAGLSYRSARQEVFGLLDLAGLRAVTVDEAASTAWVESGATIGELYYAVAKNNPRLAFPSGECPTIGVGGHCSGGGIGMMMRKYGLSIDRVVDAKLLVNANGDLLDRAGMGEDLFWAIRGGGGGNFGVVLSWKVQLVPVPATVTVFNIAKTLEQGAIDILTKWQDVAPALPSELTITVMVTGQQAVFRALYLGECGSLASTMRDRFPELNMTSADCQPMTWLQSAALSFFSFTNSKPVEDVLLPRPASPTTFSKGKSDYVRRAIPKAVWKEIYASWF

SEQ ID NO: 109121 - protein, 480 aa, Triticum aestivum
  Clone ID: PAT_TA_3539.pep
GVFSCSEVCSHNLACGNHACQDVCHPGPCGECELLPGKVTTCHCGKTRLQEKRASCLDPIPTCDKVCDKRLPCGVHRCKVACHEGECPPCLVRVEQRCRCGSSGQMVECYKVLKEEFRCNKPCGRKKNSARPRCSELCCPLSKPFAQHQGDSMDPHFCQIPCGKKLRCGQHGCQHLCHSGHCDPCRETIFHDLTCACGRTSIPPPQPCGTPTPSCPHQCMVPQPCGHPASHQCHFGDCPPCVVPVTRECVGGHVMLRNIPCGSKDIRCNQPCGKNRQCGLHACARTCHPAPCDPPPANGEASSSSGGKVSCGQLCGVPRRECKHTCNAPCHPSSPCPDVRCEHRVTIACSCGRITTAVPCSAGGAYNGDSAFDISVMQQLPMPLQPVESNGKRVPLGQRKLCCDEECAKMERKRVLAEAFDITPPNLDARHLGENSNASDLLPDLFRREPMGLPARCKSWGRESQQHNSLRHIRQRITMQ

SEQ ID NO: 109122 - protein, 158 aa, Triticum aestivum
  Clone ID: PAT_TA_3540.pep
MDGIMQCVVPLTQDQYGNYVIQHVLQHGKPEERTSIIKQLAGQIVKMSQQKFASNVVGSLAEFDCFEERQILINEMLGATAYHEPLQATIVADSWNYVVQKVLETCDDHNRELILSRIKVHLNALKRYTYGKHIVARVEKLIAAGERHIGVSSQSCRD

SEQ ID NO: 109123 - protein, 109 aa, Triticum aestivum
  Clone ID: PAT_TA_3541.pep
LLGDVHAAEYHILSATHEIDHRGGSSNNGVLQAYNNASLLDATLFAVQRARGASKNAVQIRIGRKITHSNRDPEDLDRASLEGHASHGGELHDTAMAAPVERTCTQFRL

SEQ ID NO: 109124 - protein, 357 aa, Triticum aestivum
  Clone ID: PAT_TA_3542.pep
MDVLSAKLLRSSLHPHAPFLPCPSLPSRRYRRPSSIYCRLTTSSLSSSSAATTSEGDANQDLSALLSDESTTDAPGAGSRKKRSNSGASSIPSGVRLENISKSYKGVTVLKDVSWEVQRGEKVGLVGVNGAGKTTQLRIIAGLEEPDGGNVVKAKENMKIAFLSQEFEVCASQTVREEFFSAFQEEMGVKTRLDQVQAALERATEDMDLMGRLLDELDLLQRQSQDVDLGMVDVPIQKLMPELGFVPEDADRLVASFSGGWKMRMSLGKILLQDPDLLLLDEPTNHVDLDTIEWLESYLKTQDVPMVIISHDRAFLDQCCTKIVETEFGVSKTYKGNYSGCVLAKAIWVETQRAAWE

SEQ ID NO: 109125 - protein, 463 aa, Triticum aestivum
  Clone ID: PAT_TA_3543.pep
MPPPSLLLFHCRAPLPHRPLRMSSPSPSRRVVCSVSTAEGYISAAPILLPDGPWKQVEGGVTAAKGFRAAGIYGGLRAKGQKPDLALVACDVDATVAGSFTTNVVAAAPVLYCKRVLSSSKTARAVLINAGQANAATGDAGYQDAVDSAEAVAKLLNVSTNDILIQSTGVIGQRIKKEALINSLPRLVGSLSSSTEGSNSSAVAITTTDLVSKSIAVQTEIGGVPIKIGGMAKGSGMIHPNMATMLGVLTTDAQVRSDVWREMVRTSVSRSFNQITVDGDTSTNDCVIAMASGLSGLSDILTHDSAEAQQLQACLDAVMQGLAKSIAWDGEGATCLIEVTVTGANNEADAAKIARSVAASSLVKAAVFGRDPNWGRIACSVGYSGIHFDADQLDISLGVIPLMKNGQPLPFDRSAASKYLKDAGDIHGTVNIDVSVGNGGGTGKAWGCDLSYKYVEINAEYTT

SEQ ID NO: 109126 - protein, 164 aa, Triticum aestivum
  Clone ID: PAT_TA_3544.pep
MASRLLHLRRLLPAARPSCAAAFSTAVTPTPRVSGLVDEICGLNLIEASSLADALRGRLGVDQLPPLAILMGGAAPLAGDGAGAAEEAKPKEEKMAFDVKLEGFDAAAKLKIIKELRAITSLGLKEAKELVEKAPAVLKAGVPKEEAETIAEKMRALGAKIVLE

SEQ ID NO: 109127 - protein, 184 aa, Triticum aestivum
  Clone ID: PAT_TA_3545.pep
MTTPAAGAPGSPVAAPDQVAARDAVIGWYRGEFAAANAVIDALCGHLAQIGGADYDAVFAALHRRRLNWFPVLHMQKFYSVADVAAELRRVSGARAAAAAAYSEEEAASTVIHEPMDELVVTVAAEPDPEPEREHEPIPGGAARCLRPPRRRGPRAGGGRRRFLGRFVGAEGALRGTRRRPRRA

SEQ ID NO: 109128 - protein, 440 aa, Triticum aestivum
  unsure (1)..(440): unsure at all Xaa locations
  Clone ID: PAT_TA_3546.pep
PRDRSGAKVASPSPGWRASSSPPPAPRLPACPSSPPPAARRGPSRRRRSPLPPGGGEPGGRGSSSPPRPGGSRNGSDGFNTKGFASISSSNXTENTSTGTGTVPPMPPPSSYIGSPVFWIGVGVALSAAFSMVSSMVKKYAMEQAFKSMMTQAPPNTFGANSPFPFSMPPQAGSTAPSSYPYSGPRKNTPKGATVDVSATDVAATGSSEAADVAETSKPSKKFAFVDVSPEELQKQKELQSSLQTVDVKSDSTESETKGDTEQVPTNGAAFKPSEDPSTWTTESRXSGPMLSIDTIEKMMEDPAVQKMVYPYLPEEMRNPDSFKSMLQNPMYRQQLEDMLNNMGASPGQWDNRMVDHLKNFDLSSPEVRQQFAQVGMTPEEVVAKIMANPEVAVAFQNPKIQTAIMDCSQNPLNIVKYQNDQEVMDVFMKISQIFPQING

SEQ ID NO: 109129 - protein, 188 aa, Triticum aestivum
  Clone ID: PAT_TA_3547.pep
DIQLIVDSVQLNIKHLLDAAASKLSEVQLEVQQLYGFVDILHPLDPAPAQLSDVQLVLLQLCRCALVPLPLNLVLEHDRSCNVQLVLVTLMPVAAAQRLAQAREHLEVVNKLKYLEESKEMLEEHLEELKSRTKDICNVAVEERKQLVDELNGITCNIGAAIHADEDLKASLARIMQKANIEEPLLSS

SEQ ID NO: 109130 - protein, 200 aa, Triticum aestivum
  Clone ID: PAT_TA_3548.pep
RNSDAHRLSQQGAITKRMTAIEEMAGMDVLCSDKTGTLTLNKLTVDKTLIEVCSKGVDKDMVLLYAARASRVENQDAIDTCIVNMLADPKEARAGIKEVHFLPFNPVDKRTAITYIDGNGDWHRVSKGAPEQIIELCKMAPDAEKKVHTLIDSYADRGLRSLGVSYQQVPEKNKESAGDPWQFIGLLPLFDPPRHDSAET

SEQ ID NO: 109131 - protein, 211 aa, Triticum aestivum
  Clone ID: PAT_TA_3549.pep
VNRAYKRCMTLLRSVYTTLRLLPAYRVFRLLCANQSYNYEMGYTVGSFAVPFSRAQESAMRSHRFVAVDTQPGRLVVSVQYLSSLAAFNLEISSLSPSMLITNYVGSPAAEPMRNFPSSLTEATGCAFPQSYQQQRPHSWAPPALWPLAPAQQTRFSPPPLHYASPTPSPPNFPGGYLQSPLRGEVCTGDHTRREKEPRAPSEHAGTRLKG

SEQ ID NO: 109132 - protein, 207 aa, Triticum aestivum
  Clone ID: PAT_TA_3550.pep
MGFCATPTSAPGGGPGAAVPPFVPPRRPFSDYSLVPPVSAPVVRLSPVGANAGEKTMIEKRHLYMSDEFIRSSPSITAYNSPSLNLRQGLADAAIPQLGAEAARHAIADWGRQASNITHLVFCTTVSGCMPGADFELIKLLDLPLSTRRFMLYQAGCHGAGISMRLAKDLAENNHGSRVLVVCSEVITMAFRGPSKSHMGNLVGQAI

SEQ ID NO: 109133 - protein, 86 aa, Triticum aestivum
  Clone ID: PAT_TA_3551.pep
MGEPSKELLDLPSGPNPPSFIESLFADREQHKGKRKAGPPTDPLPKSQVLGKVKDFLGEMAKANEKLQLDAQNKPPEEYDIEALTK

SEQ ID NO: 109134 - protein, 193 aa, Triticum aestivum
  Clone ID: PAT_TA_3552.pep
AGHPSPPRVSARFQDKKPPSTWICKNAACKAVLTSENTFCKRCSCCICHLFDDNKDPSLWLVCSSETGDTDCCESSCHVECALQRRKAGRIDLGRSMHLDGNYGCAACGKGTGLPGCRMRQLAGVKGPPWVHLLWTRVDLSHRLLPGTTRFKELHRIVQDAKAKLETEVGPLAAPSMMARYFGRRPPGAADVQ

SEQ ID NO: 109135 - protein, 136 aa, Triticum aestivum
  unsure (1)..(136): unsure at all Xaa locations
  Clone ID: PAT_TA_3553.pep
MQIFVKTLTGKTITLEVESSDTIDAVKAKIQDKERVPPCPQPPMLPGKQLDDDXTVPDYNIQKESTLHFVFRLRRSGRNIEPKLXAHAQQYHLGKLSRRFCCSRLPPLAKSCRKXKCGHSNQLRSKKKCRYCWKCA

SEQ ID NO: 109136 - protein, 206 aa, Triticum aestivum
  unsure (1)..(206): unsure at all Xaa locations
  Clone ID: PAT_TA_3554.pep
TRRSSAASSSQGAVPERFLMRLTAASPTLVSLPVIDLSGGRDEVRRAVLHAGKELGFFQVINHGMPERTMREMEMACSDFFRLPTTDKATLYSEDSEQTNRLLSSTMYRSAASESYACHCLHLACHPVERTKPSWPEKPVRLRPALEDFIIPARSIAMELLRLLCEGIGLQPDYFEGGLTGGDVIINANRYPPCADPNLTLGLXXX

SEQ ID NO: 109137 - protein, 230 aa, Triticum aestivum
  unsure (1)..(230): unsure at all Xaa locations
  Clone ID: PAT_TA_3555.pep
MDEGNVAQQLKQMTDFIRLLAVEXAVEIEAAAAEEFQIEKLQLVEAEKKKIMQDYEKKEKQVGIKKKIEYSMQLNASRIEVLQAQDDLVKSMMDSARKELLYQSRDHQSYKKLLRILIVQSLLRLKESAVILRCRKEDLELVESVLESARNEYAEKENVYPPEIMVDHHVYLPPAPSHYKEHDLSCSGGVVMASQDGKIVFENTLDARLEVVFRKKLPEIRQSLIGQIAA

SEQ ID NO: 109138 - protein, 159 aa, Triticum aestivum
  Clone ID: PAT_TA_3556.pep
PPATPLGPALLPSVLHSPYPRSSCPGLPSPDALPQTPHQPSARPSAAAERPPARSLCPRGRRSVPPSPASLASPKCHRSLHAFSLGCNISRCTSSRTAEMGVQRDRFGVAGPSWSYSSCVCSSAPGHVMLSSLSSFIRTTPVPAAPASPSRTSSPRIIS

SEQ ID NO: 109139 - protein, 63 aa, Triticum aestivum
  Clone ID: PAT_TA_3557.pep
RFKVVVDADGGGDVLNFLREMGLLVASILINQLGLSLQRKPLKWKLTLGRNGCRLGISGPLKS

SEQ ID NO: 109140 - protein, 193 aa, Triticum aestivum
  Clone ID: PAT_TA_3558.pep
LFTDIDGVSRRLADVAVEGRSYSWLEPPPCEDTEQAVRLEAPPPPRPFPPVSSLMPTRLLIKYFLRVDADGLFHTYPHRGGPFKSLKEARDAIDSHHTNLCKFKYMGDLSEEDIHVWQTLYWPNGTRMNSKQALDVMMNRRPKWDVLNALLDKYNEDHHLFGDFAYELKEIVSYKPHFQGKNSPYKCRSFSHL

SEQ ID NO: 109141 - protein, 159 aa, Triticum aestivum
  Clone ID: PAT_TA_3559.pep
RVDGVERELADRNLGSESRGGAGAAEDTAAGGAETGVVVVALLAAVRDGGRLPVLEHLPRHGLDSGRPQNPSGWMDPGAEESRWGRLHWLLRDQDGIYTRPSPTPAPPRVRVRITSHERRQRRSRRGHGWDSDARRRWLPRRAQRRGGSSGFVAWWRRP

SEQ ID NO: 109142 - protein, 88 aa, Triticum aestivum
  unsure (1)..(88): unsure at all Xaa locations
  Clone ID: PAT_TA_3560.pep
RTRGQRRKRMATIHVADPHGTRVVGASVSVEQTSKDFPLGSAIASTILGNDAYQKWLVQRGNAAVFEDXLKWYSTEPASGLLRFDVPD

SEQ ID NO: 109143 - protein, 77 aa, Triticum aestivum
  Clone ID: PAT_TA_3561.pep
QRVKGEEQTLEPGGCGAMAGDEGRAPLVEDVAMEVEVRGPVVAANYTTTRHRTASRAPAHFNYVAVADALGGHGFGC

SEQ ID NO: 109144 - protein, 375 aa, Triticum aestivum
  unsure (1)..(375): unsure at all Xaa locations
  Clone ID: PAT_TA_3562.pep
MRTRSGSLYTCGGVGEPAAPVAGQKRKRSPAAAGEASGGRRKRQASGPDYLDGIPDDLVLSIFSKLAASANSPSDLLSVHLTCKRLNGLGQQDMVFAKASPASLAXVKAAAWSEPVQRFLKRCADAGNLEACYILGMIRFYCLGSRSGGAALLAKAAVGGHPAALYSLAVIQFNGSGGAKSDRDLRAGAALCARSAALGHVDALRELGHCLQDGYGVRRDPAEGRRLLVAANARELSLALAAAAASATYPFASLPISAVAGGAGGVSSSPLLSDFXWSLPEAEPHTANQFMSDWWASRGVPACAIKTTRRHRWRREGQLTVCSQCRAGPETRGNNSGLFLVWSAILVQPGRPVWKAPKGPLLPLQCFLRLIIRCR

SEQ ID NO: 109145 - protein, 205 aa, Triticum aestivum
  Clone ID: PAT_TA_3563.pep
MPSFKAPAPGFSVRFSPFHEHRLLAATSQHFGLVGNGHLLVLDLSAAGPGGPGLTPLFSFPTSDALFDCAWSESHDSLCAAASGDGSVRLFDVTLPPAQNPVRLLREHAREVHGIDWNPVRRDAFLSASWDDTLKLWSPDRPASVRTFRGHEYCVYAAAWSARHPDVFASASGDHTARVWDVREPGPPLGPPAHVPVNWVKSMES

SEQ ID NO: 109146 - protein, 182 aa, Triticum aestivum
  Clone ID: PAT_TA_3564.pep
TPGRDRYLDPQTLPPPPPPPCPSVSFLRRSIATLPSGQDSNLPVGAAPDDLDDELRPDPDAVPYFDEKDLVSDETLWALYERWCRFHGMARDHDEMTRRFGRFKDTAWHVHEFNKSGRSYTKGLTQFSDLEPEEFFGPRRCPRTPRTGSRFFTNDRDEVTAICTDGCLEKYEGPVWIIRNVK

SEQ ID NO: 109147 - protein, 108 aa, Triticum aestivum
  Clone ID: PAT_TA_3565.pep
RARPPDPGRRRPGPPAPPSPPAGCASAPISLTERLCQVLRWPTGSLEIFFPKPNPLLPSTYLHPLPRVAHIKITTHPIVAILRSSSTPGPAPGRVAAVDDVPPPHPVF

SEQ ID NO: 109148 - protein, 303 aa, Triticum aestivum
  Clone ID: PAT_TA_3566.pep
WVLDAIEKQKFEAPPPVAILPAGTGNDLARVLSWGGGLGVVEKRGGLFSVLKDVEHAAVTVLDRWKNTIKDNQGKLMCSPKFMNNYFGVGCDAKVALDIHNLREENPERFYSQFMNKVLYAKEGAKNIMDNMFYYFPWEVKLEIDGSNIEIPQDAEGILVANIRSYMGGVDLWKNEDSVSDTFQPQSMHDKTLEVVSFTGMLHLGRLQVGLSRAQRLAQGHHIKIEITTPMPIQVDGEPWSQEPCTIEVSHHAQAFMLKRVSEEPISHAASIMADILENAENSGTISASQKSALLQEIASRLL

SEQ ID NO: 109149 - protein, 95 aa, Triticum aestivum
  Clone ID: PAT_TA_3567.pep
MPAPASSTSVGSGGRSPSKAVASRPSGGGTVRQRKTTSSTAPRSRAAGTSSGGMWRFYTDDSPGIKVGPVPVLVMSLLFIASVFMLHIWGKYTRS

SEQ ID NO: 109150 - protein, 103 aa, Triticum aestivum
  Clone ID: PAT_TA_3568.pep
QLYAADQSTNVVKKYDKASNTWNIVKPLPVRADSSNGWGLAFKGCGDRLLVIGGHRGPRGEVILLHSWCPEDGNGAGAAADWEVLSVKERAGVFVYNCAIMGC

SEQ ID NO: 109151 - protein, 313 aa, Triticum aestivum
  Clone ID: PAT_TA_3569.pep
TSVSAGHLYKLRRKYGIVEHWVYLACSAMPWEAFDPSRNRWMRLPRMPCDDCFSCADKESLAVGTQLLVFGREYTGLAIWMYNLLTRHWSRCTPMNFPRCLFASGSSGEIAIVAGGCDRNGQVLRSAELYNSEAGQWETLPDMNLPRRLSSGFFMDGKFYVIGGVTSERHSLTCGEEYDLDTRTWRRIQDMYPGGTSASQSPPLIAVVNNQLYAADQSTNVVKKYDKASNTWNIVKPLPVRADSSNGWGLAFKGCGDRLLVIGGHRGPRGEVILLHSWCPEDGNGAASDSDWEVLSVKERAGVFVYNCAIMGC

SEQ ID NO: 109152 - protein, 79 aa, Triticum aestivum
  Clone ID: PAT_TA_3570.pep
NTSSSSIWYELAYMEAKGRVRRGDRIWQIAFGSGFKCNSAVWHALRNVKPSPSTPWDDCIDRYPVELVDGFPTHTHTHK

SEQ ID NO: 109153 - protein, 111 aa, Triticum aestivum
  Clone ID: PAT_TA_3571.pep
KLAGKSFTMRVEPLVDKAKEAGAYLARVSFGTALVASIVLVYATIIAILSSSSDEDNRGRRRRSYGSTMFLPTDLFWYLDAGSSRRRRVEKDKGMSFIESVFSFVFGNGDP

SEQ ID NO: 109154 - protein, 105 aa, Triticum aestivum
  Clone ID: PAT_TA_3572.pep
FEIFSEAVDIEREFVCDALPCALVGMNGDLMSQYIEFVADRLLMALGCKKLYNATNPFDWMELISLQGKTNFFEKRVGEYQKASVMSNLNGGAATQHVFSIDGDF

SEQ ID NO: 109155 - protein, 346 aa, Triticum aestivum
  Clone ID: PAT_TA_3573.pep
MPAALSMVPACDAEEPLLAEPSPQSLAVKSFPPRGQRRRRRRIPKMPAALSMVPACDAEEPLLAESSDRFSMFPIRFPQIWEFYKKAVASFWTAEEVDLSSDARHWDTTLSNDERHFISHVLAFFAASDGIVLENLASRFMSDVQVAEARAFYGFQIAIENIHSEMYSLLIETYIRDDVEKDRLFRAIDTIPSVRNRGLMAVRWIDDGEISRDDGLHCDFACLLYDILRGKLDESRVFEIVSEAVDIEREFVSDAPPCAPAGTTGALMTHYIEFGADRPSTAPACKTLSTTASPSASLDPTSPSAKTNFSGTRASRSWPTSCTSSRNAGAATPPAFSSAGEFSSGR

SEQ ID NO: 109156 - protein, 131 aa, Triticum aestivum
  Clone ID: PAT_TA_3574.pep
VLLRSCFQLICIYMQNTLYTSASRRMHTATFITYPPRWLPRFGSGTCCATSCLLSSRCCIALASERSSSFIRSSRRTLSRRSISSCFRYSSSIGSSCQSKNSHPPSLPWRTCSTSSLDCRRSRKSTWPLSA

SEQ ID NO: 109157 - protein, 218 aa, Triticum aestivum
  Clone ID: PAT_TA_3575.pep
MAAVVSDLVDFLNASPTAFHAVDEAKRLLKAAGFEQLSEREEWSGLQPGRKYFFTRNHSAIVAFAIGAKYVAGNGFHIIGAHTDSPCLKLKPVTKITKGGYLEVGVQTYGGGLWYTWFDRDLTIAGRVLVREKKDGVVSYGHKLVRVQEPIMRIPTLAIHLDRTISSEGLKINNQNHLVPVLGTLIKHEMQKLVEGNVPGESFRCRKHKAPSTIVAVD

SEQ ID NO: 109158 - protein, 205 aa, Triticum aestivum
  Clone ID: PAT_TA_3576.pep
VSLSCTHSMEMEGKRSVILLLVLGAVLVLGTLLPQVQAEAAADPGDDDDDDHRKVCCHDKEASYCFSFCTHGSSTPKLRTWCADNCCCVLTMDSTCPPRCTSSSLTFTNHAAVPSGLLPPAQAEAAATGGDRKKICCHDEDESLCLSGCLEQHGSGDAARTSCARDCCCVFTWSATCPRRCKSSNLLLTNTVIVDGSEDTRGGAA

SEQ ID NO: 109159 - protein, 251 aa, Triticum aestivum
  unsure (1)..(251): unsure at all Xaa locations
  Clone ID: PAT_TA_3577.pep
MLSRLLPRRHHRRLLQTLQPAAAAAGELHQRLCATAAASSPSLSIWRRKKEMGKEGLMAVAQLKRLAALPPAGGHQRLVEYMKLHVSRLLRTDLLAVLAELLRQDHVILSMKIYGVVRKEIWYRPDMYFYRDMLHMLARNKKVDETRQVWADLKSEGVLFDQHTYGDIVRVFCDAGLIDLAMEFYEDMRSSPEPPMSLPFRVILKGLIPYPELREKIKQDFLELFPDMIVYDPPDSLSDIDXNSNLTRYKY

SEQ ID NO: 109160 - protein, 212 aa, Triticum aestivum
  unsure (1)..(212): unsure at all Xaa locations
  Clone ID: PAT_TA_3578.pep
MEVRTVKVGNISLSASKREITEFFSFSGDIEYVEMQSETDWSQLAYVTFKDSQGADTAVLLSGATIVDLSVIITPGENYQLPPEAHKQLPGENSPSAESAVRKAEDVVSSMMAKGFVLSKDALNMARSFDERHNIMCTATATGVSLDHQYRLSEKINLGRXAVVASKVKEVDERYQVSELTRSALAAAEQKANVAXSALMGNQYVSPGLSAD

SEQ ID NO: 109161 - protein, 655 aa, Triticum aestivum
  unsure (1)..(655): unsure at all Xaa locations
  Clone ID: PAT_TA_3579.pep
KADRTVNEPKQSGIVSRGGSLPGQTSTADWAQEAESSYWPTQPALGAEQRLDNKNWWSQPPHPAQFADSRLQRTSSSPQQDAQYNPIEPILGPRPSPLQRMSSYPHQEPQYNNIELIRGNGSRFTPALMQHPNGFMPHQMPPPHQQNGMLPIQHSPPQFSQLHAQMRAAQHSPPQNLPMFGPRHPSPQMMGRFDPNFVMPDLSDPRARSMLHHGRHGPRYPPQGFEPGNMRMDNRWQRFRSKYMSTEEIENIARMQKAATQITDPYIDDYYHQACLARKSAGAQLKHYFCPTLIRDTSSRARSKDEPHAYLQVDALGRLPFSSIRRPRPLLDVEEASEPSDSTTEKSASKSLDQEPMLAARITIEDGLCLLLDVEDIDRLLHFSKQPDGGLQLRNRRQALLEQLAESLQLVDPLTSNKDAPLSQNDDLVFLRIVSLPKGRKLLSRYIDLVTSGSELARIVCMAVFRNLRFIFGNLPSDSSIAGTTTKLVTAVSTCVVRMDLSGLSACLAAVACSSXQPPLRPLGYAAGDGASVIIKSLLDRATELLTDNRAPSAHSMQNRTLWQASFDAFFGLLMGYGMSKFDTVVHTVQIQPAAAAVISRETPVELLRASLPHTNEYQRKQLLSFAQRTVPVNSSSSHGSGNVPMASEYVHELK

SEQ ID NO: 109162 - protein, 105 aa, Triticum aestivum
  Clone ID: PAT_TA_3580.pep
DRHSKCPAGSTCCCTHGVRKTCFVWGCCPAKGAICCKDGPTCCPSDYPVCNAENRTCSKSKNSPYTVEALIRTGQAKQDNDPYTTGRFSVLRIGRLASGSFLIIF

SEQ ID NO: 109163 - protein, 196 aa, Triticum aestivum
  Clone ID: PAT_TA_3581.pep
IFCTNKRFEVVVELEQVVGDDIQERSDGHALGEPRRPGRRASDGLCRRHVDRRETRRAGCGPEARRWRAPPGRRARGPAAAAAGGQQAQIHGVPAHVHPRRAHRQHLGPASSLARRPIQEPRLQRSRPAQALGAPKNRKITGASSPCMTAAGEGVTLAGWLAGWLAIGCVRERENLAQFGDDALLRCVEKKRGGET

SEQ ID NO: 109164 - protein, 113 aa, Triticum aestivum
  Clone ID: PAT_TA_3582.pep
CGGYDSRSVVSSISMSMSKGPPLTRSTELNSTPCCSKETTAPDTCWRQPAAVSTCAASDTSAGESGLQAGCRRCHSHQLSTAPCCCYSVSGYQSDDYSARSVFVVPVYFTSSN

SEQ ID NO: 109165 - protein, 161 aa, Triticum aestivum
  Clone ID: PAT_TA_3583.pep
MSVADAAAAADKGKEKVEEPVPPARAAGGGNGRFMAYPARMAEHKSVVADAALFRAELEKLHAHMGTKLKVPIIGGKDLDLHQLFKEVTSRGGIDKVKAENRWREVTASFIFPATATNASFMLKKYYMSLLYHFEQLYFFGGQGWYQQESDPDHCLHRSES

SEQ ID NO: 109166 - protein, 290 aa, Triticum aestivum
  Clone ID: PAT_TA_3584.pep
MMSGGGYSALDDPKASGSVPAATGPDPQTIKFTESNLQTFPPSEAKGKISGAYRPPTDSDDTFSSKVGGGGGGRGSDGGSDDAAQGGWFRMFSVAAYKPYFDVDTSDVVERIWESVFPFRGNFTEKTSDKPDLYGPFWTCTTLIFVAASIATFVTYLSHKWHKKEWTYDINLVTWSAGLFYGYVTFVPLGLYVILKYFSAPAGLVQLWCLYGYSLFIFIPASLLSIVPIEIFRWVIAGVAGFMSATFVAVNLRAHILNSGERWFLIVAGIFLLQLGLAVLLKLYFFTITV

SEQ ID NO: 109167 - protein, 159 aa, Triticum aestivum
  Clone ID: PAT_TA_3585.pep
STHGDADDWLGLEVALRQRDGSALRRTRMAQRALMRGVRGHGEMNRWLKHQREEILDQGRKVQFFLHWIKRSATSLAAPASTRPGRSAAHPRDATARAPTATRMNGWGWKRHSGNATAAPSGARAWRSAPSSAASSVTRQKGGVHPTATTRANDSPTQR

SEQ ID NO: 109168 - protein, 138 aa, Triticum aestivum
  Clone ID: PAT_TA_3586.pep
FFFFFEKTCRSYKKDPVFFIFNKVVIGERSELDVETAAMQTTPGTAAAISGQIRPRRRGGGRILLQVRRGGDLGGAGGGPAAGFELQVHGGGVPRRFRSTWRAPTGSLHGDGGAAPVRETEVRGTERKEERQGETHLH

SEQ ID NO: 109169 - protein, 288 aa, Triticum aestivum
  unsure (1)..(288): unsure at all Xaa locations
  Clone ID: PAT_TA_3587.pep
TRALSFPCSRSGSGHGRLLPPQRQIAGEGHHAPCPSTHVRGNHGRVLHARADLTRKEETMERGSCRCRAPTVLRQGKGTHAGDGVPPRATGEWWSWSLATVELQAARGKAATGKRRSWNRPEKELETLFFLLEKAYSELRRWNNTLFCWKRCFFLLEASLWIATVDASRRAAELHICNGDKRKATTDEGKSYNQCFFLVTDVWFSFTGTYDLWWRTAAPATRRSPPGATLVVVPSPVRSACPIRGLVWLRPCLPXGXXNGKXWNKPXPXXGLGFFLXXXLTXWKNGXP

SEQ ID NO: 109170 - protein, 185 aa, Triticum aestivum
  Clone ID: PAT_TA_3588.pep
SGVIVELSSLIPTLVFVVILEDASIASWPENVYNALALNFMTLIARNCGGAIEARRASVDLVVPRVGGVLWRSPRRPALSQCRDRGGFGGGYADYSSVDTVRSLVQRRLGVAQSLVVRRYGSLGRDRGASRHEPRAPRPRRARRSGWAAARGTERRCGCRRSRGGALEGRGGGGVGVARGRVVRR

SEQ ID NO: 109171 - protein, 142 aa, Triticum aestivum
  Clone ID: PAT_TA_3589.pep
HPSHFPSKMVSHRSFSMANPFKGAADNIVPMALLLSPRAFCSIYLLPSERVVQGQSSRQTEQYHHKYEAEPLVAPDDYPCHLKIQATPLILFSNHALKTGVSLIFLHYPAEGNTKQKLLDRQNEASPLPYLDARHASIGKCR

SEQ ID NO: 109172 - protein, 91 aa, Triticum aestivum
  unsure (1)..(91): unsure at all Xaa locations
  Clone ID: PAT_TA_3590.pep
SARGLQTQANRTFHPSRSRRRRPTPPPPRRRCRPSGGAPARARCSRCRAPNPPPPPRSATPXPQAPFPSPPPLALPPLLTPSPHLRAASPI

SEQ ID NO: 109173 - protein, 149 aa, Triticum aestivum
  Clone ID: PAT_TA_3591.pep
LAFIREAHRAASERVDMEAAAAKGVTNVEKVEDAPQDLALERYKVFLKQYKEWVDTNRDRLEEESYKFDQDYYPGRRKRGKDYREDMLELPFFYPGQICYGKVISIHLHQGAFVDIGGTHDGWVPIKGNDWYWIRHHIKPGMNVYVEIL

SEQ ID NO: 109174 - protein, 163 aa, Triticum aestivum
  Clone ID: PAT_TA_3592.pep
VGVEAAGPVCCNRPRRAAARPGQRPGRAPPMHLLSSGRRATCSDEAELQVATGHQRICEPQRDMLQPASAEAGTAWWLAATGGVERAATTPMMLEPASFFAGTGGRRCYYHDSKMLEPTAAASGRFFFCFKQPLILLEPLIFFAGTCDFHVCEYRSIFFVLGS

SEQ ID NO: 109175 - protein, 64 aa, Triticum aestivum
  Clone ID: PAT_TA_3593.pep
NSTSNSGPVGECPVCLEPLSVGGGDMKAAHVCGHVFHSRCIERWLRHRNSCPVCRCTVTCSHNP

SEQ ID NO: 109176 - protein, 289 aa, Triticum aestivum
  Clone ID: PAT_TA_3594.pep
MGSVRASPSEAGGWAVAAAGKEGVEMERLVAVAQSAADAAGEVLRKYFRQRFEIIDKEDHSPVTIADREAEEAMTSVILKSFPTHAVFGEENGWRCAEKSADYVWVLDPIDGTKSFITGKPLFGTLIALLHNGKPVMGIIDQPILRERWVGVDGKKTTLNGQEISVRPCNVLEQAYLYTTSPHLFEGDAEDAFIRVRDKVKVPLYGCDCYAYALLASGFVDLVVESGLKPYDFLSLVPVIEGAGGSITDWEGNKLHWLVSSESRPTSFNVVAAGDSRVHGQALAALRWR

SEQ ID NO: 109177 - protein, 266 aa, Triticum aestivum
  unsure (1)..(266): unsure at all Xaa locations
  Clone ID: PAT_TA_3595.pep
ASSVGKRSYTEGFYEIRESMASMGRPSDCSVIFVGHGGARAAEFVKQNLSINLIKHPKFLTHPKAATAETFTPTDSELPKADTTHNRVAASTASTAILVGGRLVVVNVXGDSRAVICRXGDAIAVSRGHKPDQTDERQRIEDAGGFVMWAGTWRVGGVLAVSRAFGDKLLKQYVVADPEIKEEVVDSSLEFLILASDGLWDVVSNEEAVAMVKPIVDSQEAAKKLLVEATRRGSADNITCVVVRFLDQQPPAAATNGSPAPAAASK

SEQ ID NO: 109178 - protein, 124 aa, Triticum aestivum
  Clone ID: PAT_TA_3596.pep
RCLACLCAVTLISASGQTFYAPNGFAADMTSKPGVQSAVCRNCGGGGAIICDMCGGTGKWKALNRKRANDVYEFTECPNCYGRGKLVCPICLGTGVPNNKGLLRRPGAKELLDKMYNGKLLPSS

SEQ ID NO: 109179 - protein, 201 aa, Triticum aestivum
  Clone ID: PAT_TA_3597.pep
APAPPAPPPPPPRPACAPCPLAAPCFFYFSPKPCLSFAPRCSSSSSSPPAPGGKGKGKALREDWREKSKPIPPGGVYPAKDKCSRCGLCDTYYIAHVNNACAFLGDGMSRVEDLEPVVHGRGRKDTMDEMYYGVHEQLLYARKTEPVQGAQWTGIVTTIAVEMLKSNMVDAVVCVQRHPRQESDTKSSSFLCNNSTKNSWT

SEQ ID NO: 109180 - protein, 267 aa, Triticum aestivum
  Clone ID: PAT_TA_3598.pep
MALASTSPLAATAARPKTSAPLTLCRSGRLQRISCQATTDRPRGGNASNTSPAPPRWRVAVSAALAAAVVVAMPAHADLNKYEADQRGEFGIGSAAQFGNADLKNTVHVNENFRRANFTSADMRESDFSGSTFNGAYMEKAVAFRANFTGADLSDTLMDRMVLNEANLTNAVLSRTVLTRSDLGGATIEGADFSDAVIDLPQKLALCKYASGTNPITGVSTRKSLGCGNSRRNAYGSPSSPLLSAPPPKLLDRDGFCDEASGLCDAK

SEQ ID NO: 109181 - protein, 96 aa, Triticum aestivum
  Clone ID: PAT_TA_3599.pep
ALPEAFVGRAEKLRAVVAAMCAAAKRCARESSLHMAPWRKRRYMEAKWLGTPDRLSPTAGAGSPVAAGSPESEKQRRFRASMLTLDYGGRTAVEVA

SEQ ID NO: 109182 - protein, 178 aa, Triticum aestivum
  unsure (1)..(178): unsure at all Xaa locations
  Clone ID: PAT_TA_3600.pep
CWLLASASQRXARVRTLELGDDRRVRNMYLRVSSPWIAIPVKPLLYSQYLNESASCFVSTKTNVRVCSGLLFSAESWWSGRRTWPSSSSSSSGWSVWSRWSTSIELKRRRGPADLVRGVDVAGEVELGCPAGHGPCPLLIRRLLRQIFRWRGTCAAWEEEGGPCRRSMAQVVSSRGAP

SEQ ID NO: 109183 - protein, 850 aa, Triticum aestivum
  Clone ID: PAT_TA_3601.pep
MRGGGRGGGGGAGGGRGQRRQQARGAAAAAAGDGAEIPQASRKLVQGLKGILADRTEAEIYATLLDCAMDPDVAVERLISQDPFHEVRRKRSNKKEVKAPQETRSRPFYKPAYRGSKVGSDRGGRVYSGPGDSTASAKGPIKKETELLPPPNTSTSDAVKDSNPMETISEAGNLADAKSTSFQPPQVQHGWGGVPGRPSLAEIVKMGRPQAKSGARPVANNAAKPAVGGSVAANANLNTVLPSEGDRVTAEKLPNGTIQSPSVPKEDSVGILPPGQGSDVPEGIGAASANVSAPRSFTLEVKNDDAGDANEQSTRPRGSNATGLTSPGPLSPSDKGTILNNDLIEKTDVYLSDEHSFEHNQNSNGDMSTTAYELEHLTIHEENRPKPSDDNPAVIIPGHLQVSNADFAHLTFGSFVSGTLDAPCSMMPANSDVEVAAVPDNPSRAPGDASIHEFENKETVTPAANEYIASAPDSNAENPDITSAQQSDVGRADLLDVTNNTEYNLSSDYATSSAVQPEPTVQTYLQDNRQMQNISPLSNFMQGNMPNGLLPPAMPPFRELDPAFSLLLTNPPLATMVHGTPQSSVNNATVSSQPQENVNQGGLSNPQLTHSQGSTGIAPGPPLPHHLAALHPYAQGGLPLGYANMIGYPSLPQSYAYLPPAAYQQAYMNSGLFHQGAAAAPNSGVKYPMPQYKSNVPLGSLPQPASMLSNYVGGFGTANGMPQNFALNQSNPSATTAPGFDGAMPSQYKDGNPYMSLQQGENPAMWMHGAGSRGMPPLAANPLYGYQGQQGYQGQQGHQGGLRQGQMPSQYGAALGQSQPGLGPEHRNPSDGNLSAAAAAQANQMWPNGY

SEQ ID NO: 109184 - protein, 126 aa, Triticum aestivum
  unsure (1)..(126): unsure at all Xaa locations
  Clone ID: PAT_TA_3602.pep
NMARRSFKISTYGRRVFAIRELHGLGPGRNEILAFQPPDLFLNPPGSRRWMKMEKFFREKGWGGRSRAWGIEAGRRSARGGVPDPSSPSSIGAYSRPPERXPGAASAGAIESPPCRQSIRANEQGA

SEQ ID NO: 109185 - protein, 67 aa, Triticum aestivum
  Clone ID: PAT_TA_3603.pep
PPSAASPRPQPLPTSPPSTSSTSPEPPARMSSRPTSPYTGPAPPHPAAARDPLPRPPPRAATLSQQV

SEQ ID NO: 109186 - protein, 109 aa, Triticum aestivum
  Clone ID: PAT_TA_3604.pep
EAPRTSRKNKNGRMEKSKATGGGFFLSIQAEVNLVAWWNYGSQPAKDPAGPMRWNSTRRVVRLRLKRDLERARSHRAQPIQLVHAHEGPCRSVQQDGHHPQQRHRRREH

SEQ ID NO: 109187 - protein, 148 aa, Triticum aestivum
  Clone ID: PAT_TA_3605.pep
ATMEVDIKKRGGRGSSYRTIHVRPWSLISAATRRGFRCRSEPSAILILCCCISWSKGGFSEFRQWRPAPLFPPSRRAKMGGSLVGCFDLVFPLSTSLSFIGGVVAIPPPPSGLLPGASGIWARNEADNKDSIAFQFCLLGSYLQSVWD

SEQ ID NO: 109188 - protein, 260 aa, Triticum aestivum
  Clone ID: PAT_TA_3606.pep
SDEPPLSLALSGGSAARREDGLSGWLPLVHSSISIARSRSCFASAASGDMPLSCSPPARASRARWSPAASSTCCPWRTEATGGGSGASFPSRTSSCSPLIWRKPSCRRSLLQAAAVVGEGGRRRRLLHSADRVRAHQRRTLWWSYDAGRLPVFIFLSLLQAKGRPTFFLPACVPNGRQIQLLLGGHGGQEMRPWRLRRPKWFVPGGGDVGSEQKLEKDPIAFLFSIWGPPCKSQGLSCLCYVSYGSLGKMYCRTAIVMQY

SEQ ID NO: 109189 - protein, 113 aa, Triticum aestivum
  Clone ID: PAT_TA_3607.pep
HHGRHLQLSSTSPMVGEAMRHWLWMWTCRRSFSPTTTNYSTSTKRGRSVQHRAIHHLHPTVCRGTAPRLRGTTVVRPLSPAPGLLLLGLGPPAVSSLARREVTVCINPVLFCS

SEQ ID NO: 109190 - protein, 72 aa, Triticum aestivum
  Clone ID: PAT_TA_3608.pep
HNGCCPACVVKRNFVNLQAPQIRLELKIEVHTVNTDYLIFLHVWFTPDVQSWLQDYYCLHCCVWRISGIVNI

SEQ ID NO: 109191 - protein, 144 aa, Triticum aestivum
  Clone ID: PAT_TA_3609.pep
AMGHPIQSRSDQLSSQQVFASGFITVQTTKLQTSRSKSTMYTYCLLKSKKIEIAQHFHRCGRQSTPLGNVQLILTRLTIQLTQTKPLLNTENPYRGSRNDSSTIHQTVQEKTALPCHVRRKQAHEEGQDDHGTSGSRLIQRTRG

SEQ ID NO: 109192 - protein, 312 aa, Triticum aestivum
  Clone ID: PAT_TA_3610.pep
MADIQLGCYTIKSHGAKVARLHMYDWIILLLLAVIDGLLNIIEPFHRFIGKDMMTDLRYPLKGNTVPFWAVPLIGIVLPCVIFGGIYFKKKNIYDLHHGILGILYSVLITAVITDAIKDGVGRPRPDFFWRCFPDGKDLYDNVTTGVLCHGEKSVIKEGHKSFPSGHSSWSFAGLGFLTWYLTGKIAVFDRKGHIAKLCIIVLPLLTAALVAVSRVDDYWHHWQDVVAGAVLGLTVASFCYLQFFPYPYDADGLWPHAYTLQLAEARNSGIANSFSVRPPTETEEGEGQGGIALRDTSPILDTMESGRRYGN

SEQ ID NO: 109193 - protein, 169 aa, Triticum aestivum
  Clone ID: PAT_TA_3611.pep
KKKNQLADYHPALEWVLMTVRAYLFGRGPTCRYVAVGNEPFLSSLNGTFLNVTLPALQNIQKALDEAGVGDTVKATVPLNADVYQSPKDNPVPSAGRFRPEISGLMTEIVQFLNQSGAPFTVNIYPYLSLYGNDDFPLDFAFFDGASSPVVDGNIQYTNVFDANFDTLV

SEQ ID NO: 109194 - protein, 431 aa, Triticum aestivum
  Clone ID: PAT_TA_3612.pep
MSWWFLDRGGGRFVGWPAMSVSSSSMCGGDAGMKCVVWFRRDLRVEDNPALAAAARTAGEVVPAYVWSPEEDGPYFPGRVSRWWLSQSLKHLEASLHRLGAAKLVTRRSPDSVAALLQLVRDTGATHLFFNHLYDPISLVRDHRLKEMMTAEGIVVQSFNADLLYDPWEVNDDKGQPFNMFMPFWNRCLSMPYDPPAPLLPPKRINSGDLSMCPSDDLIFEDESERGSNALLARAWSPGWQNADKALSAFLNGPLIDYSVNRKKADSANTSLLSPYLHFGELSVRKVFHLVRMKQLVWSNEGNHAAEESCTLFLRSVGLREYSRYLCFNHPCSHEKPLLAHLRFFPWVVDESTFKFWRQGRTGYPLVDAGMRELWATGWLHDRIRVVVSSFFVKVLQLPWRWGMKYFWDTLLDADLESDALGWQYLGRDHA

SEQ ID NO: 109195 - protein, 137 aa, Triticum aestivum
  Clone ID: PAT_TA_3613.pep
GFGILLLELITGQTARVFGWPSRQRGAGRLWLKKMHQEKKLDVLVDKGLRSSYDRIELEEMVQVALLCTQYLPGHRPRMSEVVRMLEGDGLAERWQASQRADSHKFTVPEFTFSRCYSDLTDDSSLLVQAVELSGPR

SEQ ID NO: 109196 - protein, 88 aa, Triticum aestivum
  Clone ID: PAT_TA_3614.pep
PTSSPKYPEKPQSQIDSDHNHHACIKHMTQIEHLKDTHSKHLGPEKNKINMKELYQMKSQIDESLHQTRAERKQFIDTSYAELTRHPE

SEQ ID NO: 109197 - protein, 78 aa, Triticum aestivum
  Clone ID: PAT_TA_3615.pep
PRPGLRRRQRRLVFDRRYGGIFDEWTDPAVAALSGGRGMSCVLPLAQSLLPAAASSRHSAAESVSTTLKPPGRCSLRA

SEQ ID NO: 109198 - protein, 187 aa, Triticum aestivum
  unsure (1)..(187): unsure at all Xaa locations
  Clone ID: PAT_TA_3616.pep
FFFFFFFCRVDSRRIKKCIQNTHENVYQHSIYLANEPVPTQTQRVKRIQTKRNARKEKLVRRQLGPGHGVLHPIVPLSLPVVARRVATRAGEPATPTGVAHPTRAHRVPPRQAPVRPRARSQREHREATAKQQGAPRDDGHHCHRRPERAGEEQERGEDDEDDEHDXRDGERDAGEDQEGGQGDGEG

SEQ ID NO: 109199 - protein, 369 aa, Triticum aestivum
  unsure (1)..(369): unsure at all Xaa locations
  Clone ID: PAT_TA_3617.pep
MPPHSTPKRGRRDEHPHPVRFPFVHSCCRCCSRPPPPPPPPTRGGRPWMEIARSAAAVGCSKEHQRIYADWFAIADPDGDGRVTGADATKFFAMSGLSRADLKQVWAIADSKRQGYLGFGEFAAAMQLVSLAQAGNEITQDSLKREDLSSFDPPVMKGLDELLARSMAIVNVVRPQENGTPQVQAPSTNSWFSSKSAKKIQTPLTAVTSVIDGLKRLYIEKLKPLEVAYRFNDFASPLLTNSDFDAKPMVMLLGQYSTGKTTFIKHLLKSNFPGAHIGPEPPRVRFVVVMSGSDERTVPGNTIAVQADMPFNGLTTFXGAFLSKFECSQMPHXLLDHITFVDTSGVLSGEKXRTQRSYDFTGVTXSWFA

SEQ ID NO: 109200 - protein, 69 aa, Triticum aestivum
  unsure (1)..(69): unsure at all Xaa locations
  Clone ID: PAT_TA_3618.pep
VRGKVSFKDLVEVLRDLTGSSMXEKQRERVLTKVLEEAGYTRDSTLSLEDFVTIIDHPGLKMEVEVPID

SEQ ID NO: 109201 - protein, 133 aa, Triticum aestivum
  unsure (1)..(133): unsure at all Xaa locations
  Clone ID: PAT_TA_3619.pep
LLDAAEHLCHHPDPVLQPLAVVPHERPSRGGEHAGDLYHEQEQQHHLGHVRRRRHCRRLGKIAPVKRKTEPNRDTGWSALSVFELEVRFCACMQQCLAEELRLFPPARPLSERNFFFFFFFFFFFFFXXXIFP

SEQ ID NO: 109202 - protein, 119 aa, Triticum aestivum
  Clone ID: PAT_TA_3620.pep
HGQGGVAALARDTDLQRARRRGEAVRGGRWPVVAERDRNGDTDARRRQAVRVQRPHALLLTCSHSLYCVGIGILVKNCSLVHLGSTNLEDEQYSPALPLFLRCFCVRGGVQDLRFRTFF

SEQ ID NO: 109203 - protein, 170 aa, Triticum aestivum
  unsure (1)..(170): unsure at all Xaa locations
  Clone ID: PAT_TA_3621.pep
REYDIEDVQPQCSSPFSQQAIVPLYERFCQLDRSAMCFVDEDEFLSIPEYSTNPLSRVLRXRVSGXNCKEFVCFLSTISARASLQXKIEFIFKVYDIDTKGKVSFKDLVEDLRDLTGSSKSEKIXEQVLTKVLEEAGYTRESTSIGRMMNYEHRNTPGLQESRIASAQPD

SEQ ID NO: 109204 - protein, 137 aa, Triticum aestivum
  Clone ID: PAT_TA_3622.pep
LCPAAEERLHGEHSVTLFSVCMLLHGGPLFMRGRRTRISSRQECVCLLMPNKLPPDGASARTACTIGATSLLLFVPQEHLIMDACLVCSGFFTILFCPRAIKHCICFYCDMQLFKNGNYILELLICMEFLCILVVYF

SEQ ID NO: 109205 - protein, 164 aa, Triticum aestivum
  unsure (1)..(164): unsure at all Xaa locations
  Clone ID: PAT_TA_3623.pep
MPEDVEMNDSAQPAPVAAPAAADAPAPAPALSTLQHLKEIASVVEAGSLTKEVRRISRAVRLTVALRRRLAAPDVAAFLAFALPASSEAFTRLFXFFPKEDGSEMDVDAAAPAAQVSIKHGLPEIEIYCYLLGVDFLYDHKKYDEAKACANSSIARLRISTEDW

SEQ ID NO: 109206 - protein, 166 aa, Triticum aestivum
  Clone ID: PAT_TA_3624.pep
ALNTILQINQLIKDLPPEDRGEKSRSFGSLLAFSSSTRKCVDRSVPRRRGGVLRRGGHAAAGVGVGLGFRVVHHRRHHPAALLLLLQPDAAEGRAPPPHRPHHLHLPALHHHHRPLREGKREESRDEDDGEKSWSGHSGRTGPEWSGVEMGSAVFLGYGRMARGSR

SEQ ID NO: 109207 - protein, 171 aa, Triticum aestivum
  unsure (1)..(171): unsure at all Xaa locations
  Clone ID: PAT_TA_3625.pep
ILLTYASSCCHXEAHYGHGRVQRPRVMHPTYRVVRGLVSLWLRVAASTASAPRMRWPQDGVVHGVVRSTAAANPPLGHGWDPTDGKGCMRLLPLAELTTHHAGDRSRSSAGSHRGHQQELGEADVAEQDSSAVELHGGTCEPDRRGVAYGGWLGAEVRRRMTPAADGTWAG

SEQ ID NO: 109208 - protein, 306 aa, Triticum aestivum
  unsure (1)..(306): unsure at all Xaa locations
  Clone ID: PAT_TA_3626.pep
MAFSVAKISASFSVFMALAFLLRPCASVEIHRKLSGWSNGGATWYGGPNGAGSDGGACGYQDAVDRPSFSSMIAAGSPSIYQDGKGCGSCYQVKCTGHGSCSSSPVTVVLTDFCPDGTCQEEPVHFDLSGTAFGGMAKPGQADQLRAAGRLQIQYTRVPCSWPGMDIAFKVDAGXSNSYYLAMLIEYEDGDGDLSSVELMQSGGNGAGWTKMDRSWGAVWRYSXGSRRQAPSSLRLTSSSGQPRVASNPLPAGWPPGGTHRPVATTDKPRRGLGCTQARRALAPYEEAWRHPDLCLEPWAWYMCVT

SEQ ID NO: 109209 - protein, 332 aa, Triticum aestivum
  unsure (1)..(332): unsure at all Xaa locations
  Clone ID: PAT_TA_3627.pep
TNGFLITGGQFLSYLINLAFTKAPGTWRWMLGVAGLPAVFQFVLMXXLPESPRWLYRKGRVEEAXAILRKIYMAEEEVTREMQELKESVEAEARERGSSERVSLTALVKTPTVRRALVAGVGLQVFQQLVGINTVMYYSPSIVQLAGFASNQTALALSLVTSGLNALGSIVSIYFIDRTGRRKLLVISLVGVIASLALLSAVFHQXTTHSPAVXSAETRHFDGSLTCPGYRTSSSGWDCTRCLKAXSSTGCGFCASGAGKQXLPGACLLSNATVRDACHGEGRLWYTRGCPSRYGWLAMSGLALYIAFFSPGKWGTVXWIVNSKDTAGNRGC

SEQ ID NO: 109210 - protein, 322 aa, Triticum aestivum
  unsure (1)..(322): unsure at all Xaa locations
  Clone ID: PAT_TA_3628.pep
MNVAGPATAFVPSARPAPRAPRPLWGRPSARCNPSPRAATEPPAAAPVYAPTPRDRPLRTPHSGYHYDGTARAFFEGWYFKVSIPECRQSFCFMYSVENPFFRDGMTALDRTLYGPQFTGVGAQILGADDKYICQFSEKSNNFWGSRHELILGNTFIPNKGSTPPEREIPPQEFSNRVLEGYQVTPTWHQGFIRDDGRSKYVPNVQTARWEYSTRPVYGWGDVTSKQKSTAGWLAAFPFFEPHWQICMGXGLSTGWDRMGWEKRFGFENAPSYSERRLGVGGSPKEXGTGWCWPPKGPGLVLVPCSRPAWVGFGKLGLNTLK

SEQ ID NO: 109211 - protein, 208 aa, Triticum aestivum
  Clone ID: PAT_TA_3629.pep
PNSQSPPQRTETLIPMPITPPFGLLEPLKLVIDDGRSPSIPESTPVHIMVPVDARMAVLVSIDGSGNVTVSAPSWRIPIIRAGKFEATTSSGAGPLSFVDLHTDGRYSGIDFPVPAGAYRSIGEIIKATCSCLSRPCPSHYRHEDGPSALQQPSDSSPTTTFEDLEEAMFEAAPTFEATSSTCPQAQAVTPGSPMSPILRPIRHDWGL

SEQ ID NO: 109212 - protein, 200 aa, Triticum aestivum
  Clone ID: PAT_TA_3630.pep
PSVHSIFMFMSIKHLPISRVVPTERFIFRQVGPREHRMFRCVARYGYSDALEEPKEFAAARGDRLKMCIQEESAFALAQREEGAGEVSDAQARPGRSTVHSEEAVQGQARVSSHSASGRMSFHTNQAVEEEKQLIDREVERGMVYLMGEANVTAEAKSSILKKVVVNHVYTFLRKNLTEGHKVLAIPKDQLLKVGITYEI

SEQ ID NO: 109213 - protein, 97 aa, Triticum aestivum
  Clone ID: PAT_TA_3631.pep
IWQLHRRSTFSNPFLVPPTKPDRDPQLLCLLRRSGIPSAGSASSPRGSPFLVLNLITPYVDPPGLKISFLRRVVLLAVVICKLAMEDNNDEHNVSLP

SEQ ID NO: 109214 - protein, 147 aa, Triticum aestivum
  Clone ID: PAT_TA_3632.pep
SGSSEAIPSFPLYTIYAASKRYVAQFSRSLYVEYRSKGIDVQCQAPLLVQTKMTSIVAGPGKRRRGLLQRFLVPTSDEYARAAARWIGHGPLCMPNLGHRLQWRLCRVVPDRLLDAQRLRENLRQRAVFQRLRSPRAPSHANGGEQS

SEQ ID NO: 109215 - protein, 229 aa, Triticum aestivum
  unsure (1)..(229): unsure at all Xaa locations
  Clone ID: PAT_TA_3633.pep
STALLEMMICHLPSPLEAQKXRVENLYEGPLDDKYAEAIKKCDPEGPPRRYVSKXMVPASDVGRFFAFGRVFSGRIAAGMKVRVMGPSYVPGMETDLHVESVQRTIIWMGKKQCDVPDVPCGNTVGLIGLDACITKSATLTSEKEVVARPIRAMKLSVCPLMFVTINCKVPSESPKLVQGLKRLAMSDPVVLWSKVEPGTYTVAGVGELHLEICLKDLQEEFMDGVEVV

SEQ ID NO: 109216 - protein, 170 aa, Triticum aestivum
  unsure (1)..(170): unsure at all Xaa locations
  Clone ID: PAT_TA_3634.pep
MAETVDDKLAYFQAVTGISDPDLCTEILVANNWDLQLAVSSITGDPSSPEPSTYAPPPPPPLESDSIAYQPPAPAPQQQQQPGIAWRLVTLPFYVVSGGVGLVTGSIRLGVWVASGVLSRSLSLLGLAQRGGDRLLELPPSAAEAADFLAEFEHEFGAXXXPRXXAXXFA

SEQ ID NO: 109217 - protein, 317 aa, Triticum aestivum
  unsure (1)..(317): unsure at all Xaa locations
  Clone ID: PAT_TA_3635.pep
PTPEQLNRAASLLRPGSRPSTTPQLDQLLLETIELVQDPYHSSQTVYDSWVKPNASPKLQRLGPAGSPGAAFARPVGLPPACSTFADPPGSPLFPALYDDFVWVEKFADPGFRRHVAAASIWGIMALRLADEEIIPFDYMSYTTELEAYTKVVEKETEGTTVSCSPLYNSIRALKKAATKVNSERKDIQRELSSKQLSKDSMRIRGLNDRLMQAERAFTNREGXSSKPGYKHLIYGPSEQNDWDTASYPGIADAITTAKXTTPRRPWKLVQHXVHKVXXAVAQASAVLNGEPHMTGLSVTVSNGKTSTLFKAVHNHP

SEQ ID NO: 109218 - protein, 69 aa, Triticum aestivum
  Clone ID: PAT_TA_3636.pep
MADWAPVFVGLALFILLSPGLLFQIPGKGRIMDFGGFQTSGISMLIHAVIYFALITILLLAVRVQVFLG

SEQ ID NO: 109219 - protein, 196 aa, Triticum aestivum
  unsure (1)..(196): unsure at all Xaa locations
  Clone ID: PAT_TA_3637.pep
MLVPAGDTSQFIPSKEADIAILEEPEHLNWYHHGKRWTDKFNHVVGVVHTNCLEYIKREKNGAIQALGVKHINNLVARAYCHKVLRLSGATQDLARSMICNVHGVNPKFLEVGERIAAERESGEQSMSKGAYFLGKMVWAKGYRELIDFLRRQTDLTXSTGRXWNGEXSXKAITAXTGLNLLHKPKHPTFFMVQVF

SEQ ID NO: 109220 - protein, 408 aa, Triticum aestivum
  Clone ID: PAT_TA_3638.pep
LPIGQAGCGRRERAAPEKVWVPLVAFPASAQVVPEPLGVVLIFSCWNFPLGLSLEPLIGAIAAGNAVALKPSELAPATARFLEENIGEYLDATAVKVIQGGPAVGEQLMEHRWDKVLFTGCPRVARVVMAAAAKHLTPVALELGGKCPCIFDAVAGRRNLQTSVNRVIFAKWSSCAGQACIAIDYVLVEERFAPTLIKVLKSTLKRFIADQDQMARIVNGRHFQRLSNLLKDPAVAASILHGGGLDAKNLSIEPTILLNPPLDSGIMTEEIFGPLLPIITVKKIEDSIAFVRARPKPLAVYAFTDSAPLKRRIVEETSSGSVTFNDAVVQFGVDTLPFGGVGQSGFGQYHGKYSFEMFSHKKAVLRRGFLVEAMLRYPPWDEQKIAMMRHLFRYDYVRFIFTFLGLRR

SEQ ID NO: 109221 - protein, 187 aa, Triticum aestivum
  Clone ID: PAT_TA_3639.pep
MEEKPAIGLGSLVSSLRVVYKSGRTKDLSWRRSQLKGLIRLLTEKEEEIFDALHDDLGKHRTESFRDEVGVLVKSIKHTLQNLEKWAAPEKAPTPLVSFPATALVLPEPLGVVLIFSCWNLPIGQGVCVMCDIVYPHIRFTTRRGRCVGVEQFTHTPVFSHAQGLVCGHLPSRPHARLLSTRYTATA

SEQ ID NO: 109222 - protein, 487 aa, Triticum aestivum
  unsure (1)..(487): unsure at all Xaa locations
  Clone ID: PAT_TA_3640.pep
MPGEHGGEAGHWLGEPGEAACEWCTKTGRTKDLSWSRSLLKGLIRLLMVKEEEIFDALPDDLGKHRTDTFRDEEEVLVKSIEHTVQNVEQWAAPVKAQMPVVSLPTTALVLPHPRGAVLDFACWNLPVGRAPGPVRAAPLDVRPLLWQEKPPELGAPQHLAANIPRYLAAEAVKVVLGAAEVGQELMEHRWDKVLFTGGARVGRIIMTKAAKYLTPVALELGSKCPCIVDWLDSKRDSQVAVNRIIGAKWSTCAGQACIAIDYILVEEQFAPILIELLKSTLERLITKPEDMARILNERQFNRLSGLLEDHEVSRSIVHGGDVDPKDLXIEPTILLNPPLDSDVMTEEIFGPLLPIITVKKIEDSIEFVSSRPKPLAIYAFTTSEALKQRIVRETSSGSVTFNDAIVQYGLESIPFGGVGQSGFGQYHGKYSFEMFSHKKAVFRRSFLLEFMFRYPPWNDDSKLALLRHVFRYDYVSLFLALLGLRR

SEQ ID NO: 109223 - protein, 176 aa, Triticum aestivum
  unsure (1)..(176): unsure at all Xaa locations
  Clone ID: PAT_TA_3641.pep
MLVPPVAEEHHPVGGSSSPISSLDGGHVHFVAWSALNGAWDDVAAFLSHRFTGTMDPDVLVRFTWLGPEEDEWVDVCKCXECVLLIVCLKEGKEQARYFDAHVLQVQRRRHDVRGCRCRFLVCDDHDHSEEFVPLGHAGRRAAHHRARPPHEMMDVNTDKVTWGRGSHSIRSRRSV

SEQ ID NO: 109224 - protein, 337 aa, Triticum aestivum
  Clone ID: PAT_TA_3642.pep
FRRAAWGLLQLSSSGNPLQTSAFIVENIFAIAIGAISLILFAQLIGKMQTYLQSVSKRLEEWRLRQRDMEEWMRHHRLPPDLQERVQRFVQVKWLATRGVEEESILQALPADIRRDVQRHLCLDLVRRVPFFAEMDDQLLDAICERLVSFLCPEGTYISREGDPVSEMLFIIRGKLESSTTNGGRSNFFNSILLRPGEFAGEELLTWALLPKTNIHFPLSTTSAPRPPRGPAFALRAEDLKFVANQFRRLHSKKLQHTFRFYSHHWRTWGACFIQAAWRQHQRRKLSESLSRWESYSWWSEEHPAADKPKQEGTSRTAAEMHKFASASKRFPRRRHQ

SEQ ID NO: 109225 - protein, 153 aa, Triticum aestivum
  Clone ID: PAT_TA_3643.pep
MESARAPAGDVNLDLRLVHPMAAAAWRPHPQTPVAADRTFSCTYCRRKFYSSQALGGHQNAHKLERSLAKRSRELSAASQVAIASSSAASSPPPSDLISWYTPGGGDSGQAPGSAAAAAAVVSWIADGGRRRYVHRVHAAGNGEDDIDLSLKL

SEQ ID NO: 109226 - protein, 170 aa, Triticum aestivum
  Clone ID: PAT_TA_3644.pep
SRGCIPCTPIMHIYLTCHSENTSLGSYIAPKVGHLAVLLKRSALLTGSAFFTIAIRYRALLDRWILQKCAVSQGAPVQSTMMLRSCWQCRSLPVFVGIGVLMARLCSYITIQSPNNNRQVIRGIEANLQGDSIIEKNEFCNQQSVLPSLLGSKHDYVRLLLHFICSTAIF

SEQ ID NO: 109227 - protein, 103 aa, Triticum aestivum
  Clone ID: PAT_TA_3645.pep
GVAPRSTRGEHDPCLSKVPTSSVGWGVHGVHLLGPRFPGGGGYPVLQIRLPGLHGFGVRAVLGPVMPPGEPGAAEPQRPGDPRDHWRPQGVLEPADHEAEVLV

SEQ ID NO: 109228 - protein, 72 aa, Triticum aestivum
  Clone ID: PAT_TA_3646.pep
AVLSQSKTLSFWHLLLSLELQNPDHFIVDICKHSIELRFATCLVRHSRLPCRVKTFSRHMQLPILIARSWFM

SEQ ID NO: 109229 - protein, 122 aa, Triticum aestivum
  Clone ID: PAT_TA_3647.pep
TKRSITQSENWKGVGGDAPPRFFSTKMCVAAIMVLALSLSLQGTVAAGRLFPNSGWDGCPPGTSRKCTGPPAHCPCLPNLGPLDRQDMTAMPEKNSLVLSQLSYPGPQIRGCARGGGASSGN

SEQ ID NO: 109230 - protein, 42 aa, Triticum aestivum
  Clone ID: PAT_TA_3648.pep
TAETVISSHNSFYFILQTRDDARQFMKYLHPDLGVELPERSY

SEQ ID NO: 109231 - protein, 79 aa, Triticum aestivum
  Clone ID: PAT_TA_3649.pep
SLASVFPLWTHMRLRSWLVVEESIARINQRKDVDKSSRQRWRSSGELETMDPGLECSRDGGAQDGGRGGRPAGSDLCAP

SEQ ID NO: 109232 - protein, 295 aa, Triticum aestivum
  unsure (1)..(295): unsure at all Xaa locations
  Clone ID: PAT_TA_3650.pep
APRPSRRRGCSPGSASGCPGARGASPGGRAERGRASAGRPAGSPPLPPPGSAGLRPGWTPRPRAPPGAPRAPASRRGPAGPWRRAPPPDPRYALLAGHPTAWCGAFGLAEFVSDSHKGHRTHPCXGTLASLDPEYYMSQQLTEKSDVYSFGVVMLELIIARQPIEKGKYIVREAKRVFDAADAEFCGLRGMIDSRIINTNHLAAFSKFVQLAIRCVEEGAAARPSMSDVVKEIEMMLQNEGLSSASTSATDFDVTKTAPRHPYNDPLPKKDKDMSTDSFDDYSGGYSFQSKVQPK

SEQ ID NO: 109233 - protein, 475 aa, Triticum aestivum
  unsure (1)..(475): unsure at all Xaa locations
  Clone ID: PAT_TA_3651.pep
CQKTYILRWSGLVVAVVGGGLPGLAVACARLVQYVLCLPRKISLFFVGTFLSGRLYMQNAVPVSRVSTVTPATISFFRDIGAWEHILQQRHAFFGKMQVWDYTGLGYTRYNASDVCKEYLGCVVENKVLCNSLLLRLQEQKEDIKKMVYPTRLASLAFPSKSRNVGVAGLKPPSTEAEELRRSNLVKLDLSDGQTLYSKLVVGADGSKSNVRQIAGIKTTGWSYPQSAIICTVEHTAANDCXAWQRFLPSGPIALLPIGDNFSNIVWTMSPEEASRHKSMSPEDFVMSVNRALEFXGYGPHPNSSSLDHYVERLFSDFGGTAASTKECFEVPPRATGLISERMAFPLSLMHSHDYVSKRLALVGDAAHTVHPLAGQGVNLGFGDAAALAEVISEGVSVGADIGDLSLLNRYENDRKAANVAMAAVLDGFQKMYSVDFGPLNVLRAAAFHGAQYISPLKKNIISYAMGDRKSPLFS

SEQ ID NO: 109234 - protein, 396 aa, Triticum aestivum
  Clone ID: PAT_TA_3652.pep
GHRGVPLQEAYRRLLAEKLLNNRTRILAFRNKPPEPENVFAADTVSSHQATPAKQRRYIPQSAERTLDAPDLVDDYYLNLMDWGSSNVLSIALGDTMYLWDASSGSTSELVTVEEDNGPITSVSWAPYGRHLAIGLNSSDIQLWDTSSNRLLRTLKGVHESRVGSLAWNNNILTTGGMDGRIVNNDVRIRDHAVQTYQGHSQEVCGLKWSGSGQQLASGGNDNLLHIWDVSMASSMPSAGRNQWLHRLEDHMAAVKALAWCPFQSNLLATGGGGSDRCIKFWNTHTGACLNSVDTGSQVCSLLWNKNERELLSSHGFTQNQLTLWKYPSMVKMAELTGHTSRVLFMAQSPDGCTVASAAADETLRFWNVFGTPEVTKPAPKASQSGMFSSSFAHIR

SEQ ID NO: 109235 - protein, 308 aa, Triticum aestivum
  Clone ID: PAT_TA_3653.pep
SSMSSRSNSKRLSSDDNVASDGGLRRREFYLNGPSLDRASKRITERVLSPPNLKNSHKSKGSHQLHSEASGSNSRKGESNHGIHVSAGNDDLSTTQKPRKVKLKIGGISRTIPAKPNPAIPDSRSSAAKPTRPGDSSHRQKHGNQTEGAKDSNRLPSSQDKKTRKLRKIEDTLTPEQPAKVQREASSDPVRKSRRIAKKSNMDSELDEEYGLSTPENHGASNDNEGHIREPKNKGGSNPKKNASKKDRSRSTVYEGDNDFVTPQSNRDGKKRSRDSTDADEDNAEEELASDNELEAENKKQKAVTQLS

SEQ ID NO: 109236 - protein, 278 aa, Triticum aestivum
  unsure (1)..(278): unsure at all Xaa locations
  Clone ID: PAT_TA_3654.pep
MVWDSQDLRGRAEHNEEQLLAAMSVDPGRFPALNDLLLEVYAVLRPKPTDYEQRNALVDVFSKMATRIFGNDNGFPVVQAFGSFTMDLFTPKSDLDLSVNFSAEIEDQCPRKKKMKVVRKFAKVLYSLQRDGIYCGVLPVVSAKVPIVNVIDRGTGIECDVTVENKDGMTRSMIIKLISSLDERFQILSYLVKTWANIHGVNSPTAQTMSSMSIISLVAFHLQRXTRHPPILPAFSALLKGLSCYLFFFSCCIFLRRKDDEITILFWPLADGSDFASV

SEQ ID NO: 109237 - protein, 217 aa, Triticum aestivum
  Clone ID: PAT_TA_3655.pep
TPRGTGRGPTWRGSGRGPCGGAATSTPAAPPPAPCACRPTTACPARRAGGHTSVHTIRQGQILTPEQQADPGTYADCIHWCLPGVPDIWNSLLYTRIRSSPAPPAPPLPARLRAPAGAGLAVRPRPAAPPAPPRRLPPLLPPWPPRHLEPLPLRPDCCRASGVGSAKAATSVSVVVVRVVPRACTCTWALRIFFPSSLRVFYLCSLCQLINLLSSRE

SEQ ID NO: 109238 - protein, 113 aa, Triticum aestivum
  unsure (1)..(113): unsure at all Xaa locations
  Clone ID: PAT_TA_3656.pep
MRVKLELLMPLLAQYKTPAWATLVAGFFVLLALSLSMYLIFEHLSAYNNPEEQKFVLGVILMVPCYAIESYVSLVDPNITVYCGILREGYEALAMYCFGXRYITACLGGGRKN

SEQ ID NO: 109239 - protein, 189 aa, Triticum aestivum
  unsure (1)..(189): unsure at all Xaa locations
  Clone ID: PAT_TA_3657.pep
IVTGLQGQPPADHPHGYPFLASVRDNVLACAKHFVGDGGTDKGINEGNAGGSPEDLERIHTKPYPGXIAQGVATVMASYSQWNGEPLHASRHLLTDVLKGKLRFQGFVVSDWEGIDRLCEPRGSDYRYCVAQSVNAGMDMIMIPHRFEKFLEDLVFLVETGEISMSRIDDAVERILRVKFISGVFEHPF

SEQ ID NO: 109240 - protein, 98 aa, Triticum aestivum
  Clone ID: PAT_TA_3658.pep
MAASMITSPIVAPTSVPSLSRRGSSFAVVCSGGKKIKVDKPLGLGGGLTVDIDANGRKVGKKGVYQFVDKYGANVDGYSPIYTPEEWSESGDRYAGGE

SEQ ID NO: 109241 - protein, 148 aa, Triticum aestivum
  unsure (1)..(148): unsure at all Xaa locations
  Clone ID: PAT_TA_3659.pep
MRGPPTLGRGAGSPRCLEVSITLETSETINPRVIHPSRRVSPTITKVLPVQLEVVAVLHLTRFLFSIPIDGPMSFATSKVSVQWSLRFEFFTTPAGMDSSRYEHPLLVEXREVGDSILPLTVYAPPLRRRATHGRNDRSALVGNLLSS

SEQ ID NO: 109242 - protein, 992 aa, Triticum aestivum
  Clone ID: PAT_TA_3660.pep
MAPCHAHGPPPPPPPPRPRAEHETRHALAPGHRHRHQSTTTSPPPPLFSPTPLPAAFRPAARFKLPSPHQSPCLSLFPMACSAAAGVEATALLSPRCPAPSPPDGRSRRRLALASRTRHRSLRAAAQRPHKSATGADPLYNNRANVRSDEASVSAEKERQRKYNDGDGISNLKLEDLVGMIQNTEKNILLLNQARLQAMEHADKVLKEKEALQRKINILETRLSETDEQHKLSSEGNFSDSPLALELGILKEENILLKEDIEFFKTKLIEVAEIEEGIFKLEKEHALLDASLRELESRFIAAQADTMKLGPRDAWWEKVEKLEDLLETTANQVEHAAVILDHNHDLQDRLDNLEASLQAANISKFSCSLVDLLQQKVKLVEDRFQACNSEMHSQIELYEHSIVEFHDTLSKLIEESEKRSLENFTGNMPSELWSKISLLIDGWLLEKKISYNDASMLREMVQKRDSRLREAYLSYRGTENREVMDNLLKMALPGTSSGLHIAHIAAEMAPVAKVGGLADVISGLGKALQKKGHLVEIILPKYDCMQVDQVSNLKVLDVLVQSYFEGNMFNNKIWTGTVEGLPVYFIEPQHPAMFFSRAQYYGEHDDFKRFSYFSRAALELLYQSGKKVDIIHCHDWQTAFVAPLYWDVYANLGFNSARICFTCHNFEYQGTAPARDLAWCGLDVEHLDRPDRMRDNSHGRINAVKGAVVYSNIVTTVSPTYALEVRSEGGRGLQDTLKVHSRKFLGILNGIDTDTWNPCTDRYLKVQYNAKDLQGKAANKAALREQLNLASAYPSQPLVGCITRLVAQKGVHLIRHAIYKTAELGGQFVLLGSSPVPEIQREFEGIADHFQNNNNIRLILKYDDALSHCIYAASDMFIVPSIFEPCGLTQMIAMRYGSVPIVRKTGGLNDSVFDFDDETIPMEVRNGFTFVKADEQGLSSAMERAFNCYTRKPEVWKQLVQKDMTIDFSWDTSASQYEDIYQKAVARARAVA

SEQ ID NO: 109243 - protein, 200 aa, Triticum aestivum
  unsure (1)..(200): unsure at all Xaa locations
  Clone ID: PAT_TA_3661.pep
MANLESLASLAAILILVLVEVAVLSSFAAAQLRPDYYANVCPNLEGIVRYSVKQSMVKSPISAPATLRLFFHDCAVMGCDASVMIISPTXDDEWRNQDDYSLKPEGFQTILDAKAAVDSDLQCRYKVSCADIIALAARESVSQSGGPNYTVELGRYDGKISTDXSVRLPHPGDNLDSLNAYFSTLGLSQTDMIALSGGHT

SEQ ID NO: 109244 - protein, 120 aa, Triticum aestivum
  Clone ID: PAT_TA_3662.pep
ICGAPAAAGSCSPRSLTSMTINSGCRGQARGRRFRGAAKISSMKFIYYEAGFSCPTYCCQLHIGHHKPLRPPVAGKMAMTTHDRWWCAVLVRLAKFSSYGDVFRPLPVASDRRHPVRSAG

SEQ ID NO: 109245 - protein, 381 aa, Triticum aestivum
  Clone ID: PAT_TA_3663.pep
PLPGGVCAPAELRAPALKRPSFRRDRLAAVKGAVPGRAGARASEPLELLASFFGAGLARAPGLPGPVQSAFGTRAAPAAPQRPDVGEGVWLGFPAAFAGSVVDGASSRLEACLACSGSGSKVGSKPKMCSTCGGRGQVMRTEQTPFGLFSQVSSCPTCVGEGEVISEYCRKCSGEGRVRVRKEIKVKIPPGVSKGSTLRVRGEGDAGPKGGPPGDLFVCLDVEEPSDIKRDGINLYSTVSISYIEAILGTVQKVRTVEGSSELRIPPGTQPGDVLVLAKQGVPSLNRPSIRGDHLFTVKVSIPKRISGREKELLEELASLKNGGFARAPVKPKPVHKENGSRAAPEVSDQPDDGEGDWLKKLSDFAGSIVNGASKWLKDNL

SEQ ID NO: 109246 - protein, 178 aa, Triticum aestivum
  Clone ID: PAT_TA_3664.pep
NVFSGTSGGVALTAAGGLRKIGLGDTYESPSLIGVHHEGKFYEFVPWTGTVSWDIAPWGHWRMSGENKNHLVEIEATTKEPGTALRAPTMEAGLVPACKDTCYGDLKLQMWEKKYDGSKGKIILDTTSNMAAVEVGGGPWFNGWKGTTASPELVNNIVGTQIDVESLFPIPFLKPPGL

SEQ ID NO: 109247 - protein, 239 aa, Triticum aestivum
  unsure (1)..(239): unsure at all Xaa locations
  Clone ID: PAT_TA_3665.pep
ARRSGDDIYLGDLVFEPPRDGPTMWEFGIPDRSAPQFHVPAPNPXLGHQTLHRASWRVKETFASSTXMQLFRQYGLWGRYAELYPDRDLVYTTGESIYSTDWFYAQGVWTLGEARQPTSWPRRVSLDAVPPNSTYKFRVALASSANAELQVRFNDEARAVPHFTTGLIGRDNAIARHGIHGLYWLFNVGVSGAWLVRGINTIYLKQPRNQSPFQGVMYDYLRLEGPCAVPAANSGPKAN

SEQ ID NO: 109248 - protein, 107 aa, Triticum aestivum
  Clone ID: PAT_TA_3666.pep
GQAESTEQGIRPAVNSCAEEGRSPGELSSECYAAPQEDPDQRPSPSSAGGRATPPRPLTAPGRVAAEAAGGALRPWHHSAGAPPYTSMRPRECGTRVGLAHASRTPR

SEQ ID NO: 109249 - protein, 92 aa, Triticum aestivum
  Clone ID: PAT_TA_3667.pep
EDVRTGIQPLSKSVVVDGERRPTITQIVHELSKSGIAESPPMSQANKLTATPLGETSRSCPGQACRKLNVPKRNLKLKLKKNVKLKLKTNVN

SEQ ID NO: 109250 - protein, 418 aa, Triticum aestivum
  Clone ID: PAT_TA_3668.pep
MAGKSKGARNKAKAQAASQEAVSVEPVADVAEEAKPQNGEVTEAPAAEVAPAAEVAAADVEKEEGDVAEAAQAAEKPAEGELHLYPVSVKTQSGEKLELQLSPGDSVIDVKQFLLDAPETCFYTCYDLILHTKDGSTHQLEDYNEISEIADITAGGCSLEMVAATYDERSIRSHLRRVRELLSLSSLHVLLSTSLALQQESAQAKNADAGKTRVRELDGLNFMEDTTVALTNLLASAPAEIKCVDSIVFSSFNPPPSYRRLHGDLIYIDVVTLEGSKHCITGSSKSFYVNASNGVGLDSRPLKQSHEASTLVGLLQKISAKFKKGFREILDRKASAHPFENVQALLPVTSWLGAHPVPEHRRDAARAEDSVVLSYGTELIGMQRDWNEELQSCREFPHANPQERILRGRALYKVTCDF

SEQ ID NO: 109251 - protein, 108 aa, Triticum aestivum
  Clone ID: PAT_TA_3669.pep
MDPALLDNIIARLLEVKSLKPGKNAQLSESEIKQLCAASKEIFLAQPNLLELEAPIKICGDVHGQYSDLLRLFEYGGYPPQSNYLFLGDYVDRGKQSLETICLFLAYK

SEQ ID NO: 109252 - protein, 282 aa, Triticum aestivum
  unsure (1)..(282): unsure at all Xaa locations
  Clone ID: PAT_TA_3670.pep
HLRDNQLYPKLLDLADRLAKMWEDMHMHHANQLKTVLDLKSVDISDSSIETSAHHHSHTRQLHDIVDKWNTNFSDLMSYQKEYINALYSWLKLNLIPIESSLKEKVASPPRVQQPPVKALLQAWNEQLAKLPDDLARHAIVSFRAVLETILGVQDEXELKKKEACEPIHKEYVRKARAFEEWYHKHGQRRTFDDPESGEGTSQKDAISEKRFAVESLKSKLDNEVEAHNKLSKQVREKSLSILRAHLPELFRALTDFSHATAEMHSKLRLNALMQDQGSGNN

SEQ ID NO: 109253 - protein, 324 aa, Triticum aestivum
  unsure (1)..(324): unsure at all Xaa locations
  Clone ID: PAT_TA_3671.pep
MMEKGMDPALLDNIIARLLEVKSLKPGKNAQLSESEIKQLCAASKEIFLAQPNLLELEAPIKICGDVHGQYSDLLRLFEYGGYPPQSNYLFLGDYVDRGKQSLETICLLLAYKVKXPENFFLLRGTHECASXVNRIYGFYDECKRRFSVKLWKTFTXDCFNCLPVSXALIDEKILCMHGGLFPEVNKLEXILIPKRPTDVAETGLLCDLLWSDRSKETQGCAMKDRGVSYTSXPDTLGGFLEKHAIDLMCRAHXLQDDGYVILCGSXLDTMCSAHNYCGEFDNAAAMMSVDETLMFSYQILNPARKMLPGSDNDKSGFKSMRGW

SEQ ID NO: 109254 - protein, 155 aa, Triticum aestivum
  Clone ID: PAT_TA_3672.pep
VTNIRFYLHNTHSVNDPSSVLVAENKNATAHAHGLVPFSSVYVFDDVLTEGPASTSKVIGNAQGMYVETGKDGYTILETIDCEMTDGPFKGSSFVMFSRNQFSKPSRELPVIGGRGAFRMAKGYGLLRTVCINCINSVNPSKGDIIEYNVTLYLH

SEQ ID NO: 109255 - protein, 136 aa, Triticum aestivum
  Clone ID: PAT_TA_3673.pep
HQGRWTISPLASRPPRSPEGHHKGLRHGVSPTAQLAGLHGNDLFRALMALQLPVTAPPEFCLEATLAAQSLIVHDHLDLFIHLCGVATCSGVGTAVRVCFFMVFMDHINTLEKFMQEHIDLADAAATSRATTGQAK

SEQ ID NO: 109256 - protein, 216 aa, Triticum aestivum
  Clone ID: PAT_TA_3674.pep
SARGPPPTLPVDLLASPPLPPRHPIPWPSSSPACCPVIRARGAAAPSAAKAPPPFWSPLPRSWRGGNCSSGVAPPFFFLHQRPLSRSTPLSCPDSRPLQGRPWGGPGGAAAPRPPNPRGPRSVRSWPVPPAGPARPPAPLPVLPLPARQGVLASALRELPAHMQRAIGELHRGLPSHAVRPVHLPESRIHSWPRPSCRRPAPPGPRPRAPARVPRT

SEQ ID NO: 109257 - protein, 205 aa, Triticum aestivum
  unsure (1)..(205): unsure at all Xaa locations
  Clone ID: PAT_TA_3675.pep
AASFTSWTLPCAGAAVASLSEPPCPLRDLLEEYAAAVRRMACGVLELMAEGLGVAPADALSRLVSDAESDSMVRVNHYPPRPELQGRLLTGFGEHTDPQVISVLRSNGTSGLEICARDGSWTAVPPDADSFFVNVGDALQVLTNGRFRSVRHRVVVSSERPRVXPRSFFGGPPFGEEGWAPLRQAAKGPGGPGSPLQGSSTWKGL

SEQ ID NO: 109258 - protein, 266 aa, Triticum aestivum
  Clone ID: PAT_TA_3676.pep
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELKKLIEANPLFRDKLQFPNLKSSRLRTLINQSLNWQHQLCKNPRPNPDIKTLFVDHSCGQPNGARAPSPANKATLGAIPTWWGPKRPSKEARRDKGGGHQNKTNRASTQGKNCRGKKGAL

SEQ ID NO: 109259 - protein, 570 aa, Triticum aestivum
  Clone ID: PAT_TA_3677.pep
KLVFSSHLVEWNESEGAVKRTYQGFRKRSMGVVQFDTTRNRFLAAGDEFVIKIWDMDNTSLLTTIEADGGLPASPRIRFNKEGTLLAVSTVDNGIKVLANADGVRLLRTLENRSFDASRSASETVTKPLINPLTAAAAAAAAAAAAATSSGTAAPSPITAMNGDNRSMVDVKPRIADESMDKSKVWKLMEITDTAQCRSLKLGDSIRTAKISRLIYTNSGVAILALASNAVHLLWKWPRNERNSTGKATASVSPQLWQPPSGILMTNDTIDNSPDEAVHCFALSKNDSYVMSASGGKISLFNMMTFKTMTTFMPPPPAATFLAFHPQDNNIIAIGMDDSTIQIYNVRIDEVKSKLRGHSKKITGLAFSNVLNVLVSSGADAQICVWNTDGWERQRSRFLQIPSGRPTSNILDTRVQFHQDQQHCLVVHETQIAIYDASKLEPVKQWPPRETSAPPITHATFSCDSQLIYASFLDATVCIFSASSLRLQCRILPASYLPQNISSNVHPVVVAAHPSEANQFALGLTDGSVYVMEPLESERKWGIPPPAENGSTSNMSTPPNGASSSDQPER

SEQ ID NO: 109260 - protein, 124 aa, Triticum aestivum
  Clone ID: PAT_TA_3678.pep
GRATGEEDGHGAELTRSSSSLSCGKEKVGHDERLSVSLSHARKWRCEGEGAASPVPPWLAAPAVARAPELSGRAREEWTSERGAGGGMALEFLMDRLGQSFDLAKTAPNRRIEMDVSEGSKILN

SEQ ID NO: 109261 - protein, 305 aa, Triticum aestivum
  unsure (1)..(305): unsure at all Xaa locations
  Clone ID: PAT_TA_3679.pep
SARGSCARXTLTEDESSFYVAETILAIESIHKHNYIHRDIKPDNLLLDRTGHLKLSDFGLCKPLDSSSFPNLTDLDSAAGNITNPSADGDKPLSSAAVPRRTQQEQLLHWQKNRRMLAYSTVGTPDYIAPEVLLKKGYGMECDWWSLGAIMYEMLVGYPPFYSEDPMSTCRKIVNWRSHLKFPEEARLSPEAKDLINKLLCNVDQRLGMKGAHEIKAHPWFRSVEWEKLYQMEAAFIPEVIDELDTQNFENFEEAAPTMQTSSKAGPWRKMLSSKDMNFVGYTYKNFEIVNDPELPGIAELKKKN

SEQ ID NO: 109262 - protein, 157 aa, Triticum aestivum
  Clone ID: PAT_TA_3680.pep
IVPCPHFLNSSHATCSILPVAMQPCLPGHDAIGLDVMHGPIELPPYLLRSSPYDPLQSSRSCFFPTQLLHRRRSAKGAAAGSQAHLPHCYRSAHANSLKEILHDIFRNLPVQKNKVREQTYAAQLPSRNLWCETIKVQKRYMNILFPYLFNFIPDYS

SEQ ID NO: 109263 - protein, 92 aa, Triticum aestivum
  Clone ID: PAT_TA_3681.pep
MPVGGTWHPRPSAKNRRHQGQRASSKDMQGSSIKFLEAALTIIRPSSLLGGEIQIWLAMAYDAHRRHKDSIALYREQGSAHPPMSIRDQETE

SEQ ID NO: 109264 - protein, 221 aa, Triticum aestivum
  unsure (1)..(221): unsure at all Xaa locations
  Clone ID: PAT_TA_3682.pep
KRQRYKIPKEPLTRLEYSQAQAGTSKPSANRSQHTPRLSQGRSRCRRIVTLCHPPWAKPSGPPFVSTSEESPLPSSPGSEDTTPXDRQSRSPLSSHDQDQQVAGRGRQTQRPHQAAAPPSIANAARRRQHHRKWPSMDTTDDIRQPHSHAKGLDQPLRRTKVVYSRRKNDAGAPSTTQSGRIGAFTPGPTEGRARGGLRSRFKQGNDAGAPPASWPQRTAK

SEQ ID NO: 109265 - protein, 498 aa, Triticum aestivum
  Clone ID: PAT_TA_3683.pep
MAAALLLRGLRSSASRARPAVPSPASAPPPFASSLLHRLYSSAAASAASPPASALGGVTDPARIRNVAVIAHVDHGKTTLMDRLLRQCGADIPHERAMDNISLERERGITISSKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLKFTKCPPDSEKNMSPLLDSIVQHVRSPKADLEAPFQMLVSMMERDFYLGRILTGRVTSGVIRVGDKVHGLRITDEGVHKIEDGKVVKLMKKKGTSMALIEAAGAGDIISMAGLSGPAIGHTVANPEVLTALPALELDPPTISMTFGVNDSPLAGRDGTHVTGAKIGNRLMAEAETNLAINVLPGPLSESYEVQGTGELQLGILIENMRREGFELSVSPPRVMSKTERGERLEPIEEVTVEVDEEHIGFVLETLNNRNGELLDMGPV

SEQ ID NO: 109266 - protein, 153 aa, Triticum aestivum
  unsure (1)..(153): unsure at all Xaa locations
  Clone ID: PAT_TA_3684.pep
SVLPHYTSSEEGEMSPAAAPLDDENLLSEILLCLPPLPSTLPRASLVCKRWRLLVSDILFFRRFREHHRHSPPLLGCFVEGDRCVSYTPTMDSPDRIPGERLSLQLIETCHSSVLGLPPRAPWLIXPRFTESRSWWWEPVTGGQRNRFPPGGF

SEQ ID NO: 109267 - protein, 193 aa, Triticum aestivum
  Clone ID: PAT_TA_3685.pep
RAHLNSVAPSDPSSLQLSLFFVVLNQPHWLGFCGTVLLSAAVGGAASESCPPSLLVFSCLVLQSSTPVAVMHSVHCLVPWPSLYLVSQPVPLLVFPWLVFFSKLFFLYPPVRPCPLHFGPSAPPVSVSALWFGGHPFRHASSVTVRPSPSVRGPAGHILPPARAGGCWVEYQSSTPVGGMYSVECRCLSRSCT

SEQ ID NO: 109268 - protein, 54 aa, Triticum aestivum
  Clone ID: PAT_TA_3686.pep
VIIATRTLQHYKQRFRNFRFFRRMARKQCSTCRCQCATFFPRDSYLSPNAQLKL

SEQ ID NO: 109269 - protein, 231 aa, Triticum aestivum
  Clone ID: PAT_TA_3687.pep
MAMQQLVYWFCAFLALLLLLKLLRKRGATTTAPALKLPPSPSSLPFIHNLHHLLRSPIAHRAVADIARELDAPLMYLQLGELPAVFVSSADAAREIMKVHDMKFAWRPYPPTIQKLRPMGKGIFFAPYGALWRQLRKISIVKLLSVRRVHSFHRVREEEAGRLVAAIAATPPGETVNLCEQIFWVIADSTMRTMIGERFERRDRGPGGVGGHRQDRIRVHHGRVVPLTPVD

SEQ ID NO: 109270 - protein, 216 aa, Triticum aestivum
  Clone ID: PAT_TA_3688.pep
MSWEETSSSSKAAAPPAIRLVSFVSEEQLDEAKRSRGERVEDGTAQRDKPLFQILQENKDKKDAEFNERFKHRPPKALDEDETEFLDKLALSRREYDQQVANEEAEQLRSFHEAVAAQSTIAHELGEMPTVSMPEESKPKPPPKRSQPEFLRNITVSVKPRAKKAKSDLECKPAPKELVPSNGHDTNREPQGDTKSSVLGSLAAYGDEDDESGDEQ

SEQ ID NO: 109271 - protein, 65 aa, Triticum aestivum
  Clone ID: PAT_TA_3689.pep
CHLVRMFQYRSCMQLHLAVIHELVASAYDTEMQLDQFGGNRRPNISTCSICAGTERPEQIRIICS

SEQ ID NO: 109272 - protein, 220 aa, Triticum aestivum
  Clone ID: PAT_TA_3690.pep
ESQYFVASYISILLFLFLFWALPGIVVGLFTLQGIWDVEQDSLDENSCHLRVYTNVAFSKRTIFRGKIEQSTKDECLAYMASAPYDSGLSSLVPPIEHCQQSVGTLASTSQEFWRSLASYMRSSQFGPVLGVMLVAIVILMQVTIIVLLSRSPKVLMVSPEASASSLGSYSKESIEWLQKRVSLLSEEMHMAEAHMEKMSHEFAWLKSHLERLERLRSSS

SEQ ID NO: 109273 - protein, 193 aa, Triticum aestivum
  Clone ID: PAT_TA_3691.pep
KELEAEEKPQKSLNEKQQENQDLLIKCVSQDLGFSSGRAIAACVIYRCLLHWRSFEVERTGVFDRIIQTIGSAIEVQDNDDKLAYWLSNSSTLLLLLQRTLKTTGAAGLTPQRRRSTAASFGRVFSGIRASPQSAARPFLGSRLIGGLGDLRQVEAKYPALLFKQQLTAFLERILGMLGPSLKKVISPLLGLC

SEQ ID NO: 109274 - protein, 408 aa, Triticum aestivum
  Clone ID: PAT_TA_3692.pep
PVSLSARPAGSKKSLQHVFRDGGCHPKMAMVIDDRLQVWDEKDQHRVHVVPAYAPYYAPQAEMANAVPVLCVARNVACNVRGGFFREFDENLLKKVFELLHENELLDLPYAPDVGDYLVCEDPNFPQSNKDPAPIPEGMSGAEVEKRLNGRAYQADQKQTSSSIRPSDDARVPIRGTLGSSNVQPNGGSMAIVPSLFVMVLQEIGRLCNSKVEFRSTVSTSKITQFSVEVLFSNEKIGNGIGKTRDEAQVQAAEKALQNLQSNYLSYVAPIAGVLPKVPSKPSRKGNGFLEDDLDSDGDTAMQEPSGSKSEQKDHSNVDRLPSVLSLISQLCLEDQHVVFRDQVRNPGSATNEEYHFQVELAGQILGNGIGVNKDFAKLQAAEEALRFLKTTTDPQIKKHLRPIRCSS

SEQ ID NO: 109275 - protein, 281 aa, Triticum aestivum
  Clone ID: PAT_TA_3693.pep
VDRNSAETSESFMESDWIDSSPPTKSNSSSMIINELCLTWKPSVHTNSLENVLLHIQRDNFMKTITHVQGIIRSFPSDLHCAAIIEAVVQKEILKWDSCLQDVDAQRVVIALLEHAKKIKEIHNFNMESRKEEFSTKLQDQLKWQLKELESVCTSLEFDYKKVTCDGNVAVSTSREQKKKLRALQDEIKGLQQSMMMEDELQKLVLQVAEHERLVQKSLLERVRVKTVLRSFKQVFVEVKERLAFDELGLIDVDALVKVELDNLWKEIEISKGRLLNIIFK

SEQ ID NO: 109276 - protein, 296 aa, Triticum aestivum
  unsure (1)..(296): unsure at all Xaa locations
  Clone ID: PAT_TA_3694.pep
RHPVHHTTRARPPLPPAGSHGCEHEEAPSAPAHPPPAPXPPPSRRPPSTATAXKPKAPKPSHPPKTKPPTKGPKPGPKGPTYPSPAPKGHLPHPPVVGPPKGHVPRPPVVGPPKGHVPRPPVYGPPKGPITRPPVTAPPVVVGPPVTYPTPPVTYPAPPVTAPPVTYPAPPVTTPPVTYPAPPVTNPPVTYPSPPVNTPPPPPPPPTPAAPTCPADSLKLGACVDLLGGLVHVGLGDPVVNKCCPLLEGLVXLEAAVCLCTTIKLRLLNINLYLPXALQLLLTCGKTPPPGYTCNV

SEQ ID NO: 109277 - protein, 344 aa, Triticum aestivum
  unsure (1)..(344): unsure at all Xaa locations
  Clone ID: PAT_TA_3695.pep
MCGILAVLGVGDVSLAKRSRIIELSRRLRHRGPDWSGIHSFEDCYLAHQRLAIVDPTSGDQPLYNEDKTVVVTVNGEIYNHEELKAKLKSHQFQTGSDCEVIAHLYEEYGEEFVDMLDGMFSFVLLDTRDKSFIAARDAIGICPLYMGWGLDGSVWFSSEMKALSDDCERFISFPPGHLYSSKTGGLRRWYNPPWFSESIPSAPYDPLLIRESFEKAVIKRLMTDVPFGVLLSGGLDSSLVASVVSRYLAETKVARQWGNKLHTFCIGLKGXPDLKAAKEVADYLCTVHHEIHFTVQEGIDAXLEEVLYHIQTYDVTTIRASPPIVSNVSGKINSWGVKNGLFR

SEQ ID NO: 109278 - protein, 144 aa, Triticum aestivum
  Clone ID: PAT_TA_3696.pep
CITGSKAFIRCAGSILTIISSTRQQRQHLKQQMKQQSIRIIFQVMQSLQLPDPGIKFTATPSGGGLDMFALFNPRGTSEGRIVFSNSIGEAVLYDADKQLFNTMGCLNEPKGADPMCLPIEHPGTDQDSLYVLDSCPWKADSRC

SEQ ID NO: 109279 - protein, 82 aa, Triticum aestivum
  Clone ID: PAT_TA_3697.pep
MHMWNSFVRKQRVLADGHIPWACEAFSRLHGKHLVQNPPLLWSWRFLMIKLWNHSLLDARAMNVCGTILQGYQNESSDPKKM

SEQ ID NO: 109280 - protein, 96 aa, Triticum aestivum
  Clone ID: PAT_TA_3698.pep
AATSRRSAATGTRSCSTCAYHIAAADTSRRLQRPPRRRVPLPPGPPRPDLRARRPLRPPPPPPPARSVRAPPPPGRGSRCAVAPVFGQGHWGATPS

SEQ ID NO: 109281 - protein, 238 aa, Triticum aestivum
  unsure (1)..(238): unsure at all Xaa locations
  Clone ID: PAT_TA_3699.pep
PGATMPALPFDRSPPSSPVNTVGAPIPPPRPQPVTRPPPRSRSHAPAADATTAPTPTDDAPHHLLEHLGVPGSDEDPSPPFTRRQPRALSQIGHYPAAGEAVELQQVGVNDLQLVAAKDLSRNPPLIPPSVVASARSSXVTRPRVVRPTSAVFLLIHAADLDHGCPSRREGLQRVGPGSTSSSPAACLGSRRAHPPSAHGVWTLMTVAPPCCSLLSLGVFVCSFVLGLGSWCVMMVSE

SEQ ID NO: 109282 - protein, 533 aa, Triticum aestivum
  unsure (1)..(533): unsure at all Xaa locations
  Clone ID: PAT_TA_3700.pep
VRYGSATELGWSTGRGYTLREGAXKIKRHSKNFQERKSIRPTFSIERVFGGVLLAMCTNDFICFYDWADCRLIRRIDVNVKNLYWADSGDLVTVASDTSFYILKYNRDVVSSHLDGGXQLVREGVEDAFXELLHEINERIRTGLWVGDLFYLXNSASRHNYFVGGEVTTLFHLDRPMYLLGYLANQSRVYLIDKQFNVVGYTLLLSLIEYKTLVLRGDFDRANDILPSIPKEQYDSVAHFLESRGMLEEALDIATDSNYRFDLAVQLGRVDDAKAIALEVQSESKWKQLGELAISTGKLEMAEECLLHALDLSGLLLLYSSIGDAEGITKLASMAKEQGKNNVAFLCLFMLGKLEECLQLLIESNRIPEAALMARSYLPSKVPEIVALWKKDLQKVNSKAAESLADPDEYPNLFEDWQIALNVEATVAPKRGIYPPAEEYMIHSERPNESLVEAFKNMHVQEEEDVHEEDVHDEEELTNENDTVQEVFEDDEAEESQEDAVEVEADGSTDGTIHVNGNDSEEQWGTNKEEPSA

SEQ ID NO: 109283 - protein, 310 aa, Triticum aestivum
  unsure (1)..(310): unsure at all Xaa locations
  Clone ID: PAT_TA_3701.pep
GLPFLLVVRAFMGIGARAAFPARNNILSKWVPVSERSRSLALVYXSGMYLGSVTGLAFSPFLIGECGWPSVFYSFGSLGTGWFATWAAKAYTTPLEDPGISAEEKKLIISQTTSREPVTTIPWGVILSKPPVWALIACHFCHNWGTFILLTWMPTYYNQXFLEFNLTGSXPFLASFPGLTXAISANVGGWXLQTHLLSKRNIKWTTVPQDHATNGFLRAXFFLNQTGPYPIQPTLAFLCXAXYQGNEHFLNXGQYPNNQDSDTRCTGSPTLGPTVFGQHNRYCNMSWTLKCRLTVGRIIQRKFETRTTRK

SEQ ID NO: 109284 - protein, 157 aa, Triticum aestivum
  Clone ID: PAT_TA_3702.pep
VRLRWRESGWGLHDGGQNKDDLAHPHPAWVGPRPRRPRPQAQRLVALWRTRIPLHARAPVYHLHPLLCPRHSPWRLWQQSILLTAPPRGVDCLLDGLGGHPNEYDLENLDNGRMSSCFIVASPRGCNTMAWRGARYSPKIACLFSEFDSLLDKPPYV

SEQ ID NO: 109285 - protein, 140 aa, Triticum aestivum
  Clone ID: PAT_TA_3703.pep
SNKMCGNPTRIKCLRDLLPQDPVPPNFWWLDDEDADNGQFQGQPTALASAMAARTSRTRASSSPTTTFPQRPCPSASTMKTCLPCARSSPPRTGSHPRPLLCGQTPERGSFRMGSSAALTAAPSLLTKICARSRIMGRGA

SEQ ID NO: 109286 - protein, 376 aa, Triticum aestivum
  Clone ID: PAT_TA_3704.pep
MADEDVQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMTQIMFETFSCPAMYVAIQAVLSLYASGRTTGIVLDSGDGVSHTVPIYEGYTLPHAILRLDHAGRVCTDNVMKCPTLRGYSLTTTAEREIVRDIKEKLAYVALDYEQELETARSSSSVEKSYEMPDGQVITIGSERFRCPEVLFQPSHVGMEVPGIHEATYNSIMKCDVDIRKDLYGNVVLSGGSTMFPGIADRMSKEITALAPSSMKVKVIAPPERKYSVWIGGSILASLSTFQQMWISKAEYDESGPGIVHMKCF

SEQ ID NO: 109287 - protein, 329 aa, Triticum aestivum
  unsure (1)..(329): unsure at all Xaa locations
  Clone ID: PAT_TA_3705.pep
GMTPLRTPQRTPGGKRDAIMMEAQNLAXRLRESQTPLLRGDNPDLHPSDLSGVTPRKKEIQTPNPMATPLASPGPGVTPRIGLTPSRDGNSFGLTPKGTPFRDELHINEEVEMQDSAQLELRSPPASGRGLRSGFASIPQPKNEYQIVMPPITEEKEEAEERIEEDMSDRLARERAEEQARQEALLRKRSKVLQRSLPRPPAASVEILRQSLIKGGESRSTFVPPTSLEQADELINEELLRLLEHDNAKYPLDEQTQREKKKGSKRQTNGPAFVPEIEGFDEHELKEASSMVEEEIQYLRVAMGHENESFEDFVKSHDACQEDLMFFPA

SEQ ID NO: 109288 - protein, 167 aa, Triticum aestivum
  Clone ID: PAT_TA_3706.pep
QIRLGAPPDYCQPSSEWPCAQGRQYYGRGPIMLSWNYNYGPAGRAIGEDLLNNPDLVATDATVSFKTALWFWMTPQANKPSSHAVITGQWTPTAADNAAGRVPGYGVITNIINRGLECGRGQDSRVADRIRFYQRYCNILGVGYGSNLDCYNQRPFVEGLLIQQVTQ

SEQ ID NO: 109289 - protein, 143 aa, Triticum aestivum
  Clone ID: PAT_TA_3707.pep
HRASSILHAPVASALLCSMTPALRRPWSCRRRDADAEGETAVADCTAAMPKSKLRAHHVVFIQASTQTNAGRNCQDVSMGAILVSLVTRRRSGIIRCFSSPGSVVASSMNRKFRTGFYSSIEPCIRRGRWRSNTLTAADARKW

SEQ ID NO: 109290 - protein, 211 aa, Triticum aestivum
  Clone ID: PAT_TA_3708.pep
PQFDQRSPTSMAAVSKVLEDDNLLTEILLRTVFTTTLLNSALVCTRWLAHVSDRAFLHRFREIHPPRLLGFYINKGEHTPNFIPILPQPRELTAVIQRATSSFGTYQRVPSVPTYILGCRNGNVLIRQHDEIGTTFAVHKVVCPERGMDILPPFPRPQSQYLFDGTTYSKILPKEEGDELPYLYALMHQTKGRKTQGIPIYLETWHMAPDS

SEQ ID NO: 109291 - protein, 382 aa, Triticum aestivum
  Clone ID: PAT_TA_3709.pep
MGRREALVVLLAVVVAAAAAGEAGAAKAKGKAKGKYRALFNFGDSLADAGNLIANGVPDILATARLPYGQTYFGKPTGRCSDGRLVIDHLAQEFGLPLLPPSKANRSDLSHGANFAITGATALDTPYFEARGLGAVVWNSGALMTQIQWFRDLKPSFCNATKEECKEFYANSLFVVGEFGGNDYNAPLFAGKGLTEAYKFMPDVIQGISDGVEELIAEGAVDLIVPGVMPTGCFPVYLNMLDMPAHEYGARSGCIRQYNTFSWVHNAHLKRALEKLRPKHPNVRIIYGDYYTPVVQFMLQPEKFGFYKQLPRACCGAPGSVAKAAYNFNVTAKCGEPGATACADPTTHWSWDGIHLTEAAYGHIARGWLYGPFADQPIVQSS

SEQ ID NO: 109292 - protein, 184 aa, Triticum aestivum
  unsure (1)..(184): unsure at all Xaa locations
  Clone ID: PAT_TA_3710.pep
MPARGHGARSGSRGYSRACSSLRNGGRGSGRGQVRPKGPGERPSAGHLLALAVRRQQPHHQLGVEEQLPSAGDLRPGSVAKAHYTVIIRRHCQPPAGEATSRPAILRRYKQLPRAWCAAPGSAAKGVYNFNVTAKCGEPGCXACADPTTHWSWDGIHLTEAAYGHIXRGWLYGPFADQPIVQSS

SEQ ID NO: 109293 - protein, 236 aa, Triticum aestivum
  Clone ID: PAT_TA_3711.pep
LLSPGSRSWRRGSRNWSSRLRLSKPHRLQLHHPSDRRRLRPLPWSRARSKGNQATAFLGDPGRWPPARRRLPRSRDWVQVAAGQSGTAQAQVAYGSAFNNLPAQTTQAYGMPYAYTNPMAGYQDVQASGHAGYPVASYDQNAIPYYTIYPGYPAGYDQNGLPYYTGYPAGDDQNAMHFYLVAYAATAVGVPATDAANMDGNAGSPAGAGQAESTGHITLASDAPPVAAIGSPLLEM

SEQ ID NO: 109294 - protein, 130 aa, Triticum aestivum
  unsure (1)..(130): unsure at all Xaa locations
  Clone ID: PAT_TA_3712.pep
MADHDPELEAIRQRRMQELMGQRGGAASPQNAXQQKAQEDAKQEAEERRQXMMLAQILSXEARERISRIALVKPDKARGVEDVLLRAAQTGGISEKVSEERLISLLEQINTHTSKQTKVTIQRRRFDDDD

SEQ ID NO: 109295 - protein, 185 aa, Triticum aestivum
  Clone ID: PAT_TA_3713.pep
GKSNNQISLACQLFLFTGVGFLPTVSSADAVSGHCFSGESAESQFTLNLPENLVVSKIAVWATVANPITKYALTITPLAMSLEELLPRSQQKYSNIIILRSALVVSTLIIALSVPFFALVMALIGSLFAMLVTYILPCACFLAILKAKATWYQTATCSFIIAVGVTCACVGTYSSLSGIVQNYAT

SEQ ID NO: 109296 - protein, 74 aa, Triticum aestivum
  Clone ID: PAT_TA_3714.pep
MYASFVPKKKNMRVRANCICMCCESVMCPFLVRDQQNRCSIRVPQIPPWKENVLYSELSSHLLGYMAGAQSSYF

SEQ ID NO: 109297 - protein, 132 aa, Triticum aestivum
  Clone ID: PAT_TA_3715.pep
MASIAGSAVSFAKPVKAINTNSLSFSGARRGNAFLRLQPVPMRFAVCCSAKQDTVEKVCEIVKKQLAVPEGTEVCGTTKFSDLGADSLDTVEIVMGLEEEFQISVEETSAQAIATVEDAATLIDKLVSAKSS

SEQ ID NO: 109298 - protein, 167 aa, Triticum aestivum
  Clone ID: PAT_TA_3716.pep
LPSHYSITRCVSFKAVNCTEMEMTPELLYGQNVYVPTAVNSYTYGYAEVGSPMDWYNHQNSLGYDAQDVYFPAFQTDGTQCVYCFPGAQPHPTHPVHPPSPSRSSCSLPRRPHALRARRLPSRAASWLPSPDLPCPSPSPSRQSTRTHSLSLVQGGAMHFFACSQCR

SEQ ID NO: 109299 - protein, 334 aa, Triticum aestivum
  Clone ID: PAT_TA_3717.pep
PARPRAAPSASMSAEARAAPSPLPPPAHPTYDLSAVIALALSDDAGDRRTRGCLATIPTDVKAEATFIAKEDGVIAGISLAEMIFNQVDPSLKVEWFEADGNYVRKGLQFGKVYGCAQSIIVAERVVLNFMQRMSGIATMTKAMADAARPACILETRKTAPGLRLVDKWAVLIGGGKNHRLGLFDMVMIKDNHISVAGGITNAMTSVDQFLEKENLAIPVEVETRTLEEVRDLLKYTDENKTSLTRIMLDNMVVPLPNGDLDVSMLKDAVQLINGRFETEASGNVTIDTVKKIGETGVTYISSGALTHSVKALDISLKIDTELALQVGRRTKRA

SEQ ID NO: 109300 - protein, 293 aa, Triticum aestivum
  unsure (1)..(293): unsure at all Xaa locations
  Clone ID: PAT_TA_3718.pep
FHSGTAACVVPGLAAPAGRARLRGASAASARPPCSSLPSRGVVCSAPPPAGRTVCSAAGPTLLAATGPPPTPSPACPRGPRRPAPLARPPPCACPRAGPAPSAPPDAARPAPSPMGTGGECVSIRPRSRFVTVDGIVCGPGPGLSVGSLGKNGATASVEYIDVKNVHFINTTNGARIKTWQGRKGYAKSISFTDIKFTNVDRPVVINQFYVDRHHVPNMGAVALSNITYKXLKGTSKHQTAVDFNCSESGSCTKIHVNSAXITVADGGGTMARCQNAQGDTSGYVYPKIPCLR

SEQ ID NO: 109301 - protein, 142 aa, Triticum aestivum
  unsure (1)..(142): unsure at all Xaa locations
  Clone ID: PAT_TA_3719.pep
ILFANANEARAFCELTSEESTVSAARYLSHSIPLVSVTDGMHGSYIGVKGEAIYIPPPACIPVDTCGAGDAYASGILYGILRGASDLKGIGLXAAQVAAVVVGQQGTRLRVKDADRLAESFEFHLDNLEFCSDAGTDQVPNL

SEQ ID NO: 109302 - protein, 163 aa, Triticum aestivum
  unsure (1)..(163): unsure at all Xaa locations
  Clone ID: PAT_TA_3720.pep
APPPPPRPGTSPPPPSAXRPPTSARAPSRSAPPAPPSAAPSCKPPRPRPRRPGAPAPPTPAPPRRPPPAPAATREPLGSPPRPAGCLPPPAACVPASAAACSVAGCIPLRPPAPELSVFLLTEQADTTSAQSVQEERHGEASVDPTGKVFGEMPGELGGQPYQ

SEQ ID NO: 109303 - protein, 231 aa, Triticum aestivum
  unsure (1)..(231): unsure at all Xaa locations
  Clone ID: PAT_TA_3721.pep
PKGGQSFSELHRSEHRRTPPPAGASRPPQXPPRPPPPAPPPPPPPPPPPPAPPRPPPRPRPPSAPAPPRRPHPPPAPPPGPPPRPAPPPRPHPPPPAPHPRPPPRPPPPRACPPPVPGGGVGPGRPRHPLPPRAGRPRRNDRLSGVRGVTAGAGHQRRRAADAARSVQGPRTVAGGKWPPVIGGRAGRPPCPCRPGGRRAGPRPPTSPPATAVVVAVRPRSLRRRPRAGFV

SEQ ID NO: 109304 - protein, 104 aa, Triticum aestivum
  Clone ID: PAT_TA_3722.pep
GSRRAWRTRPAAGAGRPAAPPRPSPGAAPAAARAWTNVASWAVAGTLAYYLRLRPARQLHKERQQRAALAAASDPYRYVGKRNPIPDPQDTWLTYREEEGSSEV

SEQ ID NO: 109305 - protein, 133 aa, Triticum aestivum
  Clone ID: PAT_TA_3723.pep
ALTALSLYVETEPVDKIIFGNAGFSVLKYFKFRCSAPWLKFESAAMPNLEKLMLGFNVIPQMDQHRHANAVITIERMPGLKEISAKIGGATANTDAVSALRTVVSNHQSNPKINVQLVDYSFYGHENELQFLW

SEQ ID NO: 109306 - protein, 307 aa, Triticum aestivum
  Clone ID: PAT_TA_3724.pep
MSSLSMVEARLPPGFRFHPRDDELVLDYLSRKLGGGAGGAAAAVASIYGCPAMVDVDLNKIEPWDLPEIACIGGKEWYFYSLRDRKYATGQRTNRATESGYWKATGKDRAISRKGLLVGMRKTLVFYEGRAPKGKKTEWVMHEFRKEGQGDLMKLPLKEDWVLCRVFYKTRATVAKPPTGSSYNIDSAAATSLPPLVDNYIAFDHPGMSTVQNLEGYEQVPCFSNGPSSHPSSSASMNIPVTAMAPMAADQEQQHMGKAIKDALSQLTRFEQGNVKREAPAQGGVFAQDGFEYLADSGFSQMWNSLN

SEQ ID NO: 109307 - protein, 40 aa, Triticum aestivum
  Clone ID: PAT_TA_3725.pep
AEILTPVASALKPFLEGLLFNGLERFVAFAKERYSKSLQS

SEQ ID NO: 109308 - protein, 230 aa, Triticum aestivum
  Clone ID: PAT_TA_3726.pep
RKSQSGWRCQSVGSYKKKPMTAAAFSGDGSVLAVAAESVITLWDPDNNALVGVIAEALSPITKLSFAGDSAYLMSLSQSSKPQVAVWNVSNLSMQWSYTLFAEAACCSSSKSEFAVLSLLSCPEGGAPAEQDGIILIFDAENSKPVSSWSVKKAKGGSIAFVKNDLSLDANTDDTRDGEASLLVYLNGLHEYVIFDPRNNEEQQISQNTRKNIQADEPAPIGYASIYGEL

SEQ ID NO: 109309 - protein, 255 aa, Triticum aestivum
  Clone ID: PAT_TA_3727.pep
REREQSGVTSSCHCMWTYLADLRASGGSFHEHINPFYDRERYWLPLVPPAAALAPTLWPQFYLRWTCPPESQGGGLESHGHSMRKKYEASVKSKEMAESRSRDIKMKMESMLTDLQRERRASSSALAMAQRARRENVAIKRAIQTIGCTVNFSTNENQVDKSEEMSYSFRREADTVSQQDDNADLSVSISAIEDSLVSETPSNQVCETLCPFRSREGCRWPHAACAQLGSQFVGLKANFDAFDRLSVKDCYFPKE

SEQ ID NO: 109310 - protein, 223 aa, Triticum aestivum
  Clone ID: PAT_TA_3728.pep
LAVALRRLLPPPSAAAAARGAAPVAAEACSGRGIPILRRAGGAEVAAGGWSGGSGTRLCRRLCTYNERDDRALEEEVEKKFGWILKIFFIGTAGLVGWQFFPYMGDNLLQQSITLLHVKDPLFKRMGASRLARFAVDDERRMKVVEMGGAQEILNVLEGAKDDKTRKEALKALVALAKLDKAAGFLDKAGAYAIVSSTPNSPEYAEIEACKTSLLKTFDQLKS

SEQ ID NO: 109311 - protein, 429 aa, Triticum aestivum
  unsure (1)..(429): unsure at all Xaa locations
  Clone ID: PAT_TA_3729.pep
GEPVAAGFRLRWRFVADAAFRKASQVLARLRAVPLGSVVVLDXVAEDTVPWRECSPLHGGPYIWCMLHNFGGNIEMYGVLDSISSGPIDARTSYNSTMVGVGMCMEGIEHNPVVYELMSEMAFRSQKVEVEDWLKSYSYRRYGLLNVELQKAWAILYHTLYKCTDGIPDRNXDYLVEFPDISPSSFSSQYSKRRSISVVRKHTRFLGEVSASLPQPHLWYSTEEAVKSLELFLKAGDDLSESLTYRYDLVDLARQSLSKLANKVYLDAMDSYQMRDSSGLNFHTKKFLELIMDIETLLASDDNFLLGPWLETAKSLATTEDERKQYEWNARTQVTMWYDDTKTEQSKLHDYANKFWSGLLKSYYHPRASKYFTRLSRSLQENRSFQLEEWRRDWISYSNEWQSGKELYPVKATGDALAISRSLFAKYFR

SEQ ID NO: 109312 - protein, 141 aa, Triticum aestivum
  unsure (1)..(141): unsure at all Xaa locations
  Clone ID: PAT_TA_3730.pep
LCRPRPLPPPPSLRAPSPAPLPPPPLPPPPPAPVAALRPPTTPSPHPRPASPGPPGCWRAGRRASPTTATSRPPPPSPSRPPARSAPPPSXRARRPSPHPACAGDLRFPCPCPPAGGPVRGSWDPPALQPCCRGLGVINFS

SEQ ID NO: 109313 - protein, 181 aa, Triticum aestivum
  Clone ID: PAT_TA_3731.pep
LRAAGDDVGEPREGVAAGLVHGGGRGEQRPALSPARHGVLRSARGRPVQAHHPAGLPSRADAAGGARAPGPRPGAGRPPPARPGAGRARPARRRRCQASTCRRSSTRPLGVDVPTPGAPVPGTPPSPEQPGPFVPSPPRPEIPAVPPNPDVIPTPPPEVDPPRTPPEVVPPQPSDVPPPFV

SEQ ID NO: 109314 - protein, 302 aa, Triticum aestivum
  unsure (1)..(302): unsure at all Xaa locations
  Clone ID: PAT_TA_3732.pep
GSNEEVRRMKAETADVVLDVRDHNYLXRVAPHFLKWRAQYGEPFLFWFGAKPRICVFDYELVRQILSSKSGHFPKNDAHPNVLELLGKGLVLVNGVDWVRHRRVINPAFAMDKIKAMTETMVSCAQRTFSVFEDQACKNTNREILVEFDKAVQGLTADIISHTAFGSSYKLGMEAFHAQKELQSIAISSLLNVQIPGFSYLPTKRNRRKWMLEKKLRSTLMRVINSRLASKGSGYGNDLLGLMFEGCTTTVQGGKQEQLSLSMEEILHECKTFFFAGYETTSLLLTWTVFLLSVYPEWQERL

SEQ ID NO: 109315 - protein, 316 aa, Triticum aestivum
  unsure (1)..(316): unsure at all Xaa locations
  Clone ID: PAT_TA_3733.pep
NKKIAEAPSFPPLPRXAPQLPEFNEFHLKTMERVSRHADTCSEASSVGTMRSQGSKPLKLAEAKPPQLETALRARPSRVKSTQELELEELEKAPKFKAKPLNKKILESKGDIGVFAHPKAQATEPKEFHFRTDDRLGPPAVADLLDKLSLYSESSSYHDKKDMPRLTIPNPFNLHTDERGHDKERQLEAQLLQKKLEEEKARKFKANPYPYTTDYPVVPPKPEPKPCTRPEGFQLESLVRHEVEQQRLMEERERMAREEAQRRIVRAPPILKEDPIPLPQKERKPLTEVQQFELHVDERAVQRSEFDNKVKEKEIT

SEQ ID NO: 109316 - protein, 346 aa, Triticum aestivum
  unsure (1)..(346): unsure at all Xaa locations
  Clone ID: PAT_TA_3734.pep
MEVPSDWTAARVREVFIDFFKSKSHTPWPSSPVVPVDDPTLLFANAGMNQFKPVFLGTAAPDSQLGRLSRACNTQKCIRAGGKHNDLDDVGKDTYHHTFFEMLGNWSFGDYFKEGAIGYAWELLTQVYKLPTDRIYATYFGGDEKAGLAPDTESKNIWLKYLPNERVLPFGCKDNFWEMGDTGPCGPCTEIHFDRIGNRDAASLVNNDDPTCIEIWNLVFIQFNRESDGTLRSLPAKHVDTGMGFERLTSILQNKMSNYDTDVFMPLFDAIHKLAGAGIQPYSGKVGSDDVGKVDMAYXVXVADHIRTLSFAIADGSQPALWMFLSKCWLICVPWASKLWKQDFTL

SEQ ID NO: 109317 - protein, 410 aa, Triticum aestivum
  Clone ID: PAT_TA_3735.pep
IGAPSPRAVTDAVSRVLAAHPGPFRCVHLTRTIMEEHRGEMARWLDILVAKGVQELVFVNRPWPLDLRLPATIFSCSSLTRLYLGVWRIPDTAAVPRGARFPNLLELGLCMTVMEDHDLAFMLERSPVLESLIIMGSQTGVRLRLVSQSVRCVQLGYTYLEDIEVVDAPRLERLFQSDNFRQSELTGPSIKNCSSKIKIGRAPNLRVLGYILPGEQELGISNTLIVAGAKESIAPSVQILAIEVQFGCRNSIKKVPGFLRCFPNLGTLHVQSPRIPKESTGKVNLKFWQEGGPIKCVLQSLKKLFFYEFRGSRSEVAFLKFIAERGRVLEQMVVVVAKECFSPGGDGVNAKLKPLTNAKWNSKGCKLELFKSPLTDVAGPICSHRHASDFGFADPFDLEFYCESETISVS

SEQ ID NO: 109318 - protein, 179 aa, Triticum aestivum
  Clone ID: PAT_TA_3736.pep
TRLKSADAAYGKISGMVSTLGDPFTRIITPKEYQSFRVGSDGNLQGVGIFINRDPASGRLLVMNCIEGGPADRAGIREGDELVEINGNSVLGLDVEAVAQRLRGRAGTTVEVKLLDGTGNERSGRIKQKEVQLSREVINLSPLSTAIISHRSGDGHEGKTGYVRLAAFSQTAAAEMERA

SEQ ID NO: 109319 - protein, 179 aa, Triticum aestivum
  Clone ID: PAT_TA_3737.pep
QVVGSRACRSHRPCGSALSRVCQAVVAAVRNFGVEPPSDSSLLYDPREEDLAVQRIKHTPDLRFFDKAAVVVPSGKEVETAAASTPHSPWRLCIVTQVEETKILVRMLPLWATVVFFYAVLAQVSSTFVEQGMAMDAAVGSVRVPPASMSTFEVFAIITLVPLYDRAFVPAARRLTGRG

SEQ ID NO: 109320 - protein, 81 aa, Triticum aestivum
  Clone ID: PAT_TA_3738.pep
ARRCQDAPSPSRAFTPTSAVQICRGRCSDKRFGGKKLIQPWSSPRRRTSSITPAAVQDVIGIIIQKKEIGTDLHKRRHVDL

SEQ ID NO: 109321 - protein, 300 aa, Triticum aestivum
  Clone ID: PAT_TA_3739.pep
MATAAAAAATMRLSSPFRAPPLRPPCHRVVPSMRGPRRAGLAVSAAAAGSPPTVLVTGAGGRTGQIVYKKLKERADQFVARGLVRTPDSKGKIGGGDDVFIGDIRDPGSIAPAIEGIDALIILTSGVPKMKPGFDPSKGGRPEFYFEEGSDPEQVDWIGQKNQIDAAKSIGVKQIVLVGSMGGTDINHPLNKLGNGNILVWKRKAEQYLADSGLPYTIIRAGGLQDKDGGVRELIVGKDDEILKTETKTIARADVAEVCIQALLFEEAKFKAFDLASKPEGEGTPMTDFKSVFAQIATRF

SEQ ID NO: 109322 - protein, 154 aa, Triticum aestivum
  Clone ID: PAT_TA_3740.pep
SKCPTGVRPSSSPCAPSCRSSFRGAWLRWPLRCTSVQPERMGKSTDGSRSPRPHILTISWQSSPHNLTMEFHGLWLPWPASSPVAATPSERHTTTGLLHGDYTNMMETLGLGQPFLVRLAPPTVQVLLPWRPNRTSPKSRKKDEQHQGATRKRS

SEQ ID NO: 109323 - protein, 180 aa, Triticum aestivum
  Clone ID: PAT_TA_3741.pep
CIIHCDIKPENILLDDELGAKLADFGMAKLVGRDFSRVLTTMRGTLGYLAPEWLAGSPVTAKADVYSFGLVLFELVSGRRNNAPSEKGGYGMYFPVHAAVSLHEGDVVGLLDQRLAKEADVKELERLCRIACWCIQDEEADRPTMGLVVQQLEGVADVGLPPVPSRLHMLTKGERKRRWR

SEQ ID NO: 109324 - protein, 74 aa, Triticum aestivum
  Clone ID: PAT_TA_3742.pep
SPPHVRTAAAGPWIHFSAEPRRPPLSLPGDRSKLQLPLANGSESARPAGSEVYFNQRSEEERAPRSGSDCLLTS

SEQ ID NO: 109325 - protein, 154 aa, Triticum aestivum
  Clone ID: PAT_TA_3743.pep
MALPARLVRVALLLLVALSFCAAGTHRAPREPHRALHSGQARGGLVVRRSVAEAPADINVTTNSSFVLAEHRTFRKDPLNAFNRYEGGWNISEVHYWASVGYTAYPLFVVALLWFVLFFLLMLGISCHHCCCAHHSYNYSRIAYALSLILLILF

SEQ ID NO: 109326 - protein, 184 aa, Triticum aestivum
  Clone ID: PAT_TA_3744.pep
LCGAQAAGPAEASNHFFQSTSSSSRRRRRQAGGRARNPNPNHYFRSARASTMAASLRAAAAAATRILRPAVLPGERLRRLVHTEQHPAPACSLKEGYRGSQIQQKKEELYAASQLDRRPITTAKKVTEWTATAFVLVAGAVTLGGLATAEGAHKQDESDERRCQCRPWLCAECEQSQSLRRTNA

SEQ ID NO: 109327 - protein, 81 aa, Triticum aestivum
  Clone ID: PAT_TA_3745.pep
KSKVEEKILLLMNIQRERVDVAILFPIYIGHSIGFLSHFLDLGVILCPFNSCISCVGSVGISPLAERSRQCDNFYEAIFCV

SEQ ID NO: 109328 - protein, 165 aa, Triticum aestivum
  unsure (1)..(165): unsure at all Xaa locations
  Clone ID: PAT_TA_3746.pep
MANGDQDMATAELMETEGLKVLAVDDDPVCLQTLTQMLRRGGYEVTASASPADALKEVEKNPDGIDFIMTVAQXPGRARGMDGFGLVKRVGKRYPVSLVFSGDRRPWRQGKGGKAGIGACYLMDKPLRDAQIYFIWQQVXRWRRKAAGAATENPNPRHSQGIRLD

SEQ ID NO: 109329 - protein, 233 aa, Triticum aestivum
  Clone ID: PAT_TA_3747.pep
MPVEGAVGIKGEEMEQASATTPTTSTIRTKRARPKSSATLKTPVAAPPGGEGGPEDRDHMYRGVRQRRWGRWASEVREPNRGKRHWLGTFDNAVDAALAYDRAAVAIFGSRAIVNFPSAFFISTAQPVQCHPASSSPSAAAASVFVEHKLRPMLAAASVLTEHGVKPMMAAASILDEHEVKPVITASVFGEREVKPMVAASVFREREVKPVITSVFHEHEVKPVITVFGEREV

SEQ ID NO: 109330 - protein, 202 aa, Triticum aestivum
  Clone ID: PAT_TA_3748.pep
IHKKMTAKIQKHFFLNCKATPTALPWGVGAAVDSPRTHPGNAPEDCTTSPRTAHCTARFFIDARGGGRGVWASVLELVTGDMEVTARSEVRIRGSGWIPWLQARGVRRSPLAGVHGHGRRLRAGGLRWRLSKNNYRRRPDPANLLPFYRGEPWESGEMQGTPHPNLRGRWSAGKRTTAGGLEAVYLARIRQLLGLGSGIGVW

SEQ ID NO: 109331 - protein, 272 aa, Triticum aestivum
  unsure (1)..(272): unsure at all Xaa locations
  Clone ID: PAT_TA_3749.pep
IRTSSRASRFGYAMNPLPAASDVTESVPDADGARSVQARIARGPPSQRTFSTCDSQKLIDLRGLVGLIDVARSPGGSGPVIRIAGTSSLGHAIYKKAPRELPGLIDVARFRRGSGSVIQRPQLPPPRWSLRDSLSDPLFEIFAVYTHFPLIGEVLVFNGMATQIICQSKSVDAFNSSKAQWELKHPRSKHVFRMELPPTGPSRYISAESGVLLQVKIDPTENEPVEVSNKLVDWFNSPMSDKCKSVTIQTRKGKVDVLCAVINDAXXXTLSX

SEQ ID NO: 109332 - protein, 61 aa, Triticum aestivum
  Clone ID: PAT_TA_3750.pep
PTEGYGCEKTTEGYGCEKTTEGICQYFYWSLHYASGKETAEFPIEPEITLELMMAANYLDT

SEQ ID NO: 109333 - protein, 86 aa, Triticum aestivum
  unsure (1)..(86): unsure at all Xaa locations
  Clone ID: PAT_TA_3751.pep
RPVSDIDKKAAMVSXTLRNMLTSPGGFAETREGEVRFPEISTAILEKICQYFYWSLHYASGKETAEFPIEPEITLELMMAANYLDT

SEQ ID NO: 109334 - protein, 126 aa, Triticum aestivum
  unsure (1)..(126): unsure at all Xaa locations
  Clone ID: PAT_TA_3752.pep
MRKDGDMVGVVKLISAEGFEFVIDKKAAMVSSTXRNMLTSPGGFPDTRVGEVRFPGDAAPRSXRRSPSKFYWSLHYASGKETAEFPIEPEITLELMMAANYLVHLAWKIAWLLARLMPSCNLGSFS

SEQ ID NO: 109335 - protein, 65 aa, Triticum aestivum
  Clone ID: PAT_TA_3753.pep
TLGLSRCLLYSFYQLSWSPTGMSHYLEPYLHYFLYHWITGYSSPIFYSHSKRETNKCISGLQCSI

SEQ ID NO: 109336 - protein, 80 aa, Triticum aestivum
  Clone ID: PAT_TA_3754.pep
ASQLGPVPPRPVLVDNTEVSAVGFAEGVGVIFIKTRVGLYTIQLKSEQSNQVHRGYINKVMPYVSFYTGAWEPLPASDEA

SEQ ID NO: 109337 - protein, 292 aa, Triticum aestivum
  Clone ID: PAT_TA_3755.pep
MASESAAAAASASSPAAARAGGGKDDELADLVRRIVDVLSRYSDRLPFDLDRQKLRSLTTLAAIAITIVFAWKLLRAPPEQPRRQRRRDAPSSSNTSSRSQPGALVGTDACSSVDSRAHEAINQLFQPVNLTLEQLVRHKLSEGRRVTCRLLGVILEETTPEELQNHVTVRPSVLEVLLEIAKICDVYLMEHVLDDESEEKVLSALSEAGLFTSGGLVREKVLFCSTEIGRTSFVRQLEPDWHIDSSPEIVHQLSRFIKYQLHISPQQTERVSPNVFSSASLEQFFGGLDQR

SEQ ID NO: 109338 - protein, 166 aa, Triticum aestivum
  Clone ID: PAT_TA_3756.pep
DLDASLQNFSRLPKLMSIGTSACDSEEYFPLPSPSEDGFPFISASIESCSLSTSIEDCPFESSMVWDMLSSLSSNCIWSRSGSVPFADCPLSLGGSSITQAQAVKTLRRGGAERRRGAEETPVASAGRGGAPAVGAPEGWVGGGEGGAGRRRRGLNGGECAARPNR

SEQ ID NO: 109339 - protein, 184 aa, Triticum aestivum
  Clone ID: PAT_TA_3757.pep
MQTAMASVSTFIAMFIIMLAAMSSGILVAYANTEFISRTCNKTNNTALCIAVLTTKPQSAHASTEHDLARIALELTIDTAKHNVKVINDLDKKKQSKPKAFALAICLKAYTEATSALEIYAVSNFQMGSYPSTLANVSFAMGASDTCKKAFKRIGKESPVSYIDREMIEHCSVASNLINLLVRK

SEQ ID NO: 109340 - protein, 402 aa, Triticum aestivum
  unsure (1)..(402): unsure at all Xaa locations
  Clone ID: PAT_TA_3758.pep
MGAGRGSRPDSIQTPTLAATKRHAAPLPLAAAVLRLVGALLASAAPGFDYAAAVYVCPANSDTGGCNVGDFEPKPRGHGATVFGPPSPPFXPPRLTLHLPADATDMSFLNAYLMPFVAPYFRAGXNFAHAGCSITPASATSVSPFSFGLQIKQFFAFKEKVTRLLSQGDRYRRYIPQLDYFSKGLYMFDIGQNDLAGQFYSRTEDQVIASIPTILSEFETGLKALYDQGARKFWIHNTGPLGCLPQNIALFGKDPTQLDELHCVAKHNRAAKIFNLQLHALCTKLRGQFAGANITYIDIYSIKYALIGNYSRYGFESPTQACCGYGGPPLNYDGRVPCGQTKSVNGKLVTXAKGCSDSTEYVNWXDGIHYTEAANXNVTSQILTGEXQSVRPTRAIPYKTES

SEQ ID NO: 109341 - protein, 276 aa, Triticum aestivum
  Clone ID: PAT_TA_3759.pep
MAGAAPSEEALRRALAERQTAVDAQADAVRSLKASGAKEGVDAAVEALKALKIEAGAAARRLQAAVGSGGGAAREEMRQAVGNTLERKLFYIPSFKIYRGVAGLYDYGPPGCAVKSNVLAFWRQHFVLEENMLEVDCPCVTPEVVLKASGHVEKFTDLMVKDEKTGTCYRADHLLKDFCKDKLEKDLTLSPETAAEFKRVLAVLDDLSPEELGAKIKEYGIVAPDTKNPLSAPYPFNLMFQTSIGPTGLSVGYMRPETAQGIFVNFKDLYLGRDHA

SEQ ID NO: 109342 - protein, 150 aa, Triticum aestivum
  unsure (1)..(150): unsure at all Xaa locations
  Clone ID: PAT_TA_3760.pep
RRQHAAGGGDADHHAHXQLGCSVPGGYWQDTLAADGKQKPHEAGDPIMRDKHPQRYWVFMAASWMGFLASMMXTLSLLVRLPVDSRQVRWSFAVAYSSLVLTFIVSQAKTHISIDIVIWLVTVVFLWLMISVRPDHRERIPRFFCCNREK

SEQ ID NO: 109343 - protein, 137 aa, Triticum aestivum
  unsure (1)..(137): unsure at all Xaa locations
  Clone ID: PAT_TA_3761.pep
GSGDAKPKFMKRTAHRLKTLWARHDIATQIKELKARVMXESERRDRYKLEENYYSATKTVGIDPITAIHEEVKGLVAMDGPMKHVIALLMDESKELKVVPIVGSGGLGKTTLAMEVYRKIALGGDSQCQACVSVSRT

SEQ ID NO: 109344 - protein, 293 aa, Triticum aestivum
  Clone ID: PAT_TA_3762.pep
MDVKYPSGSVKKVRQAAVAPAVQEAKYNECGRNHALASGGHVVDGCGEWMPLRDLNPADASSYKCAACGCHRSFHRKVMTERSPMLAPMVETVLHGLPQRRKEETPEDWLPGVDSDTNSDGMKYDSDATEYDSEGTEYDDERSVPQPLQPPPVYHPAQVTQQLSSGQHNFLPRALQIHRLATQLSPATAPPPHGVMLERKRSRTTTDQKLRMEELSEHLGWRLQKRDKDFIEARCHDIGVSKKVFRNWMNNKKRKYPSGHNPSAAASSVVEPSRLLSPHHHHTTSVRINLVCV

SEQ ID NO: 109345 - protein, 99 aa, Triticum aestivum
  unsure (1)..(99): unsure at all Xaa locations
  Clone ID: PAT_TA_3763.pep
MYRAKRAALSPKVKRRVGKYELGRTIGEGTFAKVRFAKNTETMEPVAIKILDKEKVQKLRLVEQIRREICTMKLIKHPNVVRLHEVMGKXARXFIVLEY

SEQ ID NO: 109346 - protein, 411 aa, Triticum aestivum
  Clone ID: PAT_TA_3764.pep
MTAIKEPLGSSSLTFGCGKECIWLGQIRCQNSSSTVSEHTNAGRPLGVRECKDRSFIVLEYITGGELFDTIYTNGRLKEEEARKYFQQLINAVDYCHSRGVYHRDLKLENLLLDAAGNLKVSDFGLSALTEQVKADGLLHTTCGTPNYVAPEVIEDRGYDGAAADIWSCGVILFILLAGFLPFEDENIIALYKKISEAQFTCPSWFSTGAKKLITRILDPNPATRITIPQILEDPWFKKGFKPPVFDDKYETSFEDVYAAFGDSEDQHVKEETEHKPTSMNAFELISLNQGLNLDNLFEAKEEHKRETRFTSQCPPKEIISKIAEAARPLGFDIQKKNYKMRMENPKAGRKGNLNVATEVFQVAPSLHVVELKKAKGDTLEFQMFYRSLSTQLKDVVWKCGGEVEDNSTAA

SEQ ID NO: 109347 - protein, 318 aa, Triticum aestivum
  Clone ID: PAT_TA_3765.pep
LRLVVDSLSRVDGIGEALLVVSHDGYFPEMDEIVKGIAFCQVKQIFAPYSPHLFPDSFPGVAPGDCRDKDRAAEKRCRGEPDQYGNHRSPRIVSLKHHWWWMMNTVWDGLEETRDFDGHILFIEEDHYIFPNAYRNVQLLVDLKPKKCPQCYAVNLAPSDVKAKGEGWESMVAEKMGNIGYAFNRTVWRKIHAKAKQFCDFDEYNWYITMWATVYPSFEAPVYSLRGPRRSAAHFGKCGLHQGQDSSSVCVDNGVGAVELDAIDKVPNIKADWPVHIIRKQPGYQAGFKGWGGWGDRRDRELCLSFAYMYHVKDTLSA

SEQ ID NO: 109348 - protein, 100 aa, Triticum aestivum
  Clone ID: PAT_TA_3766.pep
VCGIARSLRRSIFAWMVIPGDMEVDKVKMASLCLILLMALLLLPAGSEGHCRRLSQTYPTSQCKGDQCTEDCEHEGYPYAECDTDHQYPELSYCACFFPC

SEQ ID NO: 109349 - protein, 304 aa, Triticum aestivum
  unsure (1)..(304): unsure at all Xaa locations
  Clone ID: PAT_TA_3767.pep
MAKDNDNNAPPATSSDSMSSGKGSKGSKASSRLVLGGAIDKGKGVPKVEEEEEGCRSKGKIMTAPVVAARSDGRSGGRRGDRELHIITERERRRRMSEMFTKLHGLLPTLPDKVDKSSIVMEAIHYIKSLEGTVSELEKAKAREGFSQQEASSPXAANDGVSSSVAAAMPMGMATPGDWAVGWWDLADXAAQAPSMALGAVTVAPAPVPLQTWSGPNVVLSLSGNYAYIHMSVARRPGVLTMVTAVLEKHGIDVVTTGISSDRSQCMYTIQARINGMSNQFGDTVACDDIYKLAVSEIMVWLSD

SEQ ID NO: 109350 - protein, 230 aa, Triticum aestivum
  unsure (1)..(230): unsure at all Xaa locations
  Clone ID: PAT_TA_3768.pep
APLQLEARSAFHPSRAASSANVDGSSPDSSLDSPDLHLYRFSGVSSATEDLQLVALTAPGSTPHHGIQLSRSTSDGYEASGVSLNPVAKISTDAIDSNGNXTWSSLAPLQLEARSAFHPSRAASSANXNGSSPDSSLDSPDLHLYRFSGVSSSAAEDLQLVALTAPGSTPHHGIQLSRSTSDGYEASGGEDSDRIPSRIVHRSSNWASIILSTDQGVPSSGALVPKNRLP

SEQ ID NO: 109351 - protein, 281 aa, Triticum aestivum
  unsure (1)..(281): unsure at all Xaa locations
  Clone ID: PAT_TA_3769.pep
PLLVRRIRRPAGLPAGRHVITAQPPNGDGSDGGAVWLPKNRCCGTRPFSSMIPPGSSPLFMAGKGCGACYDVKCTSNSACSGVPVTVLSPGLRPPDLQSHVHIRVDARGAIAKPGMADNLPDDLRAGSLFRMVHCRLPCKYPAFNVALRAGPGLLPPLIEFEDRVGGRRPRPLSRAPRGARPPLPHAHGAELGRAVAPQLRXGMPLPRPRPLRLTSDSGRKLVVNNVIPASCAPRCNLPSVSLPPYLPAPCVNFIYREKKECASGCCERRRRMREEGLAEL

SEQ ID NO: 109352 - protein, 349 aa, Triticum aestivum
  unsure (1)..(349): unsure at all Xaa locations
  Clone ID: PAT_TA_3770.pep
VRCDLVSVPARVPPPPMLLWHDAGKVKNCAPCVGQWNMINKKMINGGIIDNWACVSFSRMRPEEVHRFCCDLIQMCNMTGMLVHPRPLVDNRSACPIPFENALRDLSGRTTEMPGKQGPKIQLPLLTVXGIYGQLLLALPRNACRTPLTSQISKLSLILRRRSPGLRHGSDAGSTPGASLQEGYMPPVTFVVVQKRHHTRLFPEVHGRRDMTDKSGNILPGTVVDLMICHPTEFDFYLCSHAGIQGTSRPTHYHVLYDENHFTADALQSLTNNLCYTYARCTRAVSVVPPAYYAHLAAFRARYYVEGDRSNGGSTPGSSGQAAIAREGPVEVRQLPKIKDNVKDVMFYC

SEQ ID NO: 109353 - protein, 196 aa, Triticum aestivum
  Clone ID: PAT_TA_3771.pep
MAERGDNMEAETMPGDSLAMNLLRIAIYNISYIRGLFPENCFIVKSIPDIGIEIQMLMHIDPEIRRVIDLLEKGVYDALQKNYLKTLLLCICEEEGEIIEEYAFSFRYPNLNREDVVMEVNLTGSEKNGIKFKSNAAEVTPDHMRSVACKLIRTLVSLMSTLEELPDKFKIQMKLLYYDDETPENYDAPPFECCTG

SEQ ID NO: 109354 - protein, 531 aa, Triticum aestivum
  unsure (1)..(531): unsure at all Xaa locations
  Clone ID: PAT_TA_3772.pep
PPELQHAVIPEXPTFYPECRPQETEPLVATLRDVTDPVDRXEQSLSCLVRDDPYGRFSWTDENXAFLYWKIRDLAYAYQSGITTPTAITTLAIAGVEESNNNKPPMPMLISFYAFDRRKQADASTKRFEKGSPISGLAGIFFAVQLDVDVIATPTTGITAPRIPPSALKGESDYIVSAKLMQFIVAGNLLGFPAITVPVGHDKARPSYRLAXLIGRPWGEDSLXADGFGSIGTSSXREGIVRSKISVILKDMTGVVCDAGTVEVASPLTSXVEDSVLLYSALXGSRPMDKLTLRPSLLCVPNLVSSENSKILQSVKVGKYTEWFHDVPDNEVSNTCEDALNLLCSTFGCQIEEIILPELEEMRTAHLVSIGSEAFSDMNAHYQAGRRTEMTLDTRASLALFKSFTSADYVAAQCLRRRIMYYHMEAFKKVDVIATPTTGMTAPKIPPSALKGESDYVVSAKLMQFIFAGNLLGLPAISVPVGHDKQGLPIGLQLIGRPWGEASLLRVASAVEELCLKRRSRPSTFYDILKT

SEQ ID NO: 109355 - protein, 94 aa, Triticum aestivum
  Clone ID: PAT_TA_3773.pep
HPLLRPPSRSPTRGAVEQHEPSTPSWCSRVATLVLVMLLVKVPYLKHNLMLPLTVLARKGTRGQRHGHTSQFRWMIRIMQTATKFVSSCSRTMS

SEQ ID NO: 109356 - protein, 262 aa, Triticum aestivum
  Clone ID: PAT_TA_3774.pep
MQPPSQYHQSSYYAVLGVHPGASAAEIRAAYHRLAMRWHPDKIANGRVDPAIAEEAKGRFQKIHEAYQVLSDQKRRELYDAGMYDPLDDSQQEVEGFHDFLQEMLSLMATVGREEPVYSLGELQSMLDGMMQDFSSPQPPPPSSFFTSTGSSTRFSAPSGGAQQQRRPPSRVRPQGFGSSACFGQAACSRGQAPARAPPRSLRPGARPPGRHGRRRGRTLLQRRGRPRSGSVGRCSGAHSRCPCAPPARPTSRVRKPVVRSS

SEQ ID NO: 109357 - protein, 457 aa, Triticum aestivum
  unsure (1)..(457): unsure at all Xaa locations
  Clone ID: PAT_TA_3775.pep
PGNYGTAIVRHAAEDGARGGGSRAAAAADQRPAGPRHARPTAAAGXTAALPPPATPGHAHPGLLAAPHIEPIVSGNLPPGFDSSTCRSVYVGNIHLQVTDSLLHEVFQSIGPVEGCXKLIRKEKSSFGIADYYERKYAVLSIMSLNGILLFGYSNKIQLGIFKYPREVKHPVIXTSSVGNLWPMFTAAALFAFFSAYSTSSDARVMWDQQTGRSRGFGFVSFRNQQDAQTAINELNGKWLGNRQIRCNWATKGANAGEEKQSTDSKGMVELINGSSEAGKENANEDGPENNPQYTTVYVGNLPHDINSNDVHRFFHLLGAGSIEEVRVTRDKGFGFVRYSTHEEAAQAIQTGNGQFIGGRQIKCSWGSKPTPPGTASAPLPPPALAPYTPGVSAVDLISYERSLALSKMAANQALMGQHAALRQAAMGMGAGASQAIFDGGFQSVNPQQQQQQLMYY

SEQ ID NO: 109358 - protein, 114 aa, Triticum aestivum
  Clone ID: PAT_TA_3776.pep
GIHKLRRQPWTMNISLSPTRKSSCCTSRCGRDRQCRKAAAAPPEPHAASVGTYVGERPLRPRPAGASPPGSRVGVFACRSSRRRRSSLQRRRLPGPRGGSCGGGGGVAGWAALA

SEQ ID NO: 109359 - protein, 130 aa, Triticum aestivum
  Clone ID: PAT_TA_3777.pep
AHLYFFSTHNCNLTRSRQHFVPSMPLLGSYCPALCPSNLLLPATLAPPHAAHFPFFHNYYLKLSHLPPACAPRAREDAASPPEGAHGPPWVAPGALHSHGTRPEALFPLTGRGPAWFLRCLLSCLDPNIR

SEQ ID NO: 109360 - protein, 313 aa, Triticum aestivum
  unsure (1)..(313): unsure at all Xaa locations
  Clone ID: PAT_TA_3778.pep
NQTRMSLDTGDGPGKIFPGLDSLMSHSRNSQPAQLSNGPKAPVAKLFEQVGLQKILSLLESEEPDVRVHAVKVVANLAAEEANQEKIVEAXAALTSLLMLLRSSEDETIRRVAAGAIANLAMNDSRTNQDLIMAQGGVTSLSMTAXSDAEDPQTLRMVAGAIANLCGNDKLQTRLRGEGGIKALLGMVKCGHPDVLAQIARGIANLAKCESRAATQGNKGGEIIMGGVDGALPWIVKNANNEAAPIRRHIELALCHLAQHEVNAKDIVSEGALWELVRISRDCSREDIRMLAYRTLTSSPTLQSEMRRLRIEC

SEQ ID NO: 109361 - protein, 144 aa, Triticum aestivum
  Clone ID: PAT_TA_3779.pep
TITQQSRISPHSSSAELYRVVHHALQDGEHNTKARLREHDVGTDLAASVASQAVLPLRSWLRYCTTMYGSIFPRTPLPAPPVKLPAARTAGQHRRGWEQHAPRLQPAVGRPPEAARAGACWHQRAEGLSPGGAGAAAPTAPQGR

SEQ ID NO: 109362 - protein, 170 aa, Triticum aestivum
  Clone ID: PAT_TA_3780.pep
GFAKSGGCGSGCGGGCGSGCGGGCGAMVIEGSKIGFAKSGGCGSGCGGGCGGMVMEGSKMRHAKSGGCGSGCGAGCGGGCGGMVMEGSKMSHAKSGGCGSGCGAGCGGGCGGMVMEGSNMSHAKSGGCGSGCGAGCGGGCGGMVMEGSKMSHAKSGGCGSGCGGMLNTAS

SEQ ID NO: 109363 - protein, 291 aa, Triticum aestivum
  Clone ID: PAT_TA_3781.pep
ILCANLTYNGQEEFYTAEAMIKLINTSDEWYYIGCRRCNKKVQKQGNHFYSPKCEKEPEKICPRYKQKLEICDMSATTTCTMFEAEAARGFLPSARVLIESEDGMSVSKHHNSRVLGGTGCSRHAVRSAVVSGGLHGHVVHGFFSVVAGEATSVRLPNVGQEQAGKLSVMKTIKQEPEDDEPTINRTKRGRRSSTTHVVHLDEEPKTEGSREIMKSKSMEAGPKRKRAVTRKCAGIDSKQVNNHHEEESEQAGTEEHNDSRPRTRRSCVSKELMNKDIQKCGVSRSRKSNR

SEQ ID NO: 109364 - protein, 124 aa, Triticum aestivum
  Clone ID: PAT_TA_3782.pep
QQYSAKDELHSKNTDSLGFGLPRSWCGSSVAPVSQIPSLPLPHPSFLIFFTTPPLPRVRVVTRAPGRHGQDGHFLPCAGHHGVARSGHGRRLPVTRDGLSCHLEAIARRMNKEETTVGGELGGV

SEQ ID NO: 109365 - protein, 235 aa, Triticum aestivum
  unsure (1)..(235): unsure at all Xaa locations
  Clone ID: PAT_TA_3783.pep
PVYNHDELFMPRSVSRVEFDHRNREYYLPPLLTNIGSEAVDDVKKNSIVIHKTHFTKDWITLLRARASEGLDRPFSRFETILAHLWRAMTRARGLGHNETSTIRLSVDGRDRLGVPAEYAGNLVLWAFPQATAGDLLNRPXKHAAQVIHNXVARVADADYFRSFVDFASSGTVEEEGLAPSAALNLREVLCPDLEVHSWLTFPFYDLNFGTGTPSYVMPSYFPAEGLIFLMPSYI

SEQ ID NO: 109366 - protein, 300 aa, Triticum aestivum
  unsure (1)..(300): unsure at all Xaa locations
  Clone ID: PAT_TA_3784.pep
MWPGCGGRFYWAPAPPSGARGVVVVFAWVWSDEAQLRPFVELYASLGWRCLVCHPDLVSLYLSEKAATLACGVISELAKELKVKPLPTVLASFSGGSKGXMYKVIQLLDGRCEGDAMMKDYRLVRNCISGQIYDSGPVDFVSDVGTQFLQNPVIGASAQPSMLRSLMAKALASGMDTLFPSRIEAQRAEYWHTLYSSAGLGSVLIFCSEGDDLAPCHVVCGFARRLVELGTDVKVIKWSDSPHTGHYKLHEVEYRTAVDDILKKALVTFCHRSQLKGTSAWDQEYKIAHCVCNLHNVAAN

SEQ ID NO: 109367 - protein, 189 aa, Triticum aestivum
  Clone ID: PAT_TA_3785.pep
IFRKAYASRFCPEDEAPPANIVPKRPQPTDGGLPRGPQSRARQWRGTRRRGRRRGAQWAGRTGRGRGPWSRRRGRAGAPAEKGRAADEAQAAAAEQNIFSGHFTAVCSYPVRRQQKKILPSPQERRSPQSLSIATARSIDHNQTFSASLRSGRNARRFSSWGSQKPFHLPHLSLAHGQRIFLQRRGKSP

SEQ ID NO: 109368 - protein, 200 aa, Triticum aestivum
  Clone ID: PAT_TA_3786.pep
FLRLTGPVRAIVSMETVHIEIQLTVKGATKSEDRALISTFYFYNGDSSPQVAENSFCTVELCNEQLKQSVQATSLSVFVRAEAGSLPFPNGARVVCSSLPQDVDKHIAGPSSRQVVVLDLKGGMAKPGYLDLTRHVVSVELNGQLKVLMETFSPSQSVESTRVLFIPPRKCNISKHEGNFGGYEVEITIAWSLIPSKMLS

SEQ ID NO: 109369 - protein, 403 aa, Triticum aestivum
  Clone ID: PAT_TA_3787.pep
NPNPAKENPSPAMAAALPDWMMLERFVFCRESLLDSEAAPFIKADGTSSHGGSFSVAFLVLQPPGISRLYLQWPGGPKGGSQCVLVAAHRNLVLFRLTPDPVITRKAPFVDYRQDHFICGAQFSPSQRSLLLRKIPKCDQPALVDWRDGEKVTMPRSFDLNPVSILCRGDEEFALAQLNLRRSNDEWGKIEAELCVLRSKVSNRLHEWKSEKWLPIQYEGHERSDLDSWRTDRVVPFNKFLCWVNYGGGGILFCEVFKQKPNIFYLRLPIIAPRLHQCSLRFQEASRAVGVTKGSMGCDELRFVDVVCKDGNIIDPLGYGDNEGFTITYYALRITQSGGMEWDMLFFIRCYELWSINPQLPHELLKHPVVSMEDPNVVYFLMSERLEHVDKVSVVTLDMCTKK

SEQ ID NO: 109370 - protein, 195 aa, Triticum aestivum
  Clone ID: PAT_TA_3788.pep
MAKQHYATSSLVIGYALCSSLLAIINKYAVTKFNYPGLLTTLQYLTSAAGVWALGKLGFLCHDPFNLETAKKFAPAAIVFYLAIFTNTNLLVHANVDTFIVFRSLTPLLVAIADTTFRKQPCPSKLTFSSLVIILGGAVGYVITDSAFSLTAYSWALAYLVTITAEMVYIKHIVTNLGLNTWGFVLYNNLLSLMI

SEQ ID NO: 109371 - protein, 223 aa, Triticum aestivum
  Clone ID: PAT_TA_3789.pep
ACKPGNDEQRPVQRRSWRGGGSEVSAAAIFGGNFVGGDHISQAGMYNDQAPMLPQMSATALLQKAAQMGATSSPNGAASMFRGFVGSSPHARQGTPQQQMDQNDANLNELMNSLAAGGGVNAAAMFGGANGGPAGMFDPRMCDMDQHEVKFSQGGGGVGGNGGGAGGGGGGGDMTRDFLGVGGGGIVRGISTPRGDHHQSSSDMSSLEAEMKSASSFNGGRMP

SEQ ID NO: 109372 - protein, 132 aa, Triticum aestivum
  Clone ID: PAT_TA_3790.pep
VGALDEDGLVALRRRTGMVFQHFNLLSAKTVFENVALPLKIAGVPKAERTRKAEALLELVGLAAKRDAYPASLSGGQKQRVGIARALVHDPEVLLCDEATSALDPETTQSILALLADINRRLGLTIVLITHE

SEQ ID NO: 109373 - protein, 304 aa, Triticum aestivum
  Clone ID: PAT_TA_3791.pep
MPQRHSKNNNDLAFFTYEEKRKLGYGTQRERLGKDSIKPFDACCLCLKPLIDPLACPKGHTFCKECILECLLAQKKDIKRKLIAHDSQKKQEKEEEEEKLVLQKSKELDAFDQQNHGAVPQYYDRSGSQDKNGFHGANSVKTTSFEEEALRTMKAFWLPSATPEATVKVDAPSTDTICPEGQEKLKLKSLFPISFTEENARQKSSKSVEKSYICPSCKSNLTNTMSLVAISTCGHVFCKKCSDKFIATDKVCLMCSKPCKERNLINLEKGGTGFAAHDDHLEAKNFKHLGSGSGLGLVKPAPKA

SEQ ID NO: 109374 - protein, 84 aa, Triticum aestivum
  unsure (1)..(84): unsure at all Xaa locations
  Clone ID: PAT_TA_3792.pep
PRVRHIQFILASSILGAGSFGIPIPDWVNNIPDWVTFGIPXTGLADIVSKVAVPEFEPKSGVKIETDEXATNLFSASVDDTVVI

SEQ ID NO: 109375 - protein, 278 aa, Triticum aestivum
  Clone ID: PAT_TA_3793.pep
IRHEGKPKRKLPASPSRRDSPLEPYHGHAAPSPAQCLAVRDALLAFHGFPDEFAPFRLLRLGLSPEDEGDQPAPRPTVLDGLVTTLLSQNTTDAISRRAFASLKAAFPSWDQVVDEEGMGLEDAIRCGGLAATKAARIRAMLRGVREKRGAICLEYLRELSVDEVKRELSQFKGIGPKTVACVLMFYLQKDDFPVDTHVLRITKAIGWVPPTATREKAYIHLNNKIPDDLKFDLNCLFVTHGKLCQSCTIKLGVQKPKDVKAVCPLASYCCIKEEIQE

SEQ ID NO: 109376 - protein, 207 aa, Triticum aestivum
  Clone ID: PAT_TA_3794.pep
LRRSIRSRPPRALSQHPVALGLSRHQTSRQHACGGAAVDRSPVAMLRCSVCAEARSSAPQGSLTGRCNGASPAAPEAAMKLHQRHNGASPVSQELRCSGQCCNGAPPRLGLQRSFAGTPRAGGCNGERRLQWSSVTVAMELRRDADGAAWSFFSRHRAAMELQWSFPGGRRCSIEALFSIGSGVAALVLRRWLRCCCVGALPMAPVV

SEQ ID NO: 109377 - protein, 410 aa, Triticum aestivum
  unsure (1)..(410): unsure at all Xaa locations
  Clone ID: PAT_TA_3795.pep
MAAQNYGELYNILGWGEPYFTVNRDGHLCVKTHGHETKPGQEIDVVSVAEAAKEKGVQFPMILRFPDVLKHRLDSLHVAFEKAIKHTGYTAPYQGVYPVKVNQNRAIINDFVSFGHRHSYGLEAGSKPELLIAMSYLTKAKPGAFLVCNGYKDADYVALALSARAMGLNVIIVLEMEEELDIIIEHSSKLGVEPVLGVRAKLLTKIPGHFGSTAGKHGKFGLPADKIYEVANRLRHLDKLHWLKLLHFHIGSMIPSTDIVSRAATEAAGIYCTLVKQYGAXWTTLDCGGGLGVDYDGTRSGSDMSVAYGLEEYASSIVQAVRVKCEDNGVDHPVLCTESGRAMVSHHSMIILEALSAIPEPKDDEETTPEELQAMIDDLSSKKWLKGDDDAAVAKPMSSHAAEIKEHGIE

SEQ ID NO: 109378 - protein, 217 aa, Triticum aestivum
  Clone ID: PAT_TA_3796.pep
MDRFRPLRRIQVEPERADPPPPPPAVAIGEAAEMVPAPAAGMLMGAKVRRRAAVYRDCMGDYIGVHNDPCLAKILAKQGDNKVLFADKVLKFTQSGKMKRRILVITDFALYLVDPDADILKRRIALAAVDKLCISKLSDNFFAIIVPTEYDCLMASTRKKEIVDVIVKAIQSTSEYEPEVASSNRFEYHAAAEVIKEVEFEEADGRIKTRITLKEKP

SEQ ID NO: 109379 - protein, 304 aa, Triticum aestivum
  Clone ID: PAT_TA_3797.pep
MEKKGALDLNIFSEIHDILAHHVDHVGSQSEEPHCLPETFPLENLRSDHLELQHVALLISEISGISKSDIKKITSELIEGLENARVDDSAKPTNGDSKTSDEAKDSPDSVKKPDTVAMPEDFRCPISLELMRDPVIVSTGQTYERAFIQRWIDGGNRTCPAALLPLRHPSLAPHHAARSLILQWCEEKGIEPPTRSKYEGSSVEVGEDRLAIEALVRNLSCSSLDERKSAAAEIRSLAKKSTDNRMLLAESGAIPALVKLCPQKTQNEHQFISFESLIYDKTRTDGWRCQCPIIQCLGRYMEEK

SEQ ID NO: 109380 - protein, 300 aa, Triticum aestivum
  Clone ID: PAT_TA_3798.pep
MMATMGRPTGISAFTVPMHTFENHKLSDRGLSKLLLINELDESLLLVGSSDGNVRIWRNYAQKGGQKLVTAFSSVQGHRAAGRSVVIDWQQQSGYLYASGDMSSILVWDLDKEQLLNTIPSSADSGISALSASQVRPGQFAAGFIDASVRIFDVRTPDRLVYMARPHAPRTEKVVGIGFQPGFDPYKIVSASQAGDIQFLDVRRAAEPYLTIEAHRGSLTALAVHRHAPVIASGSAKQMIKVFSLEGEQLTIIRYQPSFMGLRLRGLNCRSCRPCQSLLAAAPAVMARASIHADGYSHAA

SEQ ID NO: 109381 - protein, 190 aa, Triticum aestivum
  Clone ID: PAT_TA_3799.pep
PVTGFRDWARHLSVVSRPWCGSDVSQGQLSASVPRRLRWRPIVISLDPRSGSVPPGLGRLPPVGPGALGVFRPSACAYVCGGWSPAFAVSAFAYHRPHAPRGSTSTSGGVPPPSGRRRFPSRAGCASPAPTVARAFPSARGLLTHVMSLTPAKVSVTRPFPASPAGFGEIESLHLSGNRLNGLIPWQLTP

SEQ ID NO: 109382 - protein, 122 aa, Triticum aestivum
  Clone ID: PAT_TA_3800.pep
ITLSCGRLDLAVPAPARFPFYPVFSFFVVSTLIHVSARAPLSSSPGVKFCLPCTLIHVYIGSPLYLSVAANFSLTRFVGRGMPRFAVCRSMPASPLRPGVMEIVILCLEYVSPYARSSFQLG

SEQ ID NO: 109383 - protein, 107 aa, Triticum aestivum
  Clone ID: PAT_TA_3801.pep
MPPSAATPVLLLLLLLLQGRGGHGAIGISSLDMDMDMDMGVEAAAHGRLLWASGGGRRYISYDALRGDAVPCSRPGVPYYNCRVSTTANPYSRGCESITRCRDDDPS

SEQ ID NO: 109384 - protein, 189 aa, Triticum aestivum
  unsure (1)..(189): unsure at all Xaa locations
  Clone ID: PAT_TA_3802.pep
SLRLEGDFAEIPSLLLENWCYESISLKMMSGFYQDITKSVSTEACQSXKRRRDMFAGLKLKQEILLCLVDQIIHTSENVDIDELIKDLHPKVILGIPLLEGTSPASCFPRIAVGYDAVCYSYIWSEVFAADLFATKFKDDLLNQHAGLRFRNKVLAPGGSKDPLEIITDYLGREPSLQPFIQSRTRNAL

SEQ ID NO: 109385 - protein, 136 aa, Triticum aestivum
  Clone ID: PAT_TA_3803.pep
PLRVTVAPAGARPVPNAAAVALLKLVEGKCLTVHVYNTDRYGRSVGDLHVGGVFVQEQMLKKGFACPDPAGHKRPELAKWQSQAQAARKGLWAASKPQDPWEYRKAKRNGSAASISSGRTQRASGPICCNCCVYVL

SEQ ID NO: 109386 - protein, 184 aa, Triticum aestivum
  Clone ID: PAT_TA_3804.pep
PLSPGPPSRPGLSSVEGQGGICALLNDVDHAAVMVLDRWNVTIKEKNGPQGQCIKQVKFMTNYLGIGCDAKVAYDFHTTREERPDKFSSQFVNKLIYAREGAKDMMDRSCSDLPWHVSLEVDGKNIEIPEDAEGVIILNIASYMGGVDLWQNDNDYDDDFSSQSMHDKMLEVVCISGTWHLGKL

SEQ ID NO: 109387 - protein, 324 aa, Triticum aestivum
  unsure (1)..(324): unsure at all Xaa locations
  Clone ID: PAT_TA_3805.pep
DCPSRTQTGTWXLIATXQXXSXKEVTCSKKMAGIRSCLXQXYAKDIXXDEKQELXEALQREIQAAFRTXDEIRRTPRTPQDEMRAXMSXFHETIWKGXPRFLRRVDTALKNIGIKERVPYNAPLIQFSSWMGGDRDGNPRVTPEVTRDVCLLARMMAANLYYAQIEDLMFELSMWRCSDELRVKADQLHRASKKDTTKHYIEFWKQVPPSEPYRVILSDVRDKLYNTRERSRHLLAGRVGEIPDDAIFTDVEQFLEPLELCYRSLCACGDHTIADGNLLDFLRQVLTFGLSLVRLDIRQESERHTDVMDVITKYLGVGSYREWS

SEQ ID NO: 109388 - protein, 178 aa, Triticum aestivum
  Clone ID: PAT_TA_3806.pep
EHQYVESSEFRLQKPLNHASSRRGTCTVASEVTGVAAGESPAKPACSSIRSSARRSPEKEKCPPSISRAFRVLGTTFSSIRQRLRDSVRVLAASSLYTLLFILSGSSCDMVCWRSYRRRGRRARCAAGAGGRRRRRGTAAAAGGGARTRRAASPSACPRAGRGRGTGRGTAAPRGRPP

SEQ ID NO: 109389 - protein, 164 aa, Triticum aestivum
  Clone ID: PAT_TA_3807.pep
AAAAGRRHDCRGGAGGRRGRLAGLSGGRRAPPRGAEEGPEREWVDWEDLILEDTVPLVGFVRMILHSGKYSSGERLSPEHEKAILERLLPYHPQYKKKIGCGIDYITLGLHPEFENSRCLFIVRTDGEQVDFSFWKCIKGLIREKYPLYADSFILRHFRRRQDY

SEQ ID NO: 109390 - protein, 118 aa, Triticum aestivum
  Clone ID: PAT_TA_3808.pep
FGPERGRLLTGRILYGPLLGPEHGRPLMDRINYGPAFGPKHGSQLMGRPTRVLKIFWAYSWAGPLMSAKSHGPLAGPARYDPQEFCGHLPGPAHYGTQKSCGPLPGPAYYGPRNLVGL

SEQ ID NO: 109391 - protein, 77 aa, Triticum aestivum
  unsure (1)..(77): unsure at all Xaa locations
  Clone ID: PAT_TA_3809.pep
MAKCFAVALLLLVVLASCEGRELNGKDSALAATRGAGAGGGVGESKILGLPXELPLTTTITGPVVVLPALPGIPAHP

SEQ ID NO: 109392 - protein, 139 aa, Triticum aestivum
  Clone ID: PAT_TA_3810.pep
PNPPPRLPRRPWPAPGGRRRARGARRRASPRLPPPPRRRPGQLRRRGRGVRGVPADSRRRDAAEEALGGSASLPRGGGVGGTSAQRAARPARRPGPAPRPRPPRPWLASPTIRSAWPSSTATGWGSPPQRTSHPPGWSR

SEQ ID NO: 109393 - protein, 137 aa, Triticum aestivum
  Clone ID: PAT_TA_3811.pep
NSLLFRALYIPPPQGSARGRVGALEEMLKRRQMERLPALHLAVVSLLGFCCLIHASRAAISFPPGNRPMPSAAPREQLQETETIPDSSGADGQVVVAGEVDRGAVSKRMEMEMQLEDYPGSGPNDHHSPWWRQERRN

SEQ ID NO: 109394 - protein, 156 aa, Triticum aestivum
  Clone ID: PAT_TA_3812.pep
MATPWDSSSSRLWGALGQASSVAQLVGVDALGLVSMVVQAALAARRHRDACVQLAQHVELVGGLLGELELDELMRREATRRPLEQLGAALRRCYALATACQDCGYLRRLLLGGRMADELCAPHHDVDWFCRLRPLTPLVPFAANSRRAMVNSIEIW

SEQ ID NO: 109395 - protein, 251 aa, Triticum aestivum
  Clone ID: PAT_TA_3813.pep
SILTGLAPGSPCPRNGDASGPGRPLRDGELVGLVFEFLGAATGSTAACLEWTLAHLIDLPPPLRRLRREIDAEADAGGMLSISSKSLRSGMPYLNAVVLECLRMHPPVPVILRSAHGDGATAIGGATAVPLDGLSVQFNLADIGRDAKRWTHPDKFWPERFLAGGEAEDVGPAPGPKEIRMMPFGAGHRHCPGVNMGMLHIKCFLAALVHDFDWAPSAAEDCSGGVDMTEQAGGFVKLMKKPLSARVTRRT

SEQ ID NO: 109396 - protein, 149 aa, Triticum aestivum
  unsure (1)..(149): unsure at all Xaa locations
  Clone ID: PAT_TA_3814.pep
MDGEEAHHRPSSSSSSGRPFLSGLCAAALRRKPISARASAAASGEGLVRQLGVLELVLLGIGASIGAGIFVITGTVARDAGPGVTISFALAGAACVLNALCYAELASRFPAVVGGAYLYTYAAFNELTAXLGFNQLMLDYILGHQHARN

SEQ ID NO: 109397 - protein, 252 aa, Triticum aestivum
  Clone ID: PAT_TA_3815.pep
AGDQAFDLVPVVFSDGAKCEMLLRDSEVLKPIPPFLFEDAPYFYYPSQRVRIVHPSVSKSGTWLSGSWRASRDEGVVSHVDVGLVHVNWITSVANVWGDRSSSPPNFQDSKNLTLLSCFPYANWQLGDWCTLSAGHDGSLPSEDRKFSRYSQTYVVAKTKSTFDVLWQNGSTSLGLEPYILAPVSTPGDHDFWPGQFVLEKLAVEEAAERQRIGIVRNVDALERTANVKWIVPVDDDIVRYGCDSTEETVSA

SEQ ID NO: 109398 - protein, 340 aa, Triticum aestivum
  unsure (1)..(340): unsure at all Xaa locations
  Clone ID: PAT_TA_3816.pep
MAFFSHHHLQQPHPAAPPPQQQQQQPAPLSFRNALPVPVDGQIPAPLAFFNAPPAFPDQAGQPQIVDAAGLTAAAGMGWRQPREQELLGENSQMSSXIDFLQTGSAVSTGLALSLEDRRHGGGGAGAGNSSGDSPLLLLPMLDDDISREVQRLDADMDRFIRAQSERMRQSILEKVQAKQFEALASVEDKILRKIRDKESEVQNINKRNLELEDQIKQMAGEVGAWQQRAKYNESMISALKYNLEQVCAHQSKDFKEGCGDSEVDDTASCCNGGAVNLQLMPKENNHPKDLTACRVCKSSEACMLLLPCRHLCLCKECESKLSFCPLCQSSKILGMEIYM

SEQ ID NO: 109399 - protein, 768 aa, Triticum aestivum
  unsure (1)..(768): unsure at all Xaa locations
  Clone ID: PAT_TA_3817.pep
DSCCSDLYGYFDFLSCRDXCDGDNKYQSEKSGLQDAKKGMLFIDFPPVLQLQLKRFEYDHARDIMVKINDRYEFPLQLDLDRDDGKYLSPEADRSVRNLYTLHSVLVHSGGVSGGHYYAFIRPTLSNQWYKFDDERVTKEDLKRALEEQYGGEEELPHTNPGLNMNPLKFTKYSNAYMLVYIRESDKEKIVCDLEETDINEDLKTRLRKEDEDKENKKKEKNGAHMFTTFKVARDHDLAAQIGRDMFFDLVDYEKIHPIRVLKDMPFNQVKEEFSKEFGIPVHSQRFWWWSKRQNHTYRPTRPLTQQEESYTVGQLKDAAIRMNSSELRLYLEVVQENHLTLASRTNDDILLFFKLYDPEKEELRYVGNLLLKASSTPSDIVPKLNEIAGFQPDEDIELYGEIKFEPNIMCEPVDCDVSFSLNQIADGDILCYQKRCSLDQHRHPNVSSFFEYVHNRQVVHFRLLEKPKQDDFSLELSKRSTYDDVVEKVAQHLGMDDPSKLRLTQHIPHLQQPKHQYIKYRSIDHLSDMLLLRNPNQMSDILYYEILDIPLPELQGLITLRVAFHQATPNEVLFHIIRLPKGSTYSDLIDDLKSKVQLSRSDAELRLFQVNNNKIWKVYLPTEKIDAVHDPNVPLHVEEIPEEEKSAGPRDRLVHVVHFFKDNQHIQYYGVPFFFLIREGEALSDIKVRIQKKFEVPDEQFLKWKFAYVAYNRPDYLQDSDIVLSRFQQKNIYGPWEQSLGLEHSDMPTKRANQNRHSFEKPVKIYN

SEQ ID NO: 109400 - protein, 266 aa, Triticum aestivum
  Clone ID: PAT_TA_3818.pep
LLYRKPLLGRPIVMDVFQDYILVTYSPFDVHIFHVMISGELSPTSSPVLQLSTVRELSIMSPKSPPVSMRLIPEPTDEGVLKRDTNESSNLSSQQPSRCLILRVNGELSVLDMDDGHEQALTNSVELFWVVGSQEEEKSNLIKEVSWLDYGHQGMQVWYPSHGANPFRQEDFLQLDPELEFDREVYPLGLLPNVGAVVGVSQRTSFSTAEFPCFEPSPKAQTILHCLLRHLLQRDKHEEALRLANLSAEKPHFSHCLEWLLFTVFE

SEQ ID NO: 109401 - protein, 78 aa, Triticum aestivum
  Clone ID: PAT_TA_3819.pep
NGPPLFFFFFFFFFFFFFFFFFFFFFFFFFFFFFFFFFFFFFFFKKLSIYPLRISINISYRWYQPHARGKCYITLLTR

SEQ ID NO: 109402 - protein, 70 aa, Triticum aestivum
  Clone ID: PAT_TA_3820.pep
GIALIDSWFHSTCGGADTNFSYLRGIWMLRIYTDQFNPCIDINLWHAPASTCCDESEGQNSLLEHTKLAV

SEQ ID NO: 109403 - protein, 141 aa, Triticum aestivum
  Clone ID: PAT_TA_3821.pep
EVGTSHPDRKDQRRRVLWGKCTCKEVGMTNADVCLGYFLCSVSYSAVTSVDGYEVPNAFLCTVISLSYNLLSPLCSRRGRSDCRVGSDGKFRLRNSSEFSTCFLKHFAGRGHDPGLLSLGFPEKSWADAPGAGAYPALLLL

SEQ ID NO: 109404 - protein, 228 aa, Triticum aestivum
  Clone ID: PAT_TA_3822.pep
MKKIFGAKKSRDPPPTIQDATNQINKRGESVDEKIKKLDEELARYKEQIRKARPGPSQEAIKARAIRLLKHKRMYEEQRNMLYNQTYNLDQVGFAADGLKDAQQTMGAMKAANKELKGMMKTVKIEDIDNMQDEMTDLMDVSNEIQESLGRSYNIPDDVDEEDLMGELDALEADMEFESAAVPSYLQPDEESDLNLPAAPTYPAAVPVSRHQEDELGLPPVPRASLRS

SEQ ID NO: 109405 - protein, 83 aa, Triticum aestivum
  unsure (1)..(83): unsure at all Xaa locations
  Clone ID: PAT_TA_3823.pep
TDCVFFGLWISVICICTSXEKMGHEVCTCLISVTLRASSCKYTSVVAAEVPAARTMITNHLRNTFAPAQRTLPKYYSVKAGYM

SEQ ID NO: 109406 - protein, 228 aa, Triticum aestivum
  Clone ID: PAT_TA_3824.pep
SKTIQSLQMVLAEKDSKISGIEPPSTGEAARLKATLEDIKGDLTHLKDQHEKERQSWEAECESLREKLEALESARFRSEIESAKFRNQLESELSTQNQLLQNKDSDLISAKEEISRLESEFSAYKIRAHALLQRKDAELSAAQNSDVLKAHEEAIREAEKEVAAALEERDEAIQDLQVAQCRHSEEIEARDLGLAELDKKLKNVMKKLDYVTSQFLSKKESWEKKLAS

SEQ ID NO: 109407 - protein, 378 aa, Triticum aestivum
  Clone ID: PAT_TA_3825.pep
SAPQKRRGRAGERRAARPRANPRRTAGATPPGGGQPPHRLVGFARLCRLQPPQSARSNCYICENGACGAGVYGHFCHDSNDRPDDLTQVCTFYQNGVCSYGSRCRYEHVEVSSEYTQPSTTAALAPSNSYLSWCPLCEGEIDVSNQTHKTLHPLAHLPICSFAAAGTCPYGKECPQMHGDPCTSCGKQCLHPYRPSEGGAHIKLCKRNNKRLETLKKSEEMECSVCLDRVLSKPTAAEKRFGLLPECDHAFCITCIRKWRSSSLTSSMDIDSTVKACPICRKVSYYVIPSATWYSSKEEKQDIIDGYKAKLKSIDCRYFDFGRDTCPFGGRCFYKHAYTDGRLEEPATVAVLHFHADNGSMEHARNIGLAYLLSRLHL

SEQ ID NO: 109408 - protein, 393 aa, Triticum aestivum
  unsure (1)..(393): unsure at all Xaa locations
  Clone ID: PAT_TA_3826.pep
VPRIGWDSVMSMSADLRDLFLYEVFLYYNPLLXLVALMIWLWGVNLWVFAQSSVNYAKVFDLSQTHLSHREIWRCATWLTLVVPTSMTAYLYLYSHGEVSLAASQPVVFCMLSFXMILLSPFDMFYLSSRFFFLRTMWRIALPLQAITFPDFFLADIFTSMSKVSSDLDRSGCRMVHRQVATIAWFEADSICGSHSVAIPLVLVLPYLCRFFQCLRQYKDTREKTCLLNALKYSTAVPVIFLSALKYHVFPDVWISFYRPLWLISSVGNSLYSFYWDIKRDWDLSILTRIFMFKNPNAWSNLLYGRSWVFYWVLGSNLILRCTWTYKLSAHLRHNYLTVFAITALEVVRRFQWVFFRVENEWNKMTAKQNFEMSSDVLPSEADRLLDSNSHTV

SEQ ID NO: 109409 - protein, 140 aa, Triticum aestivum
  Clone ID: PAT_TA_3827.pep
PAPSNAAPPLTPLSACASTTRVNAPPSNGLVVVLFAPERGGVLLLDASACRCASRSRGTAWPCGGATFFVSVKDSFFALSRVLGGGDLFFFFCFCFFVPKSSSQWHLIPLIYPLDRGRLDHPVSIPSLGAAELDPSAGHV

SEQ ID NO: 109410 - protein, 202 aa, Triticum aestivum
  Clone ID: PAT_TA_3828.pep
MATLLTSSSTFTRAAVVTFFHGLGETGLQTALLYFLKAQFHYTKNQYANLLLIIGITGSFSQLTVMPLLAPKLGEQKLLVVALTGSCVHGGPCSIAWSFWVPYLAASCVILSILVGPCIRSIVSKKVGPSEQGMVQGCITGISSTASVISPLVFTPLTAWFLSETTPFNFKGFSLACAGFATLVALIMSINMRPAEVQPDTR

SEQ ID NO: 109411 - protein, 91 aa, Triticum aestivum
  unsure (1)..(91): unsure at all Xaa locations
  Clone ID: PAT_TA_3829.pep
HGDVRADATFSTTWAPYATCWPYAKYATPYATCVIYLSTNVGSCSSSTPGFNSTSHQVLXGCPQLTHLXLTLWIGKSTFHMKGKSSITIGG

SEQ ID NO: 109412 - protein, 60 aa, Triticum aestivum
  unsure (1)..(60): unsure at all Xaa locations
  Clone ID: PAT_TA_3830.pep
SCKTLAYSAYINTMTWPPXKGKDAYPPSFSIHRVLKRSSENSMNQRARCLCTCGRKQKSS

SEQ ID NO: 109413 - protein, 140 aa, Triticum aestivum
  Clone ID: PAT_TA_3831.pep
AARSRLAPAPLPPSASPSRRLSLPPPPPPLAASAARRPLRAPPLPCSASPRLGLPPPGPPGSRPPGLPPPRAPLPPGPSPPRARPRSRSSSTCRPTWGSSCKAASSSSSMAKKNNQQVHMNKENKGVDDQDVPGLMFRSI

SEQ ID NO: 109414 - protein, 139 aa, Triticum aestivum
  Clone ID: PAT_TA_3832.pep
MARLMGGSAGFHVQGAHMQASRPPSLSFRTCAQLEISRFCAIPRFMGVKAVSASQQHIRHRFSSIRASALPCMQDDTTRYFDFVVIGSGVAGLRYALKVSKHGSVAIITKAEPHESNTNYAQGGVSAVLPPDLKAYQDK

SEQ ID NO: 109415 - protein, 137 aa, Triticum aestivum
  Clone ID: PAT_TA_3833.pep
HASVLEHNYIGILLEGTLKAENQNSILPPGVLLPSNMDLELLGLESSAMNRMDSCYSADSYQVEAQARVLIFEVGRLFTEANGQRNQPGGSFSAEALQLSVEESTGEEQVIITVDSPNKLPLGDSSAGSSSGVTRGS

SEQ ID NO: 109416 - protein, 330 aa, Triticum aestivum
  unsure (1)..(330): unsure at all Xaa locations
  Clone ID: PAT_TA_3834.pep
GGCDDQDSAYDEHCNPVNVNSTNYEEETDDYEYSFQGPDGPDVDERLEKIADLLSLGAGFSSKTNAWAXPEHWKYRKVXXIWXPAQTSSGDLEVAKKAKKKKGKDEPDIDFTKALEHEKANVFAPPKNPKSLLLPANKGSCNNKLPEDCHYQPESLVKLFLLPDILCLARRRRKPLDDSRDNSDDFMPSRPWDDDNLGNDHVDEGDAASDVEEPVNLIAKPRQVNKIDVQYDKVSKQVDVHALKEVLWNHIHTSAKTADLERDDKEPSLCLTKVLHDLPCSNRDVSTTEISPHLYFICLLHLANEHSLTLRDRPTLDEIDIYILTSPLVK

SEQ ID NO: 109417 - protein, 125 aa, Triticum aestivum
  Clone ID: PAT_TA_3835.pep
AAAFLSSRGLADSPCQLTKQTSPEILHGDDVHHLVGLQLPPCRPLEPAQTHHWPQRHLLLHSPFAADRGVALDLGAQGYQQIPPVREICPPRRGGTPFPPHPSIVSLPCKSRHLRSGTLSPATLS

SEQ ID NO: 109418 - protein, 238 aa, Triticum aestivum
  unsure (1)..(238): unsure at all Xaa locations
  Clone ID: PAT_TA_3836.pep
MANRARWVMKFEKGLIDILHENNNSHYRTPNGWRSEGWKKIVKDFNDRHPDAGFTKVQIQEHETQLKKDYKLIKSILQRDGVSWDQNASMIRTTDEIWDEIIDESPKARKYQKALLKGQHNLTNLXTMIGDIPEGVGNIDEEDNNTSTLRSMSRRLSALVPGSIDEGENNIIALQRTLELGSQGLEDVDLLQNHDEEALERPQPXADPKPQQRADEPAQSSSCIEPQKDKRKKRKASD

SEQ ID NO: 109419 - protein, 94 aa, Triticum aestivum
  Clone ID: PAT_TA_3837.pep
REIGPKWTPCKFLAATHLVGAGRRWYFLVDINYFPGFAKMPGYETALTDFFAEMIQLGTAGAASQEKLESVPCNGLDLEETGSALDSTCPVPMA

SEQ ID NO: 109420 - protein, 370 aa, Triticum aestivum
  unsure (1)..(370): unsure at all Xaa locations
  Clone ID: PAT_TA_3838.pep
PGPVASDDRRTPQPQSSAASSYNYTSMDSMREPKVGLWGALARKAKGILDEDAAAHKFDDHGKVHSATRKPNSSDGAQAPQSRWSFDSYGGTERSEPRKRSEALAASVNQFGGRIRNALEEGLIIVDNKTSNIIEETKKIQIRRKPNSSSLHMQNPAADAFPPPSFTQNKAEAAQETQLKASRDVRXANAMAAKAKLVLRELKTVKADLAFAKQRCTQLEEENKMLRETKQKGVKIEEDDDLIRMQLETLLAEKSRLAQENSMYARENRFLREIVDFHQFAAHNIVSFGDGNMKDSKLEEDTNRAYTENMFPVVEAYLAQEEISPVPSRLDSPILSPGESSSPVSIISVDNAANSPRNPLKPNELVPDKD

SEQ ID NO: 109421 - protein, 398 aa, Triticum aestivum
  unsure (1)..(398): unsure at all Xaa locations
  Clone ID: PAT_TA_3839.pep
MAPAALTALDARAPRAEGLATVLAIGTAAPDNCVYQADYPDYYFRVTNSDHLPELKQKFKQICEGSMIRKRHMHMTEKLLEQNPSMCEFNAPSLDVRQGILLTEVPKLGMAAAQKAIKEWGQPLSKITHLVFCTRQSVGLPGADYHLIKMLGLXPSVRRVMLYLQGCFAGATAIRVAKDIAENNXXARVLIVCSEITAATFRGPSATGSHLDNLVSQALFGDGAAAMVVGADPKEPMEKPIFQLVSTSQTILPESDGLIEVNLLEVGLTIHIDKDVPRIISKNIEHALTNAFAPLGIDDWNSIFWVAHPGGPAILDMIEAKVNLNKKRMSASRHVLSEYGNIAGATVLFILDEMRKRSAEENHATTGEGMDWGVLFGFGPGITLETVVIRSMPINTTT

SEQ ID NO: 109422 - protein, 130 aa, Triticum aestivum
  Clone ID: PAT_TA_3840.pep
VAHPMMLACSPCSVQEIQEVGQSRVVLEAITVAHRRPGQNLVRLCVDASNLEACYHLGNYLIVFLGSREVGATLMMTVTVGDTAGRQCTPCVSFNSLALVPPRTITTNDIFPLIFFPDGGGLVAPWCVDF

SEQ ID NO: 109423 - protein, 217 aa, Triticum aestivum
  unsure (1)..(217): unsure at all Xaa locations
  Clone ID: PAT_TA_3841.pep
MKRPGGGNPSXPTRSNPNDMDYGVVGMEADGDAEEEMMACGGGGGGCGGGEKKRRLSAEQVRALERSFEVENKLPTRPKARLARDLGLQPRQVAVWFQNRRARWKTKQLERDYNALRHSYDALRVDHDALRRDKEALLAEIKDLKGKLGDEEAAASFTSVKEEPAASDGPPPAGMGSSDSDSSGVLNDTDATGATPTEEAPAPEMGTLLGGPGAAGA

SEQ ID NO: 109424 - protein, 54 aa, Triticum aestivum
  Clone ID: PAT_TA_3842.pep
GATTAGHGQVFLHGNFLKVEEDETGFLDDEEPCGGFFADEPPLAWWTEPTDPWK

SEQ ID NO: 109425 - protein, 268 aa, Triticum aestivum
  Clone ID: PAT_TA_3843.pep
MKRPRGGSPSSLAAMTNPDDDGYGVVGMEAADADADADEEMMACGGGGGEKKRRLSAEQVRALERSFEVENKLEPERKARLARDLGLQPRQVAVWFQNRRARWKTKQLERDYAALRASYDALRHDHDALRRDKDALAAAMHELTEKLGAHDAGPRHTTVKEEPAASDGPPPAGMGSSDSDSSGVLNDTDATGATPTEEAPAPEMGTRLGGPGAAGAAAAGHGQMFLHGNFLKVEEDETGFLDDEEPCGGFFADEPPLAWWTEPTDPWK

SEQ ID NO: 109426 - protein, 81 aa, Triticum aestivum
  Clone ID: PAT_TA_3844.pep
KFILAPGGGGGGFSGGGGGGYGGQRREGGGGGYGGGGGGYGGGRSGGGGGYGSREGGGGYRGGGGGYRGSRGGSGGGNWRE

SEQ ID NO: 109427 - protein, 120 aa, Triticum aestivum
  Clone ID: PAT_TA_3845.pep
AAGIRHEGYVPYHELDGHQRVCPHAPCFCTEPGCGFCGPPVALLGHLTAVHSVPVHLCGSITRAATRGQAPGEWSAATEQRSGQHFVGLEGGDEQQQARRGGRGGAAVFLDGAAYISGWI

SEQ ID NO: 109428 - protein, 133 aa, Triticum aestivum
  unsure (1)..(133): unsure at all Xaa locations
  Clone ID: PAT_TA_3846.pep
MDIDDVICNLRVVGMPTKSAIYTWGYNQSGQTARKGKERHLRIPKSLPPKLFTCRDGENLRWIGFAWARAHAAPVVADGSLFTWXGDGTEESAKEPKKVNALATEFVKSVSCGAHCTAAIAEPRENDGSISRS

SEQ ID NO: 109429 - protein, 217 aa, Triticum aestivum
  Clone ID: PAT_TA_3847.pep
APIDKFIEKALEECENDLDSAMKYLLPLHLEPTEYNVDPVYQSPNEMSTEVQVPNEGIVECNNEVPAPIGSVPGAENLQSGITQWVEILMNEMASASSSDDAKARASRVLEAYGKSTSSCIRTEAMQKYQKEILLYKEQFEAVIKENTILKKAVAIQHERQKEHEERNQELQQLKQLVMQYREQIRNLEINNYALSMHLRQSQQGNSIPGHFHRDIL

SEQ ID NO: 109430 - protein, 266 aa, Triticum aestivum
  Clone ID: PAT_TA_3848.pep
MPPAGSLTADQLSFFEKNGYLVLESFSSAEEVQAMRGRMAELVEGFDGADSSVFSTKDHRQLKDDYFFKSAENISFFFEEKAFGDDGCLRQPKELSINKVGHALHEHDPVFKKFAFSENISSLFSSLGYKRPAVIQSMYIFKQPGIGGEVVPHQDNTFLYTEPLSCTGLWLALEDATITNGCLWAIPGSHKNGLKRRMIRDENGTHFDRPSPLYDQKEFVPLEMKSGDFVVIHGDLGHQRMVQRYNWSTRGKLRLIRSMCLSSASY

SEQ ID NO: 109431 - protein, 317 aa, Triticum aestivum
  Clone ID: PAT_TA_3849.pep
MNTEGNGQSVLSTLPKELPLDFLRTITNQFSEDRVLGTGAFGTVYTGVLPDGQHIAVKRLAENAPLPRDKAITNEVQNIMALKHDNIVKLVGFCHEGQKKVVLNNGRYIVADVFESLLCYEYLPKGSLQKNHFDRSNSMAWDTRFKIIKGICNGLLFLHRIPIIHMDLKPENILLDDNMNPRIADFGLSRLFGQEQTRANTQTVVGSYGYIAPEYLYRGEISTQSDMYSLGLLIIETTTGEKNQPKQNEPSARDFIENVRQNWTDGRIASRYSMLKANDLQEIKVCIKIGLECVQIDRKKRPSIENIVKRLEGRCAN

SEQ ID NO: 109432 - protein, 204 aa, Triticum aestivum
  Clone ID: PAT_TA_3850.pep
PPHPVPPRLLTLPGVLTIGRVAAVPSLSTTRPMDGPWAATATTGIFLAAAITDWLDGYIARKMHLGTPFGAFLDPVADKLMVAATLVLLCTKPLETSLLTNGPWLLTVPSIAIIGREITMSAVREWAASQNTQVLEAVAVNNLGKWKTATQMTALTLLLASRDPSLHVQGALVPPGVALLYASAGLAIWSLVVYIRNIWRILLK

SEQ ID NO: 109433 - protein, 175 aa, Triticum aestivum
  Clone ID: PAT_TA_3851.pep
VSAAVDFFSTFLENPHQQSTDQGKLHCQLFFLLFGEGPRFRIAQQWARDNALNVNWQHPEAVLLELLHDYSKLCDCSFHLLQYYVEIPFLDALLDDLKELSPFARTLSDAKKRWEPYEAKYASAGLVFRRGDGKIILESLVGGELLLLNYNYKFCTRIQMRQAGYDGQWFERLSK

SEQ ID NO: 109434 - protein, 227 aa, Triticum aestivum
  Clone ID: PAT_TA_3852.pep
MAAASSAAAAAPADTYDIPWVEKYRPSRVADVVGNADAVSRLEVIARDGNMPNLILSGPPGTGKTTSILALAHEMLGPSYREGVLELNASDDRGLDVVRNKIKMFAQKKVTLPPGRHKIVILDEADSMTTGAQQALRRTMEIYSNTTRFALACNTSSKIIEPIQSRCAIVRFSRLSDQEILGRLMVVVAAEKVPYVPERLEAIIFTADGDMRQALNNLQATVSGFRF

SEQ ID NO: 109435 - protein, 128 aa, Triticum aestivum
  Clone ID: PAT_TA_3853.pep
MAAPSTPTATVLLLVLLACGGATAQVFPRPLFPRAPWNFTFPNGPGDAAGASGAGTGATGGGGGGPVPAMFVFGDSLTDNGNNNDLTSLAKANYLPYGIDFAGGPTGRFSNGYTMVDAIAELLGLPLL

SEQ ID NO: 109436 - protein, 147 aa, Triticum aestivum
  unsure (1)..(147): unsure at all Xaa locations
  Clone ID: PAT_TA_3854.pep
PSSSPPPSPRPHPAPPPRPPPPSPPPAPPPXPRRRPAPIPPPPPPLPRLPSPVPGAGPQRRPASSPPPPPPRRPRSQAPAGPAPASPARPPAPSPAPRRRPPPAVRLQREFESSARPSAPARPCLRRRLEGCPISSHLLQCFLRRMS

SEQ ID NO: 109437 - protein, 281 aa, Triticum aestivum
  Clone ID: PAT_TA_3855.pep
MSSSMGMVPGQQTHAMSSSSLPPQSNSAVLPPDSRALVLSGNGPASAARASTEIFSALTQPKPSTSTPALPTTSSFMSKPTGSQNFANLTQPGSLQGTPTVSYGTSQPQQTQPITKPSVPSPGVSAGVSNSSSQWPKVNQSDIQKYTKVFRDVDRDRDGKITGAEARTLFLSWKLPRDVLKQVWDLSDQDNDGMLSLREFCIALYLMERNRAGTPLPPSLPDSLKFDETLLRATGLPSTAYNAPSWQPNQGLPHRGPGAPGLPTGGVRPPLPQMHSQTDGA

SEQ ID NO: 109438 - protein, 79 aa, Triticum aestivum
  Clone ID: PAT_TA_3856.pep
FFFFFCFKILTFYDQPSCFLALRKSLRLGPFAFCSFSFNSRRNVFDSSSNNSVEEFIFCYSCSSPSRSFKVFKISLAFF

SEQ ID NO: 109439 - protein, 136 aa, Triticum aestivum
  Clone ID: PAT_TA_3857.pep
LLLMRHLSCFHLASTISIQVKFPLSFFQASKTSQTDTSWRYRSLHLRMGNAKSKEAEHQLEEVVAGGNRRSPHCPSKAAADPRPAQSDAGQTSGPPQAAHRAPLTPPAAHAEGKAATDPGMEDRDGRSAVWPDGAQ

SEQ ID NO: 109440 - protein, 187 aa, Triticum aestivum
  unsure (1)..(187): unsure at all Xaa locations
  Clone ID: PAT_TA_3858.pep
MFFLGDMDVVDAPCLERLFQYNTNKNRSSRIKIGQAPKLRVLGYLEPGGQELIIVAGSKESIVPSVQILAMEVQFGVRSVVKKVPGFLRCFPNLETLHVQSHHISEEPTRKVNVKFWLQGGPIKCVVESMRKVFLYEFXGSRSEVTFLKFVAERARVLEQMVVVVSSKSFSPGDDVGAKLKPLTNAK

SEQ ID NO: 109441 - protein, 116 aa, Triticum aestivum
  Clone ID: PAT_TA_3859.pep
LPSVAATSTTFTSWLPSLAACTSWLPSRAAASTTCTSWLPSLAARRGSFSVTKDDVVASKACPQSAASWLPSLAAANTACTSCLPSLAATNAACTSSIPSPATTCIVCLSSDAARC

SEQ ID NO: 109442 - protein, 162 aa, Triticum aestivum
  unsure (1)..(162): unsure at all Xaa locations
  Clone ID: PAT_TA_3860.pep
QSLISAEAIPVLQMLMKTCPPSFHDRADSLLHCLPGCLTVTILRGNNFSLTVERGRGRGCLQIGNGPPRQTKVNXSICPVWNEGFTWLFDIPPKGQKLYILCKSKNTFGKSTLGRVTIQIDKVVTEGVYSGFFSLSHDGGKDGSRTLEIEIVWSNRPANDNM

SEQ ID NO: 109443 - protein, 214 aa, Triticum aestivum
  unsure (1)..(214): unsure at all Xaa locations
  Clone ID: PAT_TA_3861.pep
MVVDPVLKGFDLNIAAVDESSPLEGIGLGLYATEFIHKYLRFNPTDQELMERLEAKVRDGGARSDPLIDKFIPTIEVEYGYPHPQQLPGVTMDGTIKHFFCRPRAFESGRRKHRKIKAERNDRTAWHKTGKSMALKANGRLTGWKXFLVLYTNTRKTNWVMHEYRLSDVEDEEGGELVLCKIFYQTGEPKRRSVLRTQENKCPTCGCGCGGMDV

SEQ ID NO: 109444 - protein, 157 aa, Triticum aestivum
  Clone ID: PAT_TA_3862.pep
ARGIVLKQNIPIEVHASQVYTTTMFENFGEALYERGLYDLVEVRPHLEYIARHIKFQSREKWCKNEFVISVSESADEFGCECGTFEHYGMLCSHALKVVIHLKLHELPAKHVLRRWTRDARDILPPEYLRALPEGSWAAEVFFSSTQHFVPAGARCR

SEQ ID NO: 109445 - protein, 110 aa, Triticum aestivum
  Clone ID: PAT_TA_3863.pep
KSFCDDNAREDLKDLGWRGATCVFLDGGAVRWQWGVAVAAAGHNRESTYPEHPAISSGELRRASKRSTKLKGYMRLPEGGGCREGVGSCGSRSRVRPGVHLSRTPNYFIR

SEQ ID NO: 109446 - protein, 156 aa, Triticum aestivum
  Clone ID: PAT_TA_3864.pep
PHGQIVGVSRSPTPPHPPSSPLDAASLLTCRFGNPSPPPPPGVPGSRLRRRVGRWGKLQLRGACRRQVQASSGAVSGGAAASVKLKFKLKVCLRVRRSASSSPGRCFPWGAAGVPLCFVELASAPRPGTQSNDCIIPRILCFKTAPGIIWSRGRSR

SEQ ID NO: 109447 - protein, 135 aa, Triticum aestivum
  Clone ID: PAT_TA_3865.pep
LISQCFDLQLHLAVGENIPRFEEARTWFQGDNRKRSAATSRMQAKLASRGAAMEPTRSSSKDELALPRSRTSSVLHEPHDGALGESWRAGVQIRLEQDGVASIGDLLLSCLEVSACWRRSSSSRWLSQPNHKIVM

SEQ ID NO: 109448 - protein, 61 aa, Triticum aestivum
  Clone ID: PAT_TA_3866.pep
YIILRVIIDVQNDVCYHHELYFAILGYTTSVYCSILLPKPLSISHLKSILSWLCKIFLYAN

SEQ ID NO: 109449 - protein, 82 aa, Triticum aestivum
  Clone ID: PAT_TA_3867.pep
SIDSFGFIFFICYCYIFFLYCFFSSNMDIHTRLVLVYLLIQNHVVRSPTNNTRSPYQTHDHRSMHTNKVLICASRSASFLNR

SEQ ID NO: 109450 - protein, 286 aa, Triticum aestivum
  unsure (1)..(286): unsure at all Xaa locations
  Clone ID: PAT_TA_3868.pep
MATTAAAAAAVPDAIPAAAPAAPSAQPHPVPDKCTNYKNHLQEWTQRNDQKLPAYNTESKRDHRRLEFRSTVEVGGERFQSXAIIAAARNAEQDAAXEVAYETLVTKTVISDDDHTDALGLIDQGVVFCKSILHEFAVKTKAEQPTYSADHPEGVSPMPLFVSSVLFAGNTYTGEAATCKKDAEQKAARVAVKSILATKNTCMHQIVRSKKELIIAITSSGFNKERGVVSQENCNAPTNAITPIKFVPAGEAAGLTADQGATNVPEDDPCAQAVSGSEKCKKHRRV

SEQ ID NO: 109451 - protein, 220 aa, Triticum aestivum
  Clone ID: PAT_TA_3869.pep
MSGGAAAGAAAAVSRFIKCVAVGDGAVGKTCMLICYTCNKFPTDYIPTVFDNFSANVSVDGSIVNLGLWDTAGQEDYSRLRPLSYRGADVFILSFSLTSRASYENVHKKWMPELRRYAPGIPVLLVGTKLDLREDRAYLADHAADSIITTEQGEELRRQIGAVAYIECSSKTQRNIKAVFDTAIKAVLQPQRHKEVARKEIRTRSSRSVRRYFCGSVCLA

SEQ ID NO: 109452 - protein, 96 aa, Triticum aestivum
  unsure (1)..(96): unsure at all Xaa locations
  Clone ID: PAT_TA_3870.pep
PPRAFFLNAGVPLPPRPAGLLPHDRRASSPTTGVLPPQRAPPSAPTTSPPPGALPLXPASPTPEARDPATTMRHRDHLPPPRSPRLPAPPCAPHVL

SEQ ID NO: 109453 - protein, 78 aa, Triticum aestivum
  Clone ID: PAT_TA_3871.pep
MRHLPSGGRQSMVYTASTRVAHLMLSRSYTYLAFAAEPLTIMELDHTRPQWHALPCGLLDAGRRALIRLDYRAHIDHI

SEQ ID NO: 109454 - protein, 315 aa, Triticum aestivum
  unsure (1)..(315): unsure at all Xaa locations
  Clone ID: PAT_TA_3872.pep
MRLSCNGCRVLRKASAAAXAVRPRRRRMNPPRXQAIATPFLADFDRARRGXMNLINAGTDDSLRPGIFRCLRHGVCGSILNHACGPVGLPLYDSGRTGQADVEAVLSGKPIVQVSXSEDAAADRTPPLKAYDIRHVSTSPAADGRLHKVAKPGRTRFKRASSASSHHNPSSDSNNKPKPKPQPQTRAPTAEEELDRQHXRSMEEGAAQRAPSHESSDSRHEDPVEPHCQQEASXPRGASADTEAEAGSHVSRAEQEQEQSTEPAAEHAEEVEKEEDEELGLELTLGFAPVAARPAGFHLSVRTAAEPAFVGLRFL

SEQ ID NO: 109455 - protein, 380 aa, Triticum aestivum
  unsure (1)..(380): unsure at all Xaa locations
  Clone ID: PAT_TA_3873.pep
MANLVTNCGFSPSPAVKAHCNSPSYGHNFIRLQNSKSSTSSLNLKSSSKRSNKLYVTCASTAVQGQTQTPLTGSQQASGQSSSKPKKVMVIGGDGYCGWATALHLSNKGYEVAIVDNLVRRLFDHQLGLDSLTPIASIQNRIRRWKSLTGLAIRLFLGDFCVWPFRAVAFKSLVPGSAAPFAEQRSAPFSMIDRSRAVYTQNNNVIGTLNVLFAMKEFSEECHFVKLGTMGEYGTPNIDIEEGFLTITHNGRTDTLPYPKQASSFYHLSKVHDSHNIAFTCKAWGIRATDLNQGVVYGIRTDETAMHEELSNXVDYDGIFGTALNKXXGQAAVGHPLTGLWEKGXQNPDTLGTSRDTWAKAVGGLNLENPSPNPRRFTGP

SEQ ID NO: 109456 - protein, 197 aa, Triticum aestivum
  unsure (1)..(197): unsure at all Xaa locations
  Clone ID: PAT_TA_3874.pep
MQASPGLAMAAAAGAGPTTRWPFFVFLAGAMFCLMSSCACHLLSCHSHRLNLFLIRLDYTGIAVMIVVSFFPPIYYIFQCEPRWQLAYLSAISLAGAATVYALMSPRLSDAKYRAHRALLFVGMGLSGVVPAVHAAAVNWHEPRRNSRWRTXAHGRLVLVGTPSTXRVPEXWRPGCSLSGKHRYYLLYRGALRIAHS

SEQ ID NO: 109457 - protein, 139 aa, Triticum aestivum
  unsure (1)..(139): unsure at all Xaa locations
  Clone ID: PAT_TA_3875.pep
SRPDRSSWSAKIRAAVCSSRPPISGSGSGWFVTASTASARVLLDLVGCNSLARSSAATGAAPSAVYPLHPVTMSGTLALPVTRLSTRAQRSIPQSLYCTETMNLDHCSSHRRYSRSFSVALLACELLPNQXCNNACDXX

SEQ ID NO: 109458 - protein, 264 aa, Triticum aestivum
  Clone ID: PAT_TA_3876.pep
GAAASWVVGRMGTDAHLYDDPEDAAIPALLDSRFDVDVAHLFPQVVKNVAAQSLEVKKLVYLYLLHYAETRQNEALLSINIFQKDLSDINPLVRAWALRTMAGIRLHVVAPLVLVAVKKCARDPSPYVRKCAAYALCKLYDLLPEENTTLEEIVDVLLGDSSFGVVGAATVAFKSVCPNCLALIAKHFRRLCETLPDIEEWYQITLIEILLRCVIAKHGLVKDSVMFAAELSLETQAGRDSVPVSNISSTQAETIVNGGSGTMP

SEQ ID NO: 109459 - protein, 168 aa, Triticum aestivum
  Clone ID: PAT_TA_3877.pep
SPRYIREAVSYLLTITSLRSCLSEPLHRLDAALQRIYMYIIPVIKIRVHLSLLLIHHRLSALCSPLSEKGHLEKAATRARITEARRASRRRGHQQWRPSHRRRRRPTSGACRRCRQNEERRGPARTYRKKCSSSGAWHCHAPTVIRLLKARTQTCVCMPSSKMMSNAD

SEQ ID NO: 109460 - protein, 149 aa, Triticum aestivum
  Clone ID: PAT_TA_3878.pep
SPSRPTPPRSGASPPDPLLCAPFQPLSAMAGATPPHTETDAPLSPSCLAPSSSALRCPHHQRHQHRPGRRRSLQHRQANLKNEHTPATSSSLVAAIARQQGRQRRQGAACRTSSRCFGRRDCARWCACGGAGCFCFFNLRGVCVIFLLS

SEQ ID NO: 109461 - protein, 349 aa, Triticum aestivum
  unsure (1)..(349): unsure at all Xaa locations
  Clone ID: PAT_TA_3879.pep
VPSLTRSAPPGRPIDRSRWSLSDQLDATTAGPHRVVGPAASAVVARVPTCLVKKLLYFVVVSIDFXKRHNKPPEIIQRGPPAGQLTDHTGQMTFDHGEKTRRXWSPFSPDGSTRVLYTGSLLERASSALWRRPDRKSSAAPTPDRASNRAFPAAPQLAPCXSPRIAEKQRNWKQSFEATTTSPAKNQTPAANIYTLPDLSPLAASHNIARSQRGRKLFTSKRHVARWYDAISSRPSWQQVVNIQHERPGTFEWSAISIVVGHRSVACTLLPPGFTPCCLRPSRALSVYVLFVRCRVGLKYCEALKRAVSLVMSSIIATPLSFQVHKGLYQLLSVQQINCSQSSLLARLS

SEQ ID NO: 109462 - protein, 164 aa, Triticum aestivum
  Clone ID: PAT_TA_3880.pep
INKAINCQDYKHTPSGKRKNNTAVRYINDGQHQTTHTPRKLEMIKRERSRRRRGPHRRMLHQEQYHTGSEERGADTSWAYAVTMHLRAPARHIRYAIFEEGHYLLAWIEGAAPPQDGMDAAGRWPRREGQRIPNKTPEALLEQNIVVAHIQHRRGKFHIRCIYS

SEQ ID NO: 109463 - protein, 161 aa, Triticum aestivum
  Clone ID: PAT_TA_3881.pep
HPLHHPDVPVHPSRHAQDPGDRARAAGQAVGIRRHRAQSHGGGWPGRHCRACGRGALLAGRGQGGGSAVLYVRLHVVDQLIDRVSRFSFVEEAMFLLTEGTRFCCGWHTVVGCLGSMLRFFYITFMSLSCIFAYFVLCLDHLSIGRFARVIYFHIIHSCGV

SEQ ID NO: 109464 - protein, 162 aa, Triticum aestivum
  Clone ID: PAT_TA_3882.pep
IQPDALGPRPPAALGPPGLRVPLFGPGPWGSCIRTFTRGRASSDRGGHRPSIVSSRASRGYFIPHREQGVGVLTQEGLQVHICAWDSSPVFQPQAPPLPVERDRTAGGTCPMRGHAGPPYEDISFRIVNKEWEYSHKKGFKCTFERGILHLYFNFKRYRYRR

SEQ ID NO: 109465 - protein, 138 aa, Triticum aestivum
  Clone ID: PAT_TA_3883.pep
GWQAQFVSARASWGRSHQPLHGVHPPASYSLVTAGSGIYCLLGACARLTTVRALVSTWACVGCALLFFTHSFEQYISDWELRSLQSPVIISVPAFVPFRCHLTYGGRPKPFIPVTMGLRQGLLLGSNRMLRFFCRSRS

SEQ ID NO: 109466 - protein, 169 aa, Triticum aestivum
  unsure (1)..(169): unsure at all Xaa locations
  Clone ID: PAT_TA_3884.pep
EHSTIIYESSSGGGSNSAATDGGAVSPTPLVRLGWNKQDPRYMATIIMDSPKVVVLDIRYPTLPVVELHRHHAPVNAMAWAPHSSCHICTAGDDSQALIWDLSSMGTGNNSGGNGNGMAMLLQLQXAEGGLDPILAYTAGAEVEQLQWSATQPDWVAIVFANKLQILRV

SEQ ID NO: 109467 - protein, 168 aa, Triticum aestivum
  Clone ID: PAT_TA_3885.pep
IEHEKIKQYTERSWYTCGWVGNEVDVYNDTISTRTPAATHGWDLSDHHEHTRQDIRLILLVCISSGLGARQARPGLAREPPPGRARGALHRRGSLGPQREPPRRRLRPPPRQPAASKEQRGPMAQGSTGGPWRGGGGDTGMGEAAAARVSEGDRGTRRGGGGGHEGRR

SEQ ID NO: 109468 - protein, 114 aa, Triticum aestivum
  Clone ID: PAT_TA_3886.pep
GTRLPPAITNPPTIFVHHARSGHPGQPPPAPPRNQEARGQPWPARPPPAPARAASRPTGSTAGTTAWTRPPRSAARPSPRPSSAPGAGRGRRRPRAGGAGGACVAAASGGGSCA

SEQ ID NO: 109469 - protein, 210 aa, Triticum aestivum
  unsure (1)..(210): unsure at all Xaa locations
  Clone ID: PAT_TA_3887.pep
AICGRLVSSLSTKGTYTVREGDPVTEMLFIIRGKLESSTTDGGRTGFFNSIILKSGDFCGEELLGCALVPRPTVNLPSSTRTVKALVEVEAFALHAEDLRFAIKKNRRQHSRKLQHTFRYYSHHWRTWAACFIQATWRRHKRRRLARDLMMRESFSSMRSYEDGNGGGSFAEHGMSVKIMAAARKGXDSHRELPKFRKPSEPDFSVEHDD

SEQ ID NO: 109470 - protein, 109 aa, Triticum aestivum
  Clone ID: PAT_TA_3888.pep
PKCNAYSLAISHAVTSINHRRGASSWPRPRRWPPPAPWPRAGPPAPPPPRSPPSPAAPRRPRWPWRAAGPPARTRPTTTRPSALPPPASRRPSSRRPPSPRRWLEFRRC

SEQ ID NO: 109471 - protein, 100 aa, Triticum aestivum
  Clone ID: PAT_TA_3889.pep
GRHQEEGEKKLTLDEFLPIFSACKKDKDQGVYEDFLECLKLYDKAENGTMLGAELSHTLLSLGERLEDKEVDEVLKDCLDPEDDEGMVQYVPFLKKLMAA

SEQ ID NO: 109472 - protein, 400 aa, Triticum aestivum
  unsure (1)..(400): unsure at all Xaa locations
  Clone ID: PAT_TA_3890.pep
MISAERSQSQSPRSPGAAAGAPFLSICVTDPVKMGTGVQSYISYRVITKTNLPEFEGAEKIVIRRYSDFEWLHDRLAEKYKGIFIPPLPEKNAVEKFRFSKEFIELRRQALDLFINRLASHPELKQSEDLRTFLQADEEKMDRARSFETGIFKKPGDFIQMFKDVQSKVSDVVLGKEKPVEESTPEYEKLKHYIFELENHLAEAQKQAFRLVKRHRELGQSLADFGKAIKLLGACEGDSLEKVFSEVGSKSEMLSIKLQREADNLLLNFEEPLKEYVRAXVHSIKATSLIRANAFRQHFDLDQERKYKXSLTVEKMKFMNPEKFSESETEFSELKAASVGGYEDGTMHIVXVMNEVPAPVHGRYSAVSALAFPXGQAKLAKDIADAWRSVLPKLQACSSS

SEQ ID NO: 109473 - protein, 310 aa, Triticum aestivum
  unsure (1)..(310): unsure at all Xaa locations
  Clone ID: PAT_TA_3891.pep
MTTAYAAYPNGDGLLDVATERAATPLDMGAGHVDPSKAVDPGLVYDLTAADYLDFLCAIEYEPAQIAALTKHSSDHCSPNRTYSVAALNYPSFSATFPAAGGTEKHTRTLTNVGKPGTLKPARGAPGVNILAAWSRSVRPSGIAGDDRRTSFNIISGTSMSCPHVSGLAALLRSAHQDWSPAAIRSALMTTAYAAYPNGDGLLDVATERAATPLDMGAGHVDPSKAVDPGLVYDLAAADYLDFLCAIEYEPAQIAALTKHSSDHCSPNRTYSVAALNYPSFSATFPAAGXAREKHARTLTNVGKPGTYKV

SEQ ID NO: 109474 - protein, 96 aa, Triticum aestivum
  Clone ID: PAT_TA_3892.pep
MRSLHVSSCASGGQTPLPLRPRCLKKGLETNCPICCDFLFTSSKEVRAVLSGHSMHSTSLQAYTCSHYTCTIYGKSFGDMAFYCMRILHGQYNSDS

SEQ ID NO: 109475 - protein, 159 aa, Triticum aestivum
  Clone ID: PAT_TA_3893.pep
MSQSQSPSPVVKLGTWGGDDGVAHDITVAPQRLESITIRWGKVLDSVGFTYMDKDKQLHTAGPWGGAGGEKEDPDTITLGPSEYITQVDWSVGPFKLKEIEHCITSIKFVTNQATYGPFGHAVDSTHYSLPVLNNGSVLGMFGRAGDYLHAIGFYVPPF

SEQ ID NO: 109476 - protein, 171 aa, Triticum aestivum
  unsure (1)..(171): unsure at all Xaa locations
  Clone ID: PAT_TA_3894.pep
MRVPAFSLCLLLALVAANVASLAVAGRAPELKHEPSLEPKPTPQPDPKPDPQTDPKLAPTPKPDPKLAPKPDPKPDPQPDPKPAPKPDPTPKPDPKPAPKPDPTPKPDPKPDPQPDPXKPGPKSLHPKPTPDPNASPPRAPRPKPXPKPQPPEQSSSQPKQPPRSPSGYFN

SEQ ID NO: 109477 - protein, 298 aa, Triticum aestivum
  Clone ID: PAT_TA_3895.pep
MKKLRQKEQRLKDLKDEGTTVQLPEAVDGAPSSPGIQSLEATSGPGLHEQEDSQYLQLSAPVPSEDNDYNGEDANCGSGQEMDTGAVFREQAMATSNLDRIENLPPNSTVSGSSATASKHPSSSSVRHSRHREPNAGATTNKSKTWAWKVRTGVEERCPKGEPDVDANQETAPLNTDKNSQVLIGSISVAIEGGGSCSEDSKDYHPAPPESDLNTLNDPVAEAMQPISHDENGCEDANAAEDHSPSSVVTDESGCDAEAAEGGSLRRGSVSSGQEAAAFLSQRWKEVMAGDHVKLVLC

SEQ ID NO: 109478 - protein, 247 aa, Triticum aestivum
  unsure (1)..(247): unsure at all Xaa locations
  Clone ID: PAT_TA_3896.pep
MAQPKAVRAAAAAAVPDIAAQLDLASACINGAESMMAAPXCRGEAAXVVVGHRGKGMNALASPDERLREVKENSVRSFNDAARVAGVGYVEFDVQVTKDGCPVVFHDNFIFTEQDGKICGKRVTDLPLVEFLSYGPQKDQDKVGRPLLRKLKDGRTLRWDVRSDEPLCTLREAFEGVDTRVGFNVELKFDDDLVYQEEELVGVLQAILKVVFEHAKDRPVIFSSFQPDAAQLMRRLQDQYPVYFLTV

SEQ ID NO: 109479 - protein, 568 aa, Triticum aestivum
  unsure (1)..(568): unsure at all Xaa locations
  Clone ID: PAT_TA_3897.pep
MADDAASAPPTAQLAAASISSSPSSDLEPPTDPTRISAMLDVGDAMAGQRVVGGHLGETGRHQGKGAFAFLGFDXGSGQGNLQGQLREGRHRRPQIPKHTWEGPSFSRAAYVSLGDIKNVNSNTLLADLGRSVGRPVRLIYIRMLISFDMSRVLXVVILKKSIRLVXKIRTLKYYWSLASSXVIVVCGPFWIHSPIITTSDCEGAGEMFQVTALFSQAEKVEKELKENPAPSEADVEAAKLVVKEKGDAVAQLKAAKASKQEITAAVSVLTKAKENVLRVEERSKLKPGLPLKDDGKIAFENDFFKRQAFLTVSGQLQVETYACAPSHVYTFGPTFRAENSHTSRHLAEFWMVEPEIAFANLQDDMNCAERYVQYLCKWLLKHCREDMEFMVKHVDKTAIERLELVSSTPFERISYTKAVEILEGVDKKFENKVEWDDLASEHERYLTEVIFKRPVIVYNYPKGIKAFYMRLNDDQKTVAAMDVLVPKVGELIGGSQREERLDILKQRILDADLPLEPYEWYLDLRRFGSVKHSGFGLGFERMILFATGLENIRDVIPFPRYPGRADL

SEQ ID NO: 109480 - protein, 196 aa, Triticum aestivum
  unsure (1)..(196): unsure at all Xaa locations
  Clone ID: PAT_TA_3898.pep
RRTLVFLSHSRPFPTSTRIIVGDGSSLPAPRRGGLSLPSSGAPVRLYDVLVSPHLITNLVSVRALTRHNPVTVEFDAFGFSVKDLXTKTVLLRCNSPDDLYPLRASPAAPTPVALSVGLDLWHARLGHPGVSAIQQLLPSFPFSCNKTEKHSCSSCRLGKHTRLPFSESFSVSSFPFELLHCDVWTSPIKSNSGFE

SEQ ID NO: 109481 - protein, 109 aa, Triticum aestivum
  unsure (1)..(109): unsure at all Xaa locations
  Clone ID: PAT_TA_3899.pep
MLEELLIFTRGGLILWSLAGAAAALKGSPIDALIRSFLLEGRSASAGAGAGFTHGPHALRWTYDNALGLVFVAVYRRVLHLLYVDDLLAAVSAEFARIYNPSRVXYDEF

SEQ ID NO: 109482 - protein, 292 aa, Triticum aestivum
  unsure (1)..(292): unsure at all Xaa locations
  Clone ID: PAT_TA_3900.pep
RHEGLHTGGNAFPNRSSSMLCNNRISAPHSPFMYGKQNAKHAAYNHESSLHPHIKSVIFKAPDIKAQDLEPNADFIPLDLDDYKSDSDAVPSDLLGPAGLYLALPGSIIPVRHAPAPLAAEHNEVDMYPAPVLSQSFHSLCETSQNSAIAHFMKERQSSMQGRGCKRMSTLQFDGHSHLPSPRSSTIAXHLSFSFGADEISVTSDKALNRPALAELEQNREAVTKERKQQVSYSVQGTQSKSGDDSKKRSKLMSLSFAERVASLRVKSCFGNSQSLLMQSSKLSCTLLPDEE

SEQ ID NO: 109483 - protein, 210 aa, Triticum aestivum
  unsure (1)..(210): unsure at all Xaa locations
  Clone ID: PAT_TA_3901.pep
DDVWNPEAYSLMCSAFQGLQGSRVMITTRREDVAALALVSRRLQLQPLGRDESFKLFCSRAFHNTLDRKCPPELEKVAGDVVKRCHGLPLTIVSXGSLLSTKQPTQHAWNHMYNHLXSELQANNHVQAILNLSYHDLPGDLRNCSLYCSLFPEDYAMSRXNLVRLWVAEGFAMKKDNSTPGEVAEGNPMELIGRNMSEVVERDELFRVRM

SEQ ID NO: 109484 - protein, 101 aa, Triticum aestivum
  Clone ID: PAT_TA_3902.pep
STTEVQFTKSTTSGSFFYSIFSGSYQIENSTCTTLLRKKRASLYIPYTVFDSRCHVYSPSLNAEMVFKHKHNLDHTLGMALTRHAVIVDFLTWLGSHDKLG

SEQ ID NO: 109485 - protein, 661 aa, Triticum aestivum
  unsure (1)..(661): unsure at all Xaa locations
  Clone ID: PAT_TA_3903.pep
MSEEEAQRYGGGTGGGGVGALSVDLLGQVLDRVLERRDRKACRLVSRAFARAEAAHRRALRVLRREPLPRLLRAFPALERLDLSACASLDDASLAAALAGADLGTVRQVCLARASGVGWRGLEALVAACPRLEAVDLSHCVGAGDREAAALAAASGLRELNLEKCLGVTDMGLAKVAVGCPRLENLSFKWCREISDIGVDLLVKKCRELRSLNISYLKVSKESLRSISTLEKLEELAMVACSCIDDEGLELLSRGSNSLQSVDVSRCDHVTSQGLASLIDGHSFLQKLYAADSLHEIGQDFLSKLVTLKATLTVLRLDGFEVSSSLLSAIGEGCTNLVEIGLSKCNGVTDEGISSLVACCSYLRTIDLTCCNLVTNNSLDSIADNCKLLECLRLESCSSINEKGLERIASCCPNLKEIDLTDCGVNDEALHHLAKCSELLILKLGLSSSISDKGLGFISSKCGKLIELDLYRCSSITDDGLAALANGCKKIKLLNLCYCNKITDSGLSHLGALEELTNLELRCLVRITGIGISSVVIGCKSLVELDLKRCYSVDDSGLWALARYALNLRQLTISYCQVTGLGLCHLLSSLRCLQAVTMVHLSWVSIXGFEMALRAACGRLKKLKILSGLKTVLSPDLLQLLQACGCRIRWVNKPLVYKDAI

SEQ ID NO: 109486 - protein, 130 aa, Triticum aestivum
  unsure (1)..(130): unsure at all Xaa locations
  Clone ID: PAT_TA_3904.pep
SLXRRPLGPSPCTRSPSLFLSCGLPHYCCSRRRARPLPLPPHHLLLLGNPRASTLLAVRILARHKKWARVGRTRPWLGFQAGHRLRRRRGSGGLRWLLSVSFSVPTRGSASRRPWGAALQGRIGLGILCF

SEQ ID NO: 109487 - protein, 198 aa, Triticum aestivum
  unsure (1)..(198): unsure at all Xaa locations
  Clone ID: PAT_TA_3905.pep
MASEWEMAMGVELGMGMGSYHNASNVHAAPMGHQAGGYAAAAHHFYGIQPMRDANMRVDELLDFPTAGAHDFFPAAPENALHHHQHLGAGVGEXVGNNPSATSSDHQTSMLSFADEFYIPSEEAAELEWLSKFVDDSYSDMPNYSSAAHAAMAAANAANNGGGSSAGQDSCVTAVPGRGARNKXXARRGRRRWNAEPP

SEQ ID NO: 109488 - protein, 162 aa, Triticum aestivum
  Clone ID: PAT_TA_3906.pep
KRRKSCRRSEDILFTCLEITSFAQLLLYVSLTRRKRVAELENVHNSLAEELQKRYICPGCGTNNMAPEQEEAARGAGAAHSLRSSRSATYALAAEPTTRRRRRRQHRQRRWHANTRRGEPAGRWGSAGPGRGMSCPAVRDAAPEARGRKNPRRLAGCTLASG

SEQ ID NO: 109489 - protein, 114 aa, Triticum aestivum
  Clone ID: PAT_TA_3907.pep
PHLPLPQGVVGVHGKRQKFLGDEELLKHWLQCKASMWPNQLNGMLCWALNHYVKSCEFALLLFEETVNFETLVARDGKLDVWCMFSTGRNFLPYHLLSYMLVLVHVLDASDLVT

SEQ ID NO: 109490 - protein, 66 aa, Triticum aestivum
  Clone ID: PAT_TA_3908.pep
SMTAGQHAWLHLFNFIFSFFLISYHCTIPSLFSYSVLSDALSLSHLKFLRILSAHNISLWFKHLST

SEQ ID NO: 109491 - protein, 116 aa, Triticum aestivum
  Clone ID: PAT_TA_3909.pep
FILLRAFPNLHQYSSMIHPSPFRFNKSCSVSPKNQSSVGHMKNNNWSSRRDASIYHGGSSHRNFIVAPVAETLIESDEERCESLYGNALDTLIWMLNLSPRHRIQDFPTPSSRRRC

SEQ ID NO: 109492 - protein, 457 aa, Triticum aestivum
  unsure (1)..(457): unsure at all Xaa locations
  Clone ID: PAT_TA_3910.pep
MQPTYQPPMNGQHAPQPQASGAPPPPLQQAPPPPQYYQAPPQYYQQGPPPAMWGHPQQHMPPQYAPPPPQYAPQPPQQYAPPPQHYAPPPPQYGAQMAGGPPPGGEDIRSLWIGDLQYWMDETYLYNAFAPVGPQQVTSVKIIRNKHTGQPEGYGFIEFQSRAAAEYALGTFNGQMMPNVEQVFKLNWASCSAGDKRGDDGSDHTIFVGDLAADVTDAMLEEIFKATYPSVKGANVVTDRATGRSKGYGFVRFGDLNEQTRAMTEMNGVPLSTRQMRIGPAANKKNMGTQQTYSTNGYQSSQVNEAANDPNNTTIFVGGLDXQVFTPYGEVGXVKIPVGKRCGFVQFTSSRACAEQAISALNGSQIGSSNVRLSWGRSQNKQPPQQDANQGNGNSYYGYQQGXPDAYYGAPNAQDPSMQNYGYSGYGSYEQQQQPSQQQQPPQQQPPQQQQQQPPQQ

SEQ ID NO: 109493 - protein, 133 aa, Triticum aestivum
  unsure (1)..(133): unsure at all Xaa locations
  Clone ID: PAT_TA_3911.pep
AAPPAPEPRPGPGLRARRPPPAGPHGTPPPSPLWLPPPPPPPGLSPPAASSPLSGFGPPPTGFGPPASGFRPPAGSRPPSARRPPAPXSTGAGPPGQAPPSRLTASGAATSPLWLPPLLCPPLFLPSSSRRPI

SEQ ID NO: 109494 - protein, 276 aa, Triticum aestivum
  Clone ID: PAT_TA_3912.pep
MPMPMPPPLPPLPRLLLLLFLAPLLATPTTIPLYRHLPPLPPAAAQHHPLSRLAQASLARASRLRAGHGHHQGQGQASSPVRAALYPHSYGGYAFSLSLGTPPQPLPVLLDTGSHLTWVPCTSNYQCQNCSLAAAGSFPVFHPKSSSSSLVVSCSSPSCLWIHSRSHLSDCARSSAPCRPSTANCSATAKNVCPPYLVVYGSGSTAGLLVSDTLRMSPRGAARRNFAVGCSLASVHQPPSGLAGFGRGAPSVPAQLGVTKFSYCLLSRHFDDDATV

SEQ ID NO: 109495 - protein, 74 aa, Triticum aestivum
  Clone ID: PAT_TA_3913.pep
QHQNDVKDKPENATSNEKAIYKKLAGLRDKPKGRNQKAKKTSKQNITKNTDLNRTEQDLLDGVWRSSMHNNVQV

SEQ ID NO: 109496 - protein, 434 aa, Triticum aestivum
  unsure (1)..(434): unsure at all Xaa locations
  Clone ID: PAT_TA_3914.pep
ARGVLNPWERNENHTLCLNSAKAIGCTVVNIGTQFLVEGRPHLVLGLISQIIKIQLLADLNLKKTPQLVELFDDSKDIDEVLSLSTEKMVPRQMLHLQKTGTTPPQVLNLQKTGTTPHDPDGYIFLRSPVHQLALYTRVGTKSCCCYXRSEFFSEFSGSIXVHTIIQIDRSRRLFIKDIYRHIHIVGRRLVDVLVSREERAFRMWINSLGVESYLNNVFEDVRNGWVLLEVLDKVSPGSVNWKLESKPPIKLPFRKLENCNQVVKIGKELKFSLVNLAGNDIVQGNKKLIVALLWQLMRFNILQLLNRLRSHSKGSQGKQITDADILNWANSKVKASGRTSRMESFKDKSLSNGVFFLELLSAVQPRVVNWKVVTKGEADEEKKLNATYIISVARKLGCSVFLLPEDIIEVNQKMILTLTASIMYWXPAETTTA

SEQ ID NO: 109497 - protein, 201 aa, Triticum aestivum
  Clone ID: PAT_TA_3915.pep
MMFQSHTISNTQLWRTEDGVGGVHCDLVPGGVSDGGDVGGRGAVATAGWPPPTQATGSPRPTPEEGPPRSVPTGGAPPWVISSSALFWVRWKTGAALNLVRALLLNSKPHARRRPRLGFGGSQVGRRCWLTESRPSEAASHLTPSSGRSSRPRLALLPTVDGGEGGEEQGSGSRRISIDPAAGSADPAGAVGRRPFRDQIC

SEQ ID NO: 109498 - protein, 87 aa, Triticum aestivum
  unsure (1)..(87): unsure at all Xaa locations
  Clone ID: PAT_TA_3916.pep
FFFFYGIEARHHPWVPKYSTPHXEGCNVHIQGKLKDAMFIHINIECKSTNRRAEGDVFTKGEGDHTVVCTVHHRSWWHHISSRTCQS

SEQ ID NO: 109499 - protein, 127 aa, Triticum aestivum
  unsure (1)..(127): unsure at all Xaa locations
  Clone ID: PAT_TA_3917.pep
MGYDLAWLKELDGVYFEIWRRVTQGMSFKDALAEVCHLNRVPVXQPRMERALEFDEAMEEMEEEFRICTAAITPEVKEDKARELIAGAVKELLDDTPKSYEQYIIKKMHIARVVGILPDKRIEDSQE

SEQ ID NO: 109500 - protein, 173 aa, Triticum aestivum
  unsure (1)..(173): unsure at all Xaa locations
  Clone ID: PAT_TA_3918.pep
TLLLRRQCLPQVSPPHRPKRAELPARDPPPPAAXPTPNRAPKPPRRPPRLPPTPATSTPRSAAPAARPPRRPPQPPGRGIPRRPPTAPSACRPSTRPPTPLPSSSPRSRSPCRCRPPCRPSPSXPPPSESRPPTTSRASRTQPRAPLPRIPRLARAWRRRAGPSIPLSGLIIR

SEQ ID NO: 109501 - protein, 170 aa, Triticum aestivum
  Clone ID: PAT_TA_3919.pep
GLPFSALNKLGVPGLGAVTTGQVYDRHFKDRDTGTFKDFHLAYVEFCKYFNTVLPGQDFDTPDRGDLEAFHKKWAVADEPGRRKMFIEYMQENVHEAKVDDSLFIMAGLAAPAAAIIAKKSGESIPQVKKFKVHLIPNVIFVPVCTLVAIMGATAVQMSKKSKDNNKPTS

SEQ ID NO: 109502 - protein, 75 aa, Triticum aestivum
  Clone ID: PAT_TA_3920.pep
MSADWSDDNTTILTELFVQQVRAGNRPDKHLTQNAYEEVAKDFKVRTGLEYTRLQLKNKWDKLKTDYSNFRKLKL

SEQ ID NO: 109503 - protein, 204 aa, Triticum aestivum
  Clone ID: PAT_TA_3921.pep
RHHHLLPLAPPPPRAPCNPSPCCSSTFLLVLTLLLLFFFFPSLFAALPSPNPQTASPLPYTPTCCSSSPILRAPPTGCSLRSKRPPACLLNLLLLPPSSLLLAACTFSEIPNPSCLFLLLLTSVQTAAACPHPSLLLLSPGCHCCYLFLSSPAAAAVLLLISKSLLILPTPKLLLLSLATPIAVLLLLLTCCSSSSPNLAAVLF

SEQ ID NO: 109504 - protein, 182 aa, Triticum aestivum
  Clone ID: PAT_TA_3922.pep
MASAGEHTVPLLDRPPPEAAEAYTTDGSLDFDGNPALKNRTGGWRACRAVLGNLFLVPIEISTVIWFRPHLVRAGADFCYCLAFHGISYNLVTYLTAVLGQSNVVAARSVSSWKGTCYLTPLAGAVVADSYWGRYRTMVVSCSVGVAGGPFPPLSASPPLLLSVPESESPCHVPVEQFRISF

SEQ ID NO: 109505 - protein, 247 aa, Triticum aestivum
  Clone ID: PAT_TA_3923.pep
WLAVFPFVAMQGEEGLMHCICGAGGDPHRRRFDRSPLRLRRQSPWSPCERSLLRLRRRSNKGHPWWGWHPRPARAGPRLPAFHPRPPAPSGPPRTTMKRRVWRGFLHRRPSAARPPAPAAGGAVCPRPRALANRSCGCSCGMHAIAAFCDCFCFSPYSSCGGSRVVIGLSGYGDRGPDASRRWLATRSEGGAPSPPCGLGPCSWKTTSTRPGCLWRCAFRPRPRSVRKYVLKVSNAWIPMWLPLNAS

SEQ ID NO: 109506 - protein, 138 aa, Triticum aestivum
  unsure (1)..(138): unsure at all Xaa locations
  Clone ID: PAT_TA_3924.pep
MAIVYALVARGTVVLAEFAAVSGNAGAVARRLLEKLPSEAEARLGAAQDRYIFHVLRSPADGSHLPXMANDTFGRRVPFIYLEDIQMRFMKNYGRVAHSALAYAMNDEFARVLHQQMEFFSSNPSADTLNRLRGEVSE

SEQ ID NO: 109507 - protein, 203 aa, Triticum aestivum
  unsure (1)..(203): unsure at all Xaa locations
  Clone ID: PAT_TA_3925.pep
IAWIQVQRQGEFTLEFLEQITDNFSARPVIGRGGYGVVYKGVLENGEEIALKKLHHVPGLDDTQFMNEFNHLMRAQHPNITRLVGYCYDTGHQRIKLGGDYVFALVDERVLCFEYLQGGSLDKHISDESCGLDWHTRFKIIXXVCDGLDYLHNGCKDPIYHLDLKPANILLDKDMVPKIGDFGLSRLFPSTKTYVTIKIIGTP

SEQ ID NO: 109508 - protein, 141 aa, Triticum aestivum
  Clone ID: PAT_TA_3926.pep
IRQLEINPTKGNKSWSSTAVAAALELVDPPGCRNSAPERANPHITAAASSFLIHRPAAPGLPRPSSPSKPVGPTPPSALSRNSARPPPCSFWFGRGSPDRASHVAACSPDDQRCCRRPPPGTAPPRLPSILLLFLRRSSRF

SEQ ID NO: 109509 - protein, 98 aa, Triticum aestivum
  Clone ID: PAT_TA_3927.pep
WDDMGSAKDESQNGLDGSYKELYQRENPHGDADEHMLEMIGSEWEGLNRECFSGTKSTLSHSFITASLNFARMVRVMYGYDDEQKLPVLEDYTRMLLF

SEQ ID NO: 109510 - protein, 233 aa, Triticum aestivum
  Clone ID: PAT_TA_3928.pep
MSSDPRNPNPPPPPPPGSSSSALPAGGSYFPLPFHLQQQQPVATYQYQQLQQAQQLFQRDAQTITPEALESVKAALATSDVLDPSAARASASSSDAAAKKKTIPRRAAGQSWEDPTLTEWPENDYRLFCGDLGNEVNDDVLSKAFSRFPSFNMAKVVRDKRTGKTKGYGFVSFSNPTDLAAAIKEMNGKYVGNRPIKLRKSNWKERTDVEALQRQKNHIQKKPKTQKKGILHK

SEQ ID NO: 109511 - protein, 80 aa, Triticum aestivum
  Clone ID: PAT_TA_3929.pep
MGFMLRVRLASFFAGAAAAAAGGSYFLYKDYKLAHDSTALKVKGLHDHVDARYKALDKRLAALEAQKSTDSSPAVDAPSG

SEQ ID NO: 109512 - protein, 261 aa, Triticum aestivum
  unsure (1)..(261): unsure at all Xaa locations
  Clone ID: PAT_TA_3930.pep
MALVSLSLSPPCAPAASSSSSHLLTPPSLAGGSGSIRRGGPRGNAGLALTLPAGRRGREWRAPVSSFSSFLPSFFTGSKKKEEEDAKKAATLKEELLAAIAPLDRGAEATPEDKDRVDQIAQQLEEVNPTKEPLKSELLNGKWELLYTTSTSILQPQRPKFLRPYGMIYQAINTDTLRAQNMETLPYFNQVTANLVPLNSRKVAVRFDYFKIFSLIQIKAPGSGKGELEITYLDEDLRVSXGDKGNLFXLKMADPLYRVPL

SEQ ID NO: 109513 - protein, 557 aa, Triticum aestivum
  unsure (1)..(557): unsure at all Xaa locations
  Clone ID: PAT_TA_3931.pep
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGGSPGTWRSTTKVQNALEAVXSLSGKCRRPMDTYLPPFVIVDESGKSVGPIVDSDGXVVTCYCLNXRMDMLAKALNSLEQDSGLVLVTAINCAGRLXYDGELKLPTXYLVSPPLIERTPGEYLVKHGVRTFACSDTVKFGHVTFFWXGNRSGYFDETMEXYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 109514 - protein, 119 aa, Triticum aestivum
  unsure (1)..(119): unsure at all Xaa locations
  Clone ID: PAT_TA_3932.pep
MYRGLRISQVVPQLLPDIFKKAELVEGDGGVGTVLHLTFSHGVAPLEYQKEKFIKRDHENYVXGLXIVEGGLLDHGFQKYLMRIEIIGQTDKTSTIRSTIEYEXMTTSQATHPLSVPVH

SEQ ID NO: 109515 - protein, 125 aa, Triticum aestivum
  Clone ID: PAT_TA_3933.pep
RPRVRPRVRPRVRIHSLSRALSLSWSRRLHSATVAGRARRRRHCPRGGQRGYTANTLHRNRARRPRRVGERATWRDLGWGSTAGRAVVEAAGERCAAPVGRSLHNPVGLQSEPADQANGRCTLAS

SEQ ID NO: 109516 - protein, 303 aa, Triticum aestivum
  Clone ID: PAT_TA_3934.pep
MAAVATILCGGAVAGHQRSRRRAAPSLHVRGGSASDAAHLVCGRKLRPALFPASSFGALPLSSPGSRKLLRTSASAATPSSDSQGQAKPIGFLERYPALVTGFFFFMWYFLNVIFNILNKKIFDYFPYPYFVSVTHLSVGVLYCLISWSTGLLKRAPMNSTLLKLLLPVAICHAIGHVTSTVSFAAVSVSFAHTIKALEPFFNAAASQFILGQQVPFTLWLSLAPVVIGVSIASLTELSFNWTGFINAMISNISFTYRSIYSKKAMTDMDSTNLYAYISIIALIVCIPPALIIEGPQLVHQGL

SEQ ID NO: 109517 - protein, 191 aa, Triticum aestivum
  Clone ID: PAT_TA_3935.pep
AGGRPPSVQHGARRPPPAPPRRARPAAGGAGGGGGGRRAAAAGAGAAGGEHSVAQAAARPPPLAFPLALPRPRARSQHGGVATPAGGARGAEVRGPHKAHARLAGLLPHPRRRPAPPPAGAPPPPRPAPAPLGRPAAGRPRAALAHAPLAGVLRHPRRRRARLRHGRLLPARQVGAPQLPRRDLRAGAVVA

SEQ ID NO: 109518 - protein, 544 aa, Triticum aestivum
  unsure (1)..(544): unsure at all Xaa locations
  Clone ID: PAT_TA_3936.pep
MALHAPVLVLKDSLKRESGAKVQHGNIQAAKAVSDIIRTTLGPRSMLKMLLDASGGIVVTNDGNAILRELDIAHPAAKSMIELSRTQDEEVGDGTTSVIVLAGEMLHVAETFIEKNYHPTVICRAYSRALDDAIAVLDKIAXSVDVKDGEAILGLLESSLGTLLTVQLRHLIEDVAIEATKSVXNKFMKVNKIPGGQLEDSKVLKGVMFDIVVVAPGKMRRKIGNPRIILFDCPXEYKKGENQTNAELMSEEDWKVLLDMEEEYIKNLCVQILKFKPDLVITEKGHSGLAMHYSRKAAVCASCRLWKKDNSXIPKAYGGVIVNRPEELQESDVGTRAGLFEVKKIGDEFFSFIIECKDPKACTVLLRGASKDILNEVERNLQDAMSVARNILKNPKLLPGGGASELTVSATLKQKSSSVEGVEKWPYEAAALAFEAIPRTLLQNCGLNVIRTMTQLQGKHANGENPWVGVDGRTGDIVDMKERKIWDSYSVKAQTFKTAIESACMLXLRIDDIVSGIKEEAGSWLSVLLSNPRLKRVKMRTLNR

SEQ ID NO: 109519 - protein, 121 aa, Triticum aestivum
  unsure (1)..(121): unsure at all Xaa locations
  Clone ID: PAT_TA_3937.pep
ALTVKTIYESLAKRXXXKXXMETANYEIKKELVKQGGRLXAVNLESRAGLLAARQGLARAASRYVGLRSFMSLLGPIMWGTLLADIVIQMLGTDYARIVQAIYAFAQIRLTRSCYLESHEE

SEQ ID NO: 109520 - protein, 283 aa, Triticum aestivum
  unsure (1)..(283): unsure at all Xaa locations
  Clone ID: PAT_TA_3938.pep
MAKSGKSAEAATSTAPPPSPSPAIKAKAKPRLEIEGYPVEGISIGGHETCVIFPTLSLAFDIGRCPQRAVAQDFLFISHAHLDHIGGLPMYVATRGLYRLRPPTIFVPKYLRELVERLFDVHRAMDQSELNHALVPLDIGEEYELRRDLKVRAFKTYHTIPSQGYVIYSXKQKLKKDYLGXSPGSEIKRXEAVKAWRLTNTVANTPRLLSTGGYDVQFHPWXLDNADVLEGKFLGDGRXFSLDDSVPDWTMPRDMGHTVLNCEHPELTDHLTITFGSYTTEEM

SEQ ID NO: 109521 - protein, 191 aa, Triticum aestivum
  Clone ID: PAT_TA_3939.pep
VLSSPEVGIGPYVEVAFYHKPSRTLLVTDAVIFVPRQPPDCISKESLLAAAKNGLAVKILSKGREVPDDPVEDNKLTRQTGWERMVLQILFLGPSNLLEPNASFAQMSQKLIVSPIVKTLVFSKVPEKVRDWVDRIAADWPFRRIIPAHFAAPINASRSDFLAAFAFLDEFLPDRPAASLGLPLIFASLMG

SEQ ID NO: 109522 - protein, 212 aa, Triticum aestivum
  Clone ID: PAT_TA_3940.pep
PNRSCTTATALLGDALRQAIMPRGAYEALRDEERALPLAAAAAACVAFATVAAVGISLGIVFPAEPADRPFCRERRMLEALPAAASSREEEPEAYRYRGGAFYMTTAEAADFYWMVVLVPSAVLFAASAAYLVSGISVAYAAPRRHPFICTVENNFCASRRGGMRCLAIVNAAFALIFGLMAIVFGSMLLALGSSCSIPLFWCYEIAAWGLV

SEQ ID NO: 109523 - protein, 175 aa, Triticum aestivum
  unsure (1)..(175): unsure at all Xaa locations
  Clone ID: PAT_TA_3941.pep
MASLSLSLRASASSAAAGSRAAAPIKASCVRSKVTCSLPSIRATSSPARSIEPVRATATQAPPATPQSSSREKTKVGINGFGRIGRLVLRIAIDRDDIEVVAVNDPFITCXVWAHTRTFHSTHGPSGGAIXVWNGSTVADSCEGDPTDIPWGPSGAPWGXLGAEYVVESSXVLHS

SEQ ID NO: 109524 - protein, 349 aa, Triticum aestivum
  unsure (1)..(349): unsure at all Xaa locations
  Clone ID: PAT_TA_3942.pep
ARGFFINSTTTELFAYQGRLNYQKGAATKEDAPDSVYNTARRLAVQNRTSPASNMTWQFDVDGRSSYLIRFHFCDIVSKAAYSLYFDIYVDGGLALENLDLSEKVFGTLAVPYYTEFVLKSSNPSGKLSVGIGPSSLNNVALDGILNGLEIMKMNISTGTIYVVWPPATPKRKLAIILGPVLGGVGAVSIAIILCFVLRRKKKEKKPRRAPTSRPSSSWSPLTLNGLSFLTVGTRTTSRTTHTSGTNSDVSYRIPFALLQVATKHFDEXMVVGVGGFGKVYKAVLQDSTKVAXKRGNXKSHQGLKEFRTEIELLSGLXRHRHLVSLXRXXAMXRXKMVLVYEYMGEKHE

SEQ ID NO: 109525 - protein, 105 aa, Triticum aestivum
  Clone ID: PAT_TA_3943.pep
LAAPLVLLLAWLTKRRSLGGGTTARPGRRAKTAEASACRQESGGSSRTTSTYRPIRRVVGRASSAAGGDECHRALSSAACSRCRGVPVVVCRPPCGRERAARGIH

SEQ ID NO: 109526 - protein, 140 aa, Triticum aestivum
  Clone ID: PAT_TA_3944.pep
DDDRNNIERLTLAVLSYMPIAVLYVHDLSEDCGTKVADQYITYKHIKERFGDRLWIDVVSKCDLLDRATPSRFDDAADDGVDDELRRYREFGPEDAIRVSVQSQTGTQELKQRVHHLLTSQMARIKAAGGDNDEAVSEVR

SEQ ID NO: 109527 - protein, 101 aa, Triticum aestivum
  Clone ID: PAT_TA_3945.pep
YRLCCCCCYTVRSVSMVCSEVWRMAVGVMPHAPLRARAFLQVDDARSACLAAARELLRRLLVHSVLVEVGAPAVVAGHRMGIHRLLALFLLLLLLLSSPSC

SEQ ID NO: 109528 - protein, 1031 aa, Triticum aestivum
  Clone ID: PAT_TA_3946.pep
EALENNAAVLEEEENTFAENPTANPTQKQGPMQFTFESEVDRIFSSPQESSLLYVISGKHIGLAKLLTGYRPPARPRLPITTKTDGKKFIKLKPNETVLQVHWQTTLRGPVAGILTNQRVLIASADLDILSSSSTKYDRGLPSYRSMLWVGPALIFSSATAISMLGWDNKVRSILSTSFPRSVLLGALNDRLLLVNPTDINPRQKKGVEIRSCLVGLLEPLLIGFATMQQHFTQKIDLSEVLYQITSRFDSLRVTPKSLDILSKGPPVCGDLAVSLSQAGPQFTQIMRCNYAIKALRFSAALSILKDEFLRSRDYPQCPPTSHLFQRFRELGYACIKYGQFDSAKETFEAIADHESMLDLFICHLNPSALRRLAQKLEESGTDPELRRYLERILRVRSTGWTQGVFANFAAESMVPKGPEWAGGNWEIKTPTSMKSIPQWELAGEVMPYMRTTDAAIPSVIADHIGVYLGVMKGRGNVVEVSEKSLVKAMAAASSENGQPASSELALKNKANAAGDSVGDSLARQLGVQIASADEQAKAAEEFKKTLYGVVDAGSSDEDESTSKTKRIQIRIRDKPAAPAVDVNKLKEATKQLGLMAPPISRTRSSGTPQEFSQPAGPAPSAAPAMPSGAVDFFGTNTLVAPPQAPTGGTGPVIGGLGVTAGPIPEDFFQNTVPSQQLANRLPPPGAILQRMANPESGMNVGRPVPTQNMMGNVGLPDGGVPPQGPQQGQFPQQQGQFPQQQGIPMNPIGLPDGGVPPQSQALPSQPQGFQPAAPTPSQPIDLSALEGPGAAKQAAQPPAPKAVRPGQVPRGAPAAECYRMGLAHLEQNQLTDALNCLDEAFLALAKDQSREADIKAQATICAQYKIAVSLLQEIARLQRVQGAGTLSAKEEMGRLSRHLASLPIQAKHRINCIRTAIKRNMEVQNFAYAKQMLDLLYSKAPPTKQDELKSLIDMCVQRGLTNKSIDPFEDPSQFCAVTLSRLSTIGHDVCDLCGAKFSALSAPGCVICGMGSIKRSDALAGAGPVASPFG

SEQ ID NO: 109529 - protein, 269 aa, Triticum aestivum
  Clone ID: PAT_TA_3947.pep
ELPCCFIYQNLKSFHVSAIVDNRVAGRDYRYDDAVQLRQLCKISGVKVSFDAENARDSFYRATTGFVLDDCSRTAEDMGTAQINGENPRDFLAGLSMNIGLDKFRAATLVCASVAARTRACLLQCWALEIQGKRAEALDELVKICRIHRVFPPEENSAEMEMVAGGLKKNLEVAERVHLLSLYRGACTTGVKTAAEALGLLLRRLRGSSQLRSVGRRLLRRKSDALMCEAAKRRPEHLAGAATYTAADTPTLRPATKASAGRRRCVHTP

SEQ ID NO: 109530 - protein, 206 aa, Triticum aestivum
  Clone ID: PAT_TA_3948.pep
RTVSTAPPHVGGREPEKPSQPPRRQRAAVQCRNRNHECPEGATLRLPRGIIQSNPSVCGTWEFRSSSDQVGFVARPPAGGAALGLARAEAILRPLWLPCVGPRSSARFSRLVGCPLAPCRSSVSRCPSRGGHPVSGFSGLPLRGPTFPWSDLRICPGCLLGSRESGLLRPSVGNAGGMCDSAPLHRCSMLATFLPGCLWHTLARVF

SEQ ID NO: 109531 - protein, 150 aa, Triticum aestivum
  unsure (1)..(150): unsure at all Xaa locations
  Clone ID: PAT_TA_3949.pep
PEWPLDEGTLSEPVLRRPPTTSAIQLLLTERSSRTPIRSLTGHGRASPAPSAVWAQWRTERQHSHGDVTARICQCPGATRPPSSPHASXSLTPMDXEGTXGLLXGLXPPMRRRXRRGXHXFSITXCVPLAXPSARXIFTRXRXXGXGXRD

SEQ ID NO: 109532 - protein, 298 aa, Triticum aestivum
  unsure (1)..(298): unsure at all Xaa locations
  Clone ID: PAT_TA_3950.pep
GRRVGGSADRLRDLPSFLTIASDDHPYSFVLAAFRELLDVLDREDSPTVLANTFXALEPDAVATLHQHGINVVPIGPVLSFLDASAAAAANDSNDLFKQDGEGYLEWLDAQEAGSVVYISFGSLSTMSKRQIAEVSRGMAESGRPFLWVLRKDNRGEVDGDDLCTGGGMVVEWCDQGKVLSHPAVGCFVTHCGWNSTLESVACGVPIVGVPQWTDQGTNAWLVERQLGTGVRAAVSEKDGVLEADELQRCVGFATSDVVRAKAGAXWREKAXRAAAAVGGSSERNLRAFVCQPAGRPR

SEQ ID NO: 109533 - protein, 66 aa, Triticum aestivum
  Clone ID: PAT_TA_3951.pep
QPRLPPAPRAPPPGPSAVRRPRPPPSPARRAPSPPPPPPRASPSPRRPRPAAPEHAASETPRTMWM

SEQ ID NO: 109534 - protein, 184 aa, Triticum aestivum
  Clone ID: PAT_TA_3952.pep
CAHRTPDVDDYPDNQFTFSVKHLAPISLTCLMPPSYLSHHPPYFFLGVQWLDTVKVSTLCHMLESIWAHQSAQEVFLIVFEWVQGFTLSHFGFDSGIIVRMSDSTTAPVDARVVGEILSVEDVVQRLINYDEEQCLETLIRGLHICAICFSEHPDNSDAPFDSWILSLLLISQLHLHCNLNLLF

SEQ ID NO: 109535 - protein, 380 aa, Triticum aestivum
  unsure (1)..(380): unsure at all Xaa locations
  Clone ID: PAT_TA_3953.pep
RGRGRGLSIPLSDVWADAAFRTDVVKYAFTGLMRDLRGIAMATNSRXTYGLLFDWLYPSRMPLLLXAISLLTDEPEVTTPLLKFMSEFVLNKAQRLTFDSSSPNGILLFREISKLIVAYGSRILLLPNGTNIYRSKYKGIWXISLTVLSRAXLCGNYVNFGVSGLRGASALAVALDISLKMTLSIPLADILTFKKLSKAYYGYMEVLFNNHITINSVLNLDTSTFVHIVTSLESGLKGLDTGISTQCASAIDSLAAFYFNNITAGDNPPSPAALNLARHIGELPSLFPQILKSLFEIIIFEDAGNQWSLSRPILSLIMISEQMFSDLRAQILASQPLDQQQRLSQCFDKLMTDVTRSLEPKNRDRFTQNLTTFRHDFRAK

SEQ ID NO: 109536 - protein, 237 aa, Triticum aestivum
  Clone ID: PAT_TA_3954.pep
MSSSSAAAEQHRHHAVGGRELVPLAALIKEESRTERHAVTRSRICAREDGGVGGEVGEAETRRPLLRYGCAAQSKKGEDFFLLRTDCARPSTSSSSSTTSHPPTFAVFAVLDGHNGDAAAIYTRDNLLNHVLSAMPQGLSREEWLHSLPRALVAGFVKTDKEFQTKGQTSGTTATFAIIDGWTITVASVGDSRCILDAQGGAVSLLTVDHRLEENVEERERVTASGGEVGRLSVVGG

SEQ ID NO: 109537 - protein, 128 aa, Triticum aestivum
  Clone ID: PAT_TA_3955.pep
NPPFTQRPSPAAKLGAGDPVPSADRATHRTNQHGLLSKMVASVHRGLPPFAGEHRRSPASFGQRKEAGWTVVKADQWARWDPLRLAGNPRCVDKWGWVPLKLLSHGKNVFQRIRLWRRSPPARSSDWA

SEQ ID NO: 109538 - protein, 201 aa, Triticum aestivum
  unsure (1)..(201): unsure at all Xaa locations
  Clone ID: PAT_TA_3956.pep
QVQLRPLQRLLLLLPRAPSPQAALGLVSLLLVCPLLLLLVARRLATPSTAAATARAREELLSRLPSPPXRLPVVGHLHLVGPLPHVSLRDLAAEHGRDGLMLLRLGAVPTLIVSSPSAAQAVLRTHDHVFASRAYSPVTDILFYGSTDVAFCPYREHWRQVKKIATTHLLTNKKVRSYRHARENEVRLVVAKIREAAAAGT

SEQ ID NO: 109539 - protein, 347 aa, Triticum aestivum
  unsure (1)..(347): unsure at all Xaa locations
  Clone ID: PAT_TA_3957.pep
MRPLIRTACLRARVRAMATLPATAAFSSTRAPSPCPSPSRARRLLFAARFLPSAPPPPAGARALRTSAAAAEAAVEVGGVKIAREDVVKEDDPTNNVPDTIYSKIGLQLHRRDNHPLGILKNTIYDYFDKSFPGQFVKFDDLCPLVSTKQNFDDVLVPADHVSRSYNDTYYVDSQTVLRCHTSAHQAELLREGHTHFLVIGDVYRRDSIDSTHYPVFHQMEGFRVFSPDDWSGSGMDGTAYAATDLKKTLEGLATHLFGAVEMRWVDTYFPFTNPSFELEIYFPRXDWVEFLDSGVTEQGNFXKAMGRQXKXPWAFRTXAFERLTMASLDIPNIPXSWQMIGQIQFS

SEQ ID NO: 109540 - protein, 138 aa, Triticum aestivum
  Clone ID: PAT_TA_3958.pep
SLPRTRGPEHIREVDRVAYEPIIISFGPYHHGGQHFQYMEKKKWEHLDRVLKLNCNRTLHDYIKAIAEVEKQARKCYSEQIIMERKKFVQMLLLDGCFILVNIDENVGTRMSNSRTLNQGSTQTEVDGNVTGEELEQI

SEQ ID NO: 109541 - protein, 185 aa, Triticum aestivum
  unsure (1)..(185): unsure at all Xaa locations
  Clone ID: PAT_TA_3959.pep
MKSKTNRGMQKAGRVDHLQGGGPNWILVAGGVLLSTLSVKLGCKLKQMFDTKEQNGFSKAESRPGGCELHSNLCRFRGQTSCYYCISGHSDGGSGSQASSXSPSKSAEPSLPLVKIPVQESSKDNSGVMWISSPDRLEDPRKPFQYSNSSGSPRVSESGSDIYSKREVIQKLRQHLKRRDEMIME

SEQ ID NO: 109542 - protein, 218 aa, Triticum aestivum
  unsure (1)..(218): unsure at all Xaa locations
  Clone ID: PAT_TA_3960.pep
YSLVHKAQSRDDSYTEELDKVFEKHMAAAKDLLDGENLARFLSELHSDISNLRAMLRAIYIXAGHATESFSEFVVGHGELWSSQMLSYAVQKSGASCSWMDTREVLVVKPXSGPDMVDPDYXESEKRLEKWXFSRQPAEIIVATGFIXSPAENIPTTLXKRDGSDFSAAIIGSLGRARQVTIWPDVVGVFRPVPEGQEVXDLKHIIYQXAWEMHXWNV

SEQ ID NO: 109543 - protein, 137 aa, Triticum aestivum
  Clone ID: PAT_TA_3961.pep
RVRCPPRAVRWCYACSAQVSRTAARFGGRHCPPTGMCAVQSGGEGSHLLSRVQLLLVVVRGRGAAQLAIVAGQLGVGAVRKHLRGRLARTSVSAVRRCSMDARGRRFVAAVCLVLAGGSSAGPCSLPGAVRPVDGCG

SEQ ID NO: 109544 - protein, 165 aa, Triticum aestivum
  unsure (1)..(165): unsure at all Xaa locations
  Clone ID: PAT_TA_3962.pep
CATAYLSQAKPPAPIAVVLTPPPPLLPASHAAVKLFPMVAATSRHGWWWELPLSRSSCAPTRGRATGRGRVQEMRXRPRREVCCIRSLKEAGTVDKACCNRAAKXSCKGGEQRLVVGRLXPHGVANPWXYFCWIPRGKHYIKTAGDETXTACCIXEXLLERPTKN

SEQ ID NO: 109545 - protein, 111 aa, Triticum aestivum
  Clone ID: PAT_TA_3963.pep
SPVTVDQQLENLTAEKIAQKEKAAKVPEDLLYKRIAEVKEKERQNTLEEIIYCWILFKFMENDIQMTPALSSSGGPVRDVSSLPNQEYKLQSIHSQDALEMIQNHLNLIMG

SEQ ID NO: 109546 - protein, 86 aa, Triticum aestivum
  Clone ID: PAT_TA_3964.pep
SRHITAIWVLSAAHHVGIFRKFQKDGPCAGCRHSPYPVQGHSKFHQVQVVARAQKLARQYNPALPVSGFLVLLVVYKHMVLLPEVP

SEQ ID NO: 109547 - protein, 133 aa, Triticum aestivum
  Clone ID: PAT_TA_3965.pep
RIRAILLRAPPSRLTSALKARTPGKRNTEEITPLNCDKRRQQSSAAEDGVEGVRSSAWNQPSQLITSSRGRCSSSHRCRRRQGGRGWRRRSRAGSSNEGVAVGAEESEGRRRRSPGKVEEDRGRGASCRIRHE

SEQ ID NO: 109548 - protein, 112 aa, Triticum aestivum
  Clone ID: PAT_TA_3966.pep
MPKAHEEEVPAAGADSEELEPLFDYSRVQPTIDFCFDDSDLEKSDIGGHCNKRPKVPADNANAVEGGKANEKGDAGIKKATVVNLDDEDWLAPPPLKPLLSTEVCKDKTMHE

SEQ ID NO: 109549 - protein, 100 aa, Triticum aestivum
  Clone ID: PAT_TA_3967.pep
DTYRVFHYSRVTSIHIQTSSCTSYCYWLLPLSLWSLLFLLKQFTPTLFIRTHRCTPIHRTTTLTHFLTIHTSLYFVDEYIFSTNFKTIWSYSANFMKTTT

SEQ ID NO: 109550 - protein, 109 aa, Triticum aestivum
  Clone ID: PAT_TA_3968.pep
MAAHGLLSGRQLLGRPLQSSISRSSSSRKSAFVVRASSSPPAKQNDNMQLWFASEQSLTYLDGTLPGDCGFDPLGLSDPEGTGGFIEPMWLAYGEIFNGRTAIMGVVGM

SEQ ID NO: 109551 - protein, 179 aa, Triticum aestivum
  unsure (1)..(179): unsure at all Xaa locations
  Clone ID: PAT_TA_3969.pep
ASPTTNSSSRSPPVLQCLSWPPPVSSKIRAIPASPLPLTTTRNPQHHPRASPQLLPLLHDRSTFPRGRTDAAVRHAQGSRRSQWSLESVEGVNGCTAPRGALRWSELHRRRLEPAGRAPEPRGLAWPLSRPTGGRRSGRREKIRRAPHVSVLVGSLTWIREXXXARMRXQLMKTYSTSS

SEQ ID NO: 109552 - protein, 99 aa, Triticum aestivum
  Clone ID: PAT_TA_3970.pep
WLPNGDGGVDPVPRWATLATGGSFPFLPLDVPSWATLATGGILVVLSPVVGLHGWTSPVLRRDAVRANLQHISLDEQEAPTPKMLMSKWPDYEERARLA

SEQ ID NO: 109553 - protein, 149 aa, Triticum aestivum
  unsure (1)..(149): unsure at all Xaa locations
  Clone ID: PAT_TA_3971.pep
RGKALPRRSKAAASGGESEDEAFDDEXKLLRTVFVGNLPLRTKRKALTKEFAAFGEVDSVRIRSVPLGDTKIPRKGAVIKGKINDLVDNVHAYIVFKDEQCARTALSHNMALFNGNHIRVDIANVMLKRVECCHLVLAFGVLAAVLMSR

SEQ ID NO: 109554 - protein, 227 aa, Triticum aestivum
  unsure (1)..(227): unsure at all Xaa locations
  Clone ID: PAT_TA_3972.pep
PPVRSAGRPRKTPRGGGPLTDRKRTGFVGSHRFGVKAEELYRLCCGRSEPTGEVGSERASSDPASSRGKGLAHVIFKAGKAANSVVRKRGLQIRARFLRLTHAKAADATPEXDSGKKRGTPKQKTPFTPXSKSREGSDSNTGKAPASLSYQGLKSTEPGVVKKVKVARRPINQGKQQGRPSETGQSESARKAKRPAVAARKAKQLNKKRKQDGSTPENTHRSKKARK

SEQ ID NO: 109555 - protein, 132 aa, Triticum aestivum
  unsure (1)..(132): unsure at all Xaa locations
  Clone ID: PAT_TA_3973.pep
SDFHCGNLPNVSWRGRRRAGPPYVLKSEKADVYRLPYLSSGAPGFALLEAAXKANFQEVLSXISAGFSSNSGDKPILLAWGESDKYLPLSIAEEFKKNNPSVVKLNPIEGAGHMPQEDWPEKVVAALNSFLY

SEQ ID NO: 109556 - protein, 168 aa, Triticum aestivum
  Clone ID: PAT_TA_3974.pep
LTDSQNQEANPGHNEMDTMDTCGFPLFSHDLQNDPSSADGSLQTLLSASQDKAEVSTMKRSRSVADIESSSNGEVAVLEELEDVMFQLTKKTRVCLRDAFYRLAESSEVQCTAVNGGTLTCSNEQSFQQSEGTESSTSTSDRAERETNAIDRTVAILAFKPASSAAWE

SEQ ID NO: 109557 - protein, 183 aa, Triticum aestivum
  Clone ID: PAT_TA_3975.pep
SPFISSSPPSAVPPRSSSSSTSPSSAAPPPLLHPPHHPATSRLPKVAREILAASVCVFAVAAGAAAACSSAHGGRSGVPVQWWWSPSRWVAGSDGGLQGWRAVAARLLARSGGRPARSGAGWTYGGGEGGGLVVLLLLPVAEGFWGGLGGITKVFSSVNSSLYQSLANPCMIQYGKICSTYPN

SEQ ID NO: 109558 - protein, 409 aa, Triticum aestivum
  unsure (1)..(409): unsure at all Xaa locations
  Clone ID: PAT_TA_3976.pep
RNSAAAIRRYRCDPTYRFLHDRTADLFASXLVEDMRKLANDDVRELSLAAKWCPSLGSSYDRSTLLCEAVARRLFPRGSSPELADDLPDEPYAYRARERLRRTALVPLRRALQLPEVFMSARAWESVVYTRVASVAMKNYQAVFLKHDAERFNAYLADVKSGKKRIAAGALLPHQIIESLGEDGDDGGVADLQWQRMVDDMRALGKLTSCVAVCDVSGSMSGLPMDVCIALGLLVSELTDDPWRGRVITFSEQPNIHMIKGDTLSEKTDFVRNMDWGMNTDFQAVFDKILEVAVGAGLPPERMVRRVFVFSDMEFDQASAHPWETDYEAIVRKFSEAGYGAAVPEIVFWNLADSKAVPVMSGQKGVALVSGFSKNLLKLFLDGGGIVHPXAVMEKAIAGPEYDQLAVFD

SEQ ID NO: 109559 - protein, 50 aa, Triticum aestivum
  Clone ID: PAT_TA_3977.pep
FADNLAHSQENFSSDSLKKIKFLAQLILHDLCWLQFIHACFEFLVHGNNL

SEQ ID NO: 109560 - protein, 161 aa, Triticum aestivum
  Clone ID: PAT_TA_3978.pep
MNARAAAMRLSLASISQQLAPSLLGFFAASRPLRRAASRPASSAGDGMPRGPASKAERPAANLQSSDTTGEPSVLDPPELASDCFLAKLPPAELRSMAAVSPSTRERCRTAHRWERRVSDKWGSVLGTAARDEWRSYLSSSTRARRRRDRGAGLLAAGAPC

SEQ ID NO: 109561 - protein, 207 aa, Triticum aestivum
  Clone ID: PAT_TA_3979.pep
MWRLKVSEGGGPWLRSVNNFLGRAVWEFDPDYGTPEERAEVKRVRREFTDRRFEKKESQDLLMRMQYAKVKHLQVDLPAIKLADSAQVTEETLLTSLRRCLSQHSALQAHDGHWAGDFSGILFIMPILIFALHVTGSLNTVLSTEHRHEICRYIYNHQNEDGGWGTQVLGPSTMFGSCLNYVTLRLLGEVENDALTKGRAWILLRGS

SEQ ID NO: 109562 - protein, 200 aa, Triticum aestivum
  unsure (1)..(200): unsure at all Xaa locations
  Clone ID: PAT_TA_3980.pep
VDPPYLILCPQTAIHCKGCLFYFIDRGKXPCSPRGLLRFSLQDETFGITPLLNNLYPTVEDEDIVIHELGGELCATFFCKSMQRVLISMTRDILVPEWECHYVMNVSDQCLPMASLSNGGILLRRGHCLSRYYMKDHGVKENDMFDIDELRFLGPSEDTLGHAWENLFWFDLPYYTPSLVPVTPKASLHPLRQSLKCMLN

SEQ ID NO: 109563 - protein, 96 aa, Triticum aestivum
  Clone ID: PAT_TA_3981.pep
HLIVQDYKVVFFKCDWYDVHHKAGIIRDEFGFTHVNFSRKIHTGEKLEDEPFVFSSQVDQVFYIQNPRSENWNTMVKFKPRDIFDMGGEPSSDETE

SEQ ID NO: 109564 - protein, 272 aa, Triticum aestivum
  unsure (1)..(272): unsure at all Xaa locations
  Clone ID: PAT_TA_3982.pep
MAQSPPQTLPFLLLPLILLSIAPAASAVSFAGLDAFLTSAAARDPSAANDTFGSLPAGLRRALSAPSPILPSRLLSLSAAVPVNVRLAGSSFPPTSASLLPSFVSSAVSSSHFLSSRPPHRLAVSHSVHLDVAAARRGLRPRGPRRDRRXKPTSMQPPRPSDSNALSSVPYKIVDDIVAEDYRAHAGSASSPAVYIYLLDLGPQPRSYAYAAACSSAGGHSPAFSRCLAPLWTGEERYIWIDLCAGPVDYGPALSGEGVRPRGEFHPLAALH

SEQ ID NO: 109565 - protein, 114 aa, Triticum aestivum
  Clone ID: PAT_TA_3983.pep
DRPKQRRRFCWCRECQFCELKETCYWWTAGAKFEASEQCDSCPISSCFRVSCCSCCYHQCVSYSISSCFRVSCCSCCYHQCVSYSISSCFCASCCCSCPCCPPCAPAGSPFSRE

SEQ ID NO: 109566 - protein, 51 aa, Triticum aestivum
  Clone ID: PAT_TA_3984.pep
PLRHEDCHWDYAKARCAFPEFCEYRYTFGDVHLGMSCRLKYSSTKLLRQYL

SEQ ID NO: 109567 - protein, 124 aa, Triticum aestivum
  Clone ID: PAT_TA_3985.pep
FFFFFLTPDLNFMTCVHDQTQNKHPRSNRSQVLNLHLGSLYFQNYQQSETEPPLLAVHSPIVVQINNQKPRYSTSAHTTRCFELCIDCVMTNPAPDSTEGAIELCVESVTQQSSALLYVHTAKD

SEQ ID NO: 109568 - protein, 257 aa, Triticum aestivum
  Clone ID: PAT_TA_3986.pep
MKLFVLVAWALLLLSHGSGSVRSAGLPARGTDMLSLLDFKRAITDDPKGLLSSWNTSVHFCNWQGVKCSLAEHERVAELDLSEQSFVGEISPSLGNMSYLTYLNLSRSKFSGQIPHLGRLRELEFLDLSHNSLQGIIPVTLANCSNLRVLDLSRNLLVGEIPAEISLLSNLTRLWLSYNDLTGVIPPGLGNITSLEHIILMYNRLEGGIPDEFGKLSKMSNLLLGENKLSGRVPEAIFNMSLLNQMALELNMLVGTL

SEQ ID NO: 109569 - protein, 96 aa, Triticum aestivum
  Clone ID: PAT_TA_3987.pep
WCHQFQQDGLNNFICYVIMLHGDKSRALVHVLSKNNRIVYVLNADDDGKLINAPREEYVLDWFIVDSAKGGSLDFVLTASPKTCSPIHSSVFYMPN

SEQ ID NO: 109570 - protein, 136 aa, Triticum aestivum
  unsure (1)..(136): unsure at all Xaa locations
  Clone ID: PAT_TA_3988.pep
MSGSAFNAFKSRVPVAWSPKLYITLVRGLPGTPKLHRRTLEAIPLRRCHRTVEHRTTPSLLGMLTQVKRLVVVETEXEMYHARKQADEQRRALRPPLVVAHAPPPMPVAAAPVGRAPIQSPPVFDAPPWLGWRPPL

SEQ ID NO: 109571 - protein, 98 aa, Triticum aestivum
  Clone ID: PAT_TA_3989.pep
MIRDDNRHAGHNKSGRAEHSRQSSFELRHDIAQYRGAAHPLCFTDEVMDHQIPEGFKPVNIESYDGTTDPAVWIEDYLLHIHMARGDDLHAIKYLPLK

SEQ ID NO: 109572 - protein, 378 aa, Triticum aestivum
  unsure (1)..(378): unsure at all Xaa locations
  Clone ID: PAT_TA_3990.pep
MPRRRSTKARENAPDLRDILEDKARQTKSIYGSHRRPTACDNDLHSGCNKFGRAEHNRQSASELRRDIAQYRGAAHPLCFTNEVMDHQIPEGFKPVNIESYDGTTDPAVWIEDYLLHIHMARGDDLHAIKYLPLKLKGPARHWINSLPAXSIGSWEDLESXFLDNFQGTYVRPPDADDLSHIIQQPEESARQFWTRFLTKKNQLVDCPDAEALAAFKHNIRDEWLARHLGQEKPKSMAALTTLMTRFCAGEDSWLARSNNLSKNPGNSDTKDKSGRTRQNKQKRRINSDNNEDTAVNAGFKGYKSGQRKKPFKKNTQGPSSLDRILDRLCQIHGTPERPANHTNRDCWVFKQAGKLRAENSDKGLHSDDEEGTRAAEQ

SEQ ID NO: 109573 - protein, 421 aa, Triticum aestivum
  unsure (1)..(421): unsure at all Xaa locations
  Clone ID: PAT_TA_3991.pep
MRALLSRIPVSTAAFSPASSQTLAPTPSLAPLRLRRRFVAMAGAAAEEFEKGRVFPNGVAVITLHRPKAXLNAMNLEMDLRYKAFLDDWETNPNVKCILGESCSPRAFSAGMDIKGVAAEIQKDKSTSFVQKVFTAEYSLICKIHEYAKPYICLMDGVTMGFGIGLSGHGRYRIITERTLLAMPENGIGLFPDVGFAYIGAKAPGGGAVGAYLGMTGKRISSPADALFIGLGTHYVPSGDLGSLKESLLSANFTADPHKDVESLLTGYKKELESVPQLEKLLPDIVSSFGPDKSATESVEELKKRSQSGDATVSEWANDALAGLKKGAPFSLCLTQKHFSRVASSYGNNENYLSKLAGVMKLEYRIALRSSVRSDFAEGVRAVLVDKDQNPKWSPATLEDVNMDEVESVFEPLAADAELNV

SEQ ID NO: 109574 - protein, 96 aa, Triticum aestivum
  unsure (1)..(96): unsure at all Xaa locations
  Clone ID: PAT_TA_3992.pep
MDMELPQHTMEGLELLLTAGAPRTGGKTNAPPDLLLPGSPLLHGRRKVIEDGSLASNRSVVTESVSKSCSXAEVKDEDVAIAVVIDAAELKWEEQS

SEQ ID NO: 109575 - protein, 91 aa, Triticum aestivum
  Clone ID: PAT_TA_3993.pep
GRHGPRCPRRGRPSPAHGAGQRVEVSRQRDGQGKCSGSREKRNRKRREIRSKIIAEAEEIKIAFNEKRIQTCETNNNHSSELEKIFIESQE

SEQ ID NO: 109576 - protein, 246 aa, Triticum aestivum
  unsure (1)..(246): unsure at all Xaa locations
  Clone ID: PAT_TA_3994.pep
SCRRDVDHNRNILFSRRRNNCQILNQEDPFLHLTGPSRAIVCEEPVXXEIKLKVKAGTESEDIALMTRVWYYSGKVSCTLYTPVVGGLCTMVLSSEELHESVQATIVGIRLRVPEETPSLFKNGGRVVCFSLPRKGRPRKGRLPNSTHPLFRQVVLQDGAMTSCSKGYLNLSRHVVSVKLCGTLEVVIYANSQSGAIKGEVSIKAQNCNITQDVCHLGDSELEITVAWSRLVQDKLWISMEGSEEV

SEQ ID NO: 109577 - protein, 192 aa, Triticum aestivum
  unsure (1)..(192): unsure at all Xaa locations
  Clone ID: PAT_TA_3995.pep
MFEEMAADSSMGMGMGFHQGASSLHHHHHNMLSFQSNPDSAPAPAPAPPAPPVFLPSPNAPVLQGAPPKYKFVTGSPSDWTPYELSIFQEGLARYAREPTIMKYIKIAAMLPTKTIRDVALRCRWTAGKESRRRKPDEFYAGKRIRDLKEKMIVSTSLANFQMAPPNNLVPFXMSMHHPGNSLAANEDNATH

SEQ ID NO: 109578 - protein, 100 aa, Triticum aestivum
  Clone ID: PAT_TA_3996.pep
LATPTSRASRSSHHPFCPASGSGCCAAPQPSRPRRRWRCCSHATAAGPAVPSPTSRSRSPSSSMACPPSTSGSPSPPTQEDTSSAGSFTPWSFATWWCAT

SEQ ID NO: 109579 - protein, 94 aa, Triticum aestivum
  Clone ID: PAT_TA_3997.pep
MADVQDGHYDSSTDSLRVEPIYESFLCPLTKQIMRDPVTLESGATFEREAILKWFKESDSSGRSLVCPITRKELSSTELNPSIALRNTIDEWMH

SEQ ID NO: 109580 - protein, 167 aa, Triticum aestivum
  Clone ID: PAT_TA_3998.pep
DSCTTSSPLRHSRPPDGPAPPPLHAPPELRLTPARADPAAAHRVHPWLFLDMPNEARRRARHEGPHLHVVRLAITRRALCRPADASGIQAVHRAWCFAFPTKPRVAIDVIRPPSLGVPRVKRSVHAFRWPSFLINCAQPTCPREGARAVHLSLALPRLRTCLPPIAT

SEQ ID NO: 109581 - protein, 111 aa, Triticum aestivum
  Clone ID: PAT_TA_3999.pep
IQKLLSNLLCLPTIRSLRCRWAICSPGGRRARWFALVAASPSSGHFFSNLHPAAHGIDLNHRRPPSCPASKSSSCSLQVEELVYDPQREDIFVKEHTCKTGVSPTLSRGPN

SEQ ID NO: 109582 - protein, 385 aa, Triticum aestivum
  Clone ID: PAT_TA_4000.pep
MMGAGAFGGAGDQHMGSAFGEGYLDHRRKEGGDKAEPELAGSGGVPSSEAAGGDCSSKGSDSKKRRRPSEVMGGDQVQSSNVAADSANESAQSKDKGEESSPATGTTTGGKSKGKGAKESSEKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVSSSSMGFSPEMMHPQLQLSQPGLMQGGAAAMANSDVFRRIMQAQLGAKDGSHSQMAHALNGPVQRSRCADGVPVHGLLALALAGPQHQAVPGRLPNVIDAIASQPPEEPPGPSLFVQLAGLGLAINHLTANGTGSRAEATCTSNMTTEAAAARACVRAVHSWSL

SEQ ID NO: 109583 - protein, 85 aa, Triticum aestivum
  Clone ID: PAT_TA_4001.pep
FDPFRHVGIEFWQCLPRILEIWGVLSGCKWAVVVGRGGRSASSRMKWPFVNIVIRPAAPQRFPGLSLSTIHSIMDAVYQSSSKDG

SEQ ID NO: 109584 - protein, 88 aa, Triticum aestivum
  unsure (1)..(88): unsure at all Xaa locations
  Clone ID: PAT_TA_4002.pep
CALHFCLYGTQLYTGANYVSVIQMTDVGLGICGLEGRQVVMASDFVMEHFCFVKKSLIXQRHWNHQFFRYNISTMDIWNVGFLIHHHY

SEQ ID NO: 109585 - protein, 248 aa, Triticum aestivum
  unsure (1)..(248): unsure at all Xaa locations
  Clone ID: PAT_TA_4003.pep
TLYELWFGKKPKFSFLKVWGFHAYVKKLQPDMLEPKSEKCVFIGYPKEIVGYTFYHRSEGKIFVAKNGSFLEKEFLSKEVSGRKVELDEVTAPSPLLESSSSQKSVPVIXTPISGEANDDDHETSYQVTTELRRSTRTRSAPEWYDNPVLEIMLLDNGEPSNYEEAMAGPDSDKWLEAMQSKIGYMYENKVWTLTDLPDDRRAIENKWIFKKKTDADGNVTIYIARLVAKGYRQVQGVDYDENFSPVD

SEQ ID NO: 109586 - protein, 428 aa, Triticum aestivum
  unsure (1)..(428): unsure at all Xaa locations
  Clone ID: PAT_TA_4004.pep
RLGKGCKGDVIAVGTLPLHLPTGLVLNLXNNCYXVPALSMNIVIRNXFNSRDGYSFKNXENNGCSIYMRDMFYGHAPLVNGLFLMNLERDVTHIHSVNTKRCKVDNDSPTYLWHCRLGHIGVKRMKKLHADRLLESLDYESLDTCEPCLMGKMTKTPFSGTMERATDLLEIMHTDVCGPMNVEARGGYRYVLTLIDDLSRYGYIYLMKHKSETFEKFKEFQSEVENQRDRKIKFLRSDRGGEYLSHEFGAHLRKCGIVSQLTPPGTPQRNGVSERRNRTLLDMVRSMMSLTDLPLSFWGYALETAAFTLIRAPSKSVETTPYELXFGKKPKLSFLKVWGCDAYVKKPQPEKLEPKLEKCVFIGYPKGTFGYTFCLRSEXRIFFPRIGSFLGKGFLPKEVNWREVEPDEVTVPTPLLESSSSQKSVPVT

SEQ ID NO: 109587 - protein, 95 aa, Triticum aestivum
  Clone ID: PAT_TA_4005.pep
IGSKGARVFGAWRSFHVQGSRPRRRDQRGRRRVHLDDMKHLAPTLTSLTSHAFWVCLQFRYELRKRFLLYLLKHRGNEAKGNFPDIVKEFLKRII

SEQ ID NO: 109588 - protein, 161 aa, Triticum aestivum
  Clone ID: PAT_TA_4006.pep
MKGAKSKGAVKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEDDEEESDKSKSEINDDDDDEGSDEDEDDDE

SEQ ID NO: 109589 - protein, 168 aa, Triticum aestivum
  Clone ID: PAT_TA_4007.pep
NAKAGGRKVVFGSQLRIQVPSGRAAELVSSPIEFGVKNRDSFLSPARRFLPEVVISPTARVFAAGVAPGEMAMSEDYTCVISRGPNPTTRHIFDDCIVESCGDGPADGGPGCARFPPSGFLSSSHASRRQLWACPLISFHPSGLAKHSAATSAGTGKCFFDEAVDNLR

SEQ ID NO: 109590 - protein, 211 aa, Triticum aestivum
  Clone ID: PAT_TA_4008.pep
MRCGRSLHKFALYETTSNFYLVGRDKSTTLWRVLKIDRLESTDLGIQEDPTSYTENECQELLWRIHEGNRLTGGLKFVTKCYGIIGFMKWRGPYFVRLVSTDLGIQEDPTSYTENECQELLWRIHEGNRLTGGLKFVTKCYGIIGFMKFLGPYYMVIITRRRKVGTICGHDIYSIGKSEMIAIPCPIVCPNVANSRDENRYKRLLCSVDLT

SEQ ID NO: 109591 - protein, 261 aa, Triticum aestivum
  Clone ID: PAT_TA_4009.pep
MVGMYQKQLLDAPFALNGHCADQPRHAPAAAAAAASPSPYPPNPSSSSGAAPSPHAQADGAGQPRRLFHALVGGILQRGAGGGNGAAGDLGALVSWAREVAVDPCAKRPADRPRKRQVLALRRARYLKMEDVADQAELPSFSKKRKYRTKNQSERPRKGPTPTRKSERRPGGMVLMTSVLLTQRKKIGVGEQFQAEIPDWTGPPSDAELSWCRNHPFPALLHFPFDHHFYLLFEATFSEHVMHSLSWFSDFLATLDSPFQR

SEQ ID NO: 109592 - protein, 167 aa, Triticum aestivum
  Clone ID: PAT_TA_4010.pep
PPGSTPLPLAHEVTAAAAHAGRFRRAPALRSTAPSSPCSAPPSPPARFSSPGLYRPLATTPPWLGFRAVLRRRVSGGPRCRWSTPWEFPIHHGRCRQGLLQGDVKDAIDLQLLKVSLARSPQTNGYRHSCEGFRPAWRPQGPSLRDAFRRLLGRVGASPGGCPCRVI

SEQ ID NO: 109593 - protein, 112 aa, Triticum aestivum
  Clone ID: PAT_TA_4011.pep
QHHHLLLARRAPTHPSATQPCRSPRENSRRSRRPAEKTAATRRPEGRRAAAQQDSPAPARRRQRRRAPGGRRRRQSWRGRSRAPRRRSPPWRRRSPRRTPPPAPSPPSRSFS

SEQ ID NO: 109594 - protein, 173 aa, Triticum aestivum
  Clone ID: PAT_TA_4012.pep
VRGRVGGRVGAVNLLGGSEKSTPEGVLKVMNAHNLTIYHVKSHLQKYRTARYRPELSEGTSERLEASKEELPSIDLKGNHASAEALRLQLELQKRLHEQLEVQRSLQLRIEEQGKCLQIMIEQQCNPAADKALDASTSAEGPKLSSDPPESSTVKDVPNNSQNGTTEQAGDKE

SEQ ID NO: 109595 - protein, 405 aa, Triticum aestivum
  unsure (1)..(405): unsure at all Xaa locations
  Clone ID: PAT_TA_4013.pep
MDTSLAAAAVTAEASAPAAASTEPSAAPDASPAASSSSAAGAGAEDLAGGVAALSLDERFDLLMSIGEECIQPDELKRLLQNKPVPICYDGFEPSGRMHIAQGXVKTINVNKMIRAGCKVKIWIADWIXHTLNNNNGMAIVKKIQTGGRYMIGIWKAAGMNXMGLEFLWFPQNCSMNAVXYFPRRMDICXDILYLINXCSVMQVNGXMEHGVSDCCRFLLFCQGVCAVIHRLDWMLVLVFGEVEGVIGPQVVDQALILEXKSLLPTHHVRTGFTGGQEVRSXSDPTSAIFMEDDEAQVNLKIKQAFCPPKIVDKNPCLEYIQYIVFPWFDKFEVVRKENNGGNKTFLTMDELVADYEAGDLHPADVKPALAKAINEILKPVRDHFNSSSEAKILLNTVKKYRVSN

SEQ ID NO: 109596 - protein, 275 aa, Triticum aestivum
  Clone ID: PAT_TA_4014.pep
GRVGLWRIHGVDYYGMSETNEPKGLRHVKADSRTYDGPSSNTAEWEEKLDSFWQDRIQGQDPLEILKAKDKIDAAASEVLDPHVRKIRDEKYGWKYGCGAKGCTKLFHASEFVTKHLKLKHTDFVVELTSKVREDIYFENYMNDPKAPGGTPIMQQSAPREKGRQRPPIESRLRDERGRRFDRNIDSSNPDGSSENPDDPMYDSYGDPAVHGAFPPDVPAPPMLMPVPGAGPLGPFIPAPPEVAMRMLREQGGPPPFEPNAGPRPKKAGRAGWSP

SEQ ID NO: 109597 - protein, 302 aa, Triticum aestivum
  unsure (1)..(302): unsure at all Xaa locations
  Clone ID: PAT_TA_4015.pep
MADGKDLGAAAAAEPDHDEGQPDLEEEGELEAAAAGGGEEEEDVDVDGLASFLEFEILSGSSEEDPLDQLEEGEEEKETRVNDEAKNGKRKQDSLSDGDGSGSEDEHQKRARKEKGKGKVLAEGPPQIDTGMFTNVPPELFLQIFKFLSSEDLISCALVCRFMNAAASDETLWRRLYCMRWGLSSNATSNAKLRECAWKSLYIXQDREDMVEXVRYTPTEFKEYYIQMQAAKRSPGPLPSXLTTTRLFLDKTVLIKCLIXKTARAFTDDASKGFLFLEXLCYYKQLGDXLICXXTXPVMSIP

SEQ ID NO: 109598 - protein, 289 aa, Triticum aestivum
  unsure (1)..(289): unsure at all Xaa locations
  Clone ID: PAT_TA_4016.pep
MPIPMTTGGKKIREEAEAEAEAAALFPTRIPIGMASRGGGAPWADGAFPDWVMLDRLGRTKSYDGICAVREAVNQNKTAAAVHMASGRSCYVSFALADPPEGVSYFDLHWPEKRXSATRPACPYVRATDEDLVLFHISIPSQTRYDNIASDLFVYTAAGPSPSVQQLPRYTKDRKRPFLMDKFATGILQLAPDCYIVADLNVYPKKSDTGNHPMLVELCIFNSEKGHWGTICNRPAPRPHDQSNVRFPFLWSTDDVLALDGRFLCWVDYFSGVLISDFSDTCSPVLHFV

SEQ ID NO: 109599 - protein, 190 aa, Triticum aestivum
  Clone ID: PAT_TA_4017.pep
MGATNHTLQALLPWLLLFVHQAAAASGGCECTTATDGADKQGATKLKLVAIASILTAGAAGVLVPVLGRSMAALRPDGDIFFAVKAFAAGVILATGMVHILPAAFDGLTSPCIHKGGGDRNGFPFAGLVAMSAAMATMVIDSLAAGYYRRSHFSKARPLDNIDMPGHEEGRADHPHMHAHGHSHGEAIVV

SEQ ID NO: 109600 - protein, 195 aa, Triticum aestivum
  unsure (1)..(195): unsure at all Xaa locations
  Clone ID: PAT_TA_4018.pep
MAQRALELTLISGKDLKDVNLFSAMEVYAVVSLSGDPRSRQRVATDRAGGRNPTWNATVRFTVPASAAGSVHVLLRAERALGDRDVGEVHIPLSELLSGAPEGPVPVKFVAYQVRKIGSGKPQGVLNFSYKLGEVTQGQAAGAYGGAQAAYAQPPPAAAYPPQGAXPPAGKADAYGAPSAYPPPGNAYPPQSAYP

SEQ ID NO: 109601 - protein, 235 aa, Triticum aestivum
  Clone ID: PAT_TA_4019.pep
MAALSLSLAPPTAVLPCLPSRPAASLLRPQVPSRATLVVCLGAKPKVPLPIASPSPLGDDPAKWDPAECDALLRGGEQVASVLQEMLTLMEDMEMDGAFAPVAVELVAQGVIGNRVDEMESGFLMALDYMIQLAQKDGDDERNSLLEVVKQTGLDHLTKKCPPHVQVVGLLCQTEKKESRHELLRRVAAGGGVFENDKGLKCEIPGANLNDIANQADDLLESMETRPTIADRKLL

SEQ ID NO: 109602 - protein, 338 aa, Triticum aestivum
  unsure (1)..(338): unsure at all Xaa locations
  Clone ID: PAT_TA_4020.pep
ADLXXKFFXLEPIHPSVYKVGLQYLSGEVSGGNGRCIAMLLAFREAIKDYSTPPNKTLSRDLTAKVSSYVSFFIECRPLSISMGNAIRFLKNRIAKLPITLSESEAKASLQSDIDRFINEKIVVADQVIVSHAITKVRDDDVLLTYGSSSVVEMILEHAHELGRKFRVIVVDSRPKLEGQGLLRRLVAKGINCTYTHINAVSYIMHEVTRVFLGASSILSNGTVYSRVGTASVAMVAHAFGIPVLVCCEAYKFHERVQLDSICANELGDPDVISKIPGRADLGDLKNWADNENLQLLNLTYDATPSDYVSMIITDYGMLPPTSVPVIVREYRKEQLWV

SEQ ID NO: 109603 - protein, 335 aa, Triticum aestivum
  Clone ID: PAT_TA_4021.pep
HLLLLKLVHLHHPKLARLLLVKTHQTTSNSTTDAAAGRTTATQSSRPSTPNSRSRIMLNSSSGSIPAMSRPSPSIGIIPATSRAGASSSNGHGTSHSTSLSSGTVPSVSRSTSRSSTPTRQPAVRSSAPAMGRSPSFGRTSSSHSLTTSMNRPAASSVRSSAPSSAPSSRPSSPGPRPRAPVRTHDIPSSAPSSRPSSPGPRPRAPVRPHDTPSSAPSSRPSSPSPRPRAPVRPLDIPDFPNETPPNLRTKLPERPLSAGRSRPGMASGIRSNPHAEQLAASAPAKKLSVPAASRNKFSDPPSKAPSRSNGHQNRQSERSVVDSQATRTARAGAV

SEQ ID NO: 109604 - protein, 279 aa, Triticum aestivum
  Clone ID: PAT_TA_4022.pep
MATAVASQPRHFTLGGEPRAAICAASTSKICTLDKVYGFRFVCRSVVDLRSQKFHSQISKRKCYLTSSPSEFEKIILSARWLEFRRQRIAFQRTGRWVHSIPLASQDDGSGVSVNGVPQVDPASQMKEIRVKLDKALQNEDISTGLVQSIHDAARSIELAFLDHSKSSINSWFPKMWLGVDNNAWIKSLSYLPAVSSLLQAVIDVSSRGNGRDRDINVFVQRSLSRLLSSLDGVIQNELAKREPSLYQWYSSNQNPLVVRTFVNTLENDRRFNSATAIC

SEQ ID NO: 109605 - protein, 108 aa, Triticum aestivum
  Clone ID: PAT_TA_4023.pep
MGLPGCIAVIVLLLISWREGEAAMFTFVNRCADTVWPGVLSNAGTARLGTTGFELPPGALRAVPAPSAWSGRLWARTGCAQDGATGRLVCATGDCGSGTAECAGAGAA

SEQ ID NO: 109606 - protein, 306 aa, Triticum aestivum
  unsure (1)..(306): unsure at all Xaa locations
  Clone ID: PAT_TA_4024.pep
VGFAMMFGAFAGLGCMVVKWHRRPQDWDRRNSFSSWLLPIHTGQSFSNGKGSKSGYTFSSTAGLGQGGTFXEMSEATKNFDESAIIGVGGFGNVYVGEINDPDEEGSRIKVAIKRGNPSSEQGINEFNTEIQMLSKLRHRHLVSLIGYCDEGEEMILVYEFMQHGPFRDHIYGGPEGLPTLSWKQRLEICIGAARGLHYLHTGTAHGIIHRDVKTTNILLDDKFVAKVADFGLSKDGPGMNQLHVSTAVKGSFGYLDPEYFRCQQLTDKSDVYSFGXVVLLETLCARAPIDPQLPREQVSLAEWGL

SEQ ID NO: 109607 - protein, 121 aa, Triticum aestivum
  Clone ID: PAT_TA_4025.pep
KPTPSTLPLPMFDARREAPRRHRPAHQRRLPSIQRRRPSQRSPLRSLQHAAHRVHVQRGADEPPMYSLLLHARRLRLRRSLARPITWLMRVVVAYMVIDSLTVLPENIPVLPMSASPASRY

SEQ ID NO: 109608 - protein, 224 aa, Triticum aestivum
  unsure (1)..(224): unsure at all Xaa locations
  Clone ID: PAT_TA_4026.pep
MADKEPVVERPVAEEEGEDSAAAAAAGEEEDTGAQVAPIVRLEEVAVTTGGRRTTDSLLDMKAESYTGSDKXGNQWKERGTGTVKLLKHKENGKVRLVMRQAKTLKICANHLVISTTKMQEHAGSDKSCVWHAADFADGELKDEMFAIRFGTVENCKKFKDLVDEIAESLAKNEGGESEEGSSAAGLLEKLSVSESKPEESAAKEESTDASKETETKAATAPSE

SEQ ID NO: 109609 - protein, 225 aa, Triticum aestivum
  Clone ID: PAT_TA_4027.pep
GLPRILPQTPPGPGATIGGMCATRCSGSLAVRYGTMRDNVINLQAVLPDGDVVKTGSRARKSAAAELLTRLIIGSEGTLGVITEVTLRLQKLPSHSVVAMCNFQTVKDAADVAIAPMHSGIQVSRVELLDEVQIRAINMANGKSLPEVPTLMFEFIGTEAYALEQTLLVQKIAAEHHGSDFVFVEEPNAKEELWKTWNPALSFSLFPQAREPLLVECALHDVLVH

SEQ ID NO: 109610 - protein, 62 aa, Triticum aestivum
  Clone ID: PAT_TA_4028.pep
YKFTNQRLKDLGMEFVPVLQSIYETVKSLQEKGMLPVLPPGDDVRDNLHEQLMMKPAQLLRN

SEQ ID NO: 109611 - protein, 358 aa, Triticum aestivum
  unsure (1)..(358): unsure at all Xaa locations
  Clone ID: PAT_TA_4029.pep
MPIEAADNVPAELPGHGRTVCVTGAGGFIASWLVKRLLQKGYTVRGTVRNPVDPKNDHLRAFDGAADRLILLRADLMEPETLVEAFTGCEGIFHAASPVTDDPEKMIEPAIRGTKYVITAAADMGIKXVWVFTSTIGTVYMNPHRDASKPVDDTCWSDLEYCKKTANWYCYAKTVAEQDALETARQRGIELIVVNPVLVLGPLLQPTVNASTEHVMKYLTGSAKTYVNAAQAYVHVKDVAEAHVRVYEAPGAHGRYICAEGTTLHRGDLCRVLGKLFPEYPVPTKCKDEVNPPVKGYKFTNQRLKDLGMEFVPVLQSIYETVKSLQEKGMLPVLPPGDDVRDNLHEQLMMKPAQLLRN

SEQ ID NO: 109612 - protein, 173 aa, Triticum aestivum
  unsure (1)..(173): unsure at all Xaa locations
  Clone ID: PAT_TA_4030.pep
TXTNLXKAFLTLTKPLQIAPXNVEEVXAKHXWHXEGRQDXYHQQQHLSPHGDWDLGFSNLISRTRDSNQRPQLLHTASFARRRHSQVPRTNNHHPVCDSVISLTGSSHGAQDTTPQPWASGREHEEVDAVQLSCFPRSSPWLLRRTRRGRRASTSLGMNKRVYALRAHGQLQQ

SEQ ID NO: 109613 - protein, 276 aa, Triticum aestivum
  unsure (1)..(276): unsure at all Xaa locations
  Clone ID: PAT_TA_4031.pep
LSDDRGIAAIGSQESYQPEDNHHLGATSHSNVDDDSNLLEDCLLASIKVLMNLANDNPSGCEHIASCGGLNTMASLIIKHFPSFDFSADTGRDVDLLQDLTDSEDSKACQVKAKQLRDHELDFLVAILXLLVNLVDSVVAAEVRLASARVSVGLSKNAQSEKAQRDVIPLLCSIFLASKGSGEASATISPDDEESMLQGAREAEMMIVEAYAALVLGFLSIESMKVRGAISSCLPNNNLKVLVPVLEKFVAFHLQLNMMTDETHSSVTEVIEKCKL

SEQ ID NO: 109614 - protein, 311 aa, Triticum aestivum
  Clone ID: PAT_TA_4032.pep
FLPRPPPPPRPPPPSPSSPPPRRRRGGRRGRHPPTAPVPADETETRNWAELPLDAISAILHKLDHVDILMGPGQVCRSWRGAARGEPELWRRINMLGHADLEHELNFPGMAQAAVRRSAGRCEAFWGEYAADHDLLLYLADQASSLKSLRLISCYNFEDEGLQEAIVKFPLLEELELSLCANVGESGVFGVVGRACPQLKRFRLSKDVFYDFEASGYDKDDEALGIATMHELRSLQLFGNCLTNKGLTAILDNCRHLESLDIRHCFNVNMDDALRAKCGRISTVRLPNDSTDDYDFEGAGACLGGFRVLFG

SEQ ID NO: 109615 - protein, 314 aa, Triticum aestivum
  unsure (1)..(314): unsure at all Xaa locations
  Clone ID: PAT_TA_4033.pep
MDFDCNKAGESSAKHCSSICNEGTLIQANTLIHCGKAKKWNSLNKLNNPESSHGSLPRVTDPKEDGETGNDGTASECSTMCFTDLPSALVCEVLARLDPKGLGVVSCVSTVLQTLATDHQGWKKFYCERWGLPNAPIGPLVPGGTPDGRSWKALFVDREFQSRSFLGRSTVDALPGHNVDVRSVYLLASANLIFTAGHDSAVLMWNMAEGLLIAESPPFGCTIRALAAVTXLLVNGRSLALIQXWRSLDGASHLLHIPGNGPSQNCEFPLCAHERAVACLSFDSQRXYFASWDMTDHDGDRHDMDSSQDIVHAV

SEQ ID NO: 109616 - protein, 197 aa, Triticum aestivum
  unsure (1)..(197): unsure at all Xaa locations
  Clone ID: PAT_TA_4034.pep
MATSPSPKKKQVLLPIVAGTEPIEASIPIDILRRAGADVTVASAGDALLVEIMYGVKIMADELLADCAAASYDLIVLPGGVPGAVNLGGSATLESIVRKHAEKGGLYAAICAAPPLALASWGLLNGHKATGHPWFVEKFPPEVTAVDANVVVDSNAVTGTGPATSMEFALALVEQPXGKEKAEQFAKPMLSEIRRWL

SEQ ID NO: 109617 - protein, 303 aa, Triticum aestivum
  Clone ID: PAT_TA_4035.pep
FSLVALRKVMVIDYKLTYPSGTATAMLINSFHTTSGAELAEKQVSCLGKYLSISFVWNCFKWFFSGVGDSCGFDNFPSLGLAAFKNTFYFDFSPTYIGCGLICPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSEEKLLNDVFVKDSIPPWLAGSGYVGLAAISTATVPMMFPQLKWYLVLSAYVVAPLLAFCNLYRTGLTDWNLASTYGKIGLSFCLMGWATWWCDPLQLVGS

SEQ ID NO: 109618 - protein, 183 aa, Triticum aestivum
  Clone ID: PAT_TA_4036.pep
PRTWSKRVNILQMPSQGTAEGMLLFLSKCCVVLARYSEYSAGAVAGVEEAEAKAALIGLHALKDLQGPVILEFDCQIRIKELMTGKQSLSPCYGLLRDIKQALTNFSDHSISSVGRLCNALADELAALAKNSEHQERIADVPDCLRPLMISEFMVSAEQLYYSESQKEKGCASPSDNHGNFKG

SEQ ID NO: 109619 - protein, 171 aa, Triticum aestivum
  unsure (1)..(171): unsure at all Xaa locations
  Clone ID: PAT_TA_4037.pep
APPDPPPSTXAGARPVSHPSPEFLAGSRANLPGPRRRPQPPGAGRRFPAKGPGPRPPATPRARLLARMATSPASQGPSSAAPCPPRLCLWFLCIEAVQRRTSAASTRGLVRPTTRVPSPAYRTSSPPPEPPDLPRPRQVDHLDPPQLAGAHPHCQASSAAPRLPCLVLNRS

SEQ ID NO: 109620 - protein, 192 aa, Triticum aestivum
  unsure (1)..(192): unsure at all Xaa locations
  Clone ID: PAT_TA_4038.pep
QGQLREDIAEEYYHELIHRNLLQPDISYFDMSHCKMHDLLRPLALNISGEECFVGDVESLRGENMPKLRRVAAVTKKDMSVLPRVDKVDVKVRTFLTVKGPRRIEDTLFKTFRLLRVLVLNYSLVQSIPDYIGXLIHLRLLNLDYAGLSCLPESVGSLKNLQVLSLRWCDHLHTLPLAMTLLCSLRCLNLLG

SEQ ID NO: 109621 - protein, 78 aa, Triticum aestivum
  Clone ID: PAT_TA_4039.pep
IITYRRVILNLVFRLLYLTQPHEQSGGGEAPLRIHKQKWLASCNRGPASLRTPQKIYPSILAAWVKLGTNVYLFKTKN

SEQ ID NO: 109622 - protein, 264 aa, Triticum aestivum
  unsure (1)..(264): unsure at all Xaa locations
  Clone ID: PAT_TA_4040.pep
RWLRGRRSARPRRPPPAPPPPRAGAAAAGRPTLPAPGTGHPRLRRRRCARPQPPEEPPPPPAPACLTSGGVAGPARPSRQPAPPSRSSPSPSPGPPAWPRLLSSLPHQIISLISSFHDLLAFRGTCHSWHPAAASSFPSVYTFSFPPLNLKPDVSHESYNSDRNSQLVHSARKTLPLWLVSPPSRPSXTRYLGCSHGYLILSGKETLPPILWAPWHSPKAPRILSSRAPSSPGHPYGPLNPTFLTFSGGGTNPKVSLLSLAFKL

SEQ ID NO: 109623 - protein, 338 aa, Triticum aestivum
  Clone ID: PAT_TA_4041.pep
ERSMAGVVEGGEERAPGEMATEETTQPEILKMKIASLLNLLSEKQSDVLSCGPEIVSMITSLNSELASQKLARDSKPLVPPEVSSPKRPKMADQGNIGQSNTDTQSVSSQVSSVAERGDQKEIESGKIKPASRFKSNSQQVCVPSGGEDEEERLNCQFTHIMQQTDALCDELASMASTPNKTSAPIISSHMVSDLGEKTSRLMQICKVIFCESVKGDEQVPYHSLDNQRTKEDSVEMSGLTMDNGKSSTQCADKQTNKKGMGGTMELLEDFNMFESDDEDEDEEMTQEQLAMSAKFREEAQVMEARLVEALEQDDNNTPSCYRMTHLSLSYQPEEKEE

SEQ ID NO: 109624 - protein, 140 aa, Triticum aestivum
  Clone ID: PAT_TA_4042.pep
REASSRHAMRAACFCLSFTAASPPLPSTSTAASSPRCQSHASYRWSQPRHSRGGVVRALHERLLETPTPAPAETEVEDESGVGEIEDGGEREGRDGQADIVGPSEAQEHPKSRRRQQQEEEDATAERARVKLINGKEIFQ

SEQ ID NO: 109625 - protein, 188 aa, Triticum aestivum
  Clone ID: PAT_TA_4043.pep
CQCPAICSSRGPPYPGRTPAETPGRTRRPSRSQRQRRSSSRSRRPSRSHRRRRSRSRSRRPRGNRSRSRPRATRAISTAPARRRPRQSRRRRQPRRRRGRRRRRRLCPCSRVILSCCTCLNCICRQKTPVKTNTNTPVKKKTLGTLGTKRNLLPWIGGWICLLVICSGPCVCVCVCVSSNCYLNWCLG

SEQ ID NO: 109626 - protein, 136 aa, Triticum aestivum
  Clone ID: PAT_TA_4044.pep
PPPRRHQHRVSPTSSDGLRRSAAHPRAPLVAVLPSLRPDPLLTAANGRSHHPSPPLGFRLPPTPASHPPPWMRGRPPRPAHGQALRRLLRCGAGPTTSASTSPRSGKHPIPMAISLSRASFSYLVCVCVCARGVRS

SEQ ID NO: 109627 - protein, 80 aa, Triticum aestivum
  Clone ID: PAT_TA_4045.pep
MERKNSFGSSWADQWDYGSDPAPRAGGKKQGGVEKTKAAAATGLKKVKEGTAHGFQWIKGKVQKKKQGAAGAGDDAAAGY

SEQ ID NO: 109628 - protein, 147 aa, Triticum aestivum
  Clone ID: PAT_TA_4046.pep
MVDAATLEKLEAGYKKLAASDSKSLLKKYLTQEVFDALKTKKTSFGSTLLDCIQSGLESHDSGVGIYAPDAEAYSVFADLFDPIIEDYHKGFKKTDKHPPKNWGDVETLSDVDPTNEYVVSTRVRCGRSMEGYPFNPCLTEAQYAEM

SEQ ID NO: 109629 - protein, 197 aa, Triticum aestivum
  Clone ID: PAT_TA_4047.pep
ARGLAGLPGLRVLSAYENALSGPIPPGLGLSSNLQVLNLHSIGLEGSIPSSLFDLGNLQVLILTVNRLNGTIPDSIGRCLGLSNVRIGNNRLAGAIPASIGDATSLTYFEADSNQLSGSIPAQFARCANLTLLNLAYNRLVGEVPDMLGDLRNLQELIISGNGLGGEFPRSILRCRNLSKLDLSYNAFRGGLPDAIC

SEQ ID NO: 109630 - protein, 394 aa, Triticum aestivum
  unsure (1)..(394): unsure at all Xaa locations
  Clone ID: PAT_TA_4048.pep
MISPFLTERTKSKFVIAREGNVAETLFKFIRPELVPVQYGGLSRSSELENGPPKPASEFTIKGGEKVFLEIDGIEAGATITWDLVVGRRGRGAAARAVPPADAGLALGLGCTGLVGIVAYMHGWEXEGHPVCYNAYGVFKDRDMYNGVFGDGDRLSRFLRWRVPILERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASELENGPPKPASEFTIKGGEKVFLEIDGIEAGATITWDLVVGGWELEYGAEYVPAAEGGYTLCVERTRKVPAAAAEPVHNAFTAKEPGKMVLSIDNSGSRKRKVAAYRYFVRKPSA

SEQ ID NO: 109631 - protein, 96 aa, Triticum aestivum
  unsure (1)..(96): unsure at all Xaa locations
  Clone ID: PAT_TA_4049.pep
VGYRMXLGAEHLGTVKECFRQPQSMECVQLVNQMAEDNWACYVSPQYGXMKGHLMRYPIKVEKDGRVVPLPGHESFPDVGGKVLGSHSSLPNALTT

SEQ ID NO: 109632 - protein, 163 aa, Triticum aestivum
  Clone ID: PAT_TA_4050.pep
PIYTHHEPTTTKLGLADLGLELDAEVHAEELLVEHDGLPRERVHCHVLRGLAAPAVRCPDLPRSRLGPADVSCCILLPVAALQMLEVAQREKPLVVVRCRDLCKQALARVVSQIGFAEHRPVRVPQPLERDHLQFVGELKLVDCHADQALVAVEVCEDLFLDP

SEQ ID NO: 109633 - protein, 340 aa, Triticum aestivum
  Clone ID: PAT_TA_4051.pep
MAVQAQYPSNLLFHDRGDPERADMDLPKQQHQQQHQQHPQQLAGLSPAVYFASGGASGNRRKRAREAMAPPPPAKGGSTGLSAQHSAPFFNMAQLHSSRVAASPSPAPASVTRVSTGLRLALDEQQQRQINSLCYPSSSSPLVPFSVEFAGQMKQHGDELDKFVRDQGEQLRRAIADRMRHHNRALLVAADKSASRRLREKALEAEREARRGAELEERLARLRNEAAAWQAEALSEHATAVGRHAQLQQAASAARASCEELGGGDAGPAESCSSAYVDPRRAGPDRACHGCHLGAATVVLLPCRHLSLCRDCFAAGDMDVALACPVCHCVRTGSVEAILC

SEQ ID NO: 109634 - protein, 202 aa, Triticum aestivum
  unsure (1)..(202): unsure at all Xaa locations
  Clone ID: PAT_TA_4052.pep
SSADSSPTRSWGLKEQRTVYLRWFYLADDDADGRLTGKDALKFFAMSKLSREDLLQVWAIADSKRQGYLGFAEFMTAMQLVSLAQAGQDISQDTLAHADLASLQPPTMEGLEKKLKKSAAHKSSSDLTAYHPVQTSLSANWFNSKSGKKIAMKSVTSIIDGLKKAYIEKLRPLXKTYQYNDFVSPLLTSSDFDAKPMIMLLG

SEQ ID NO: 109635 - protein, 254 aa, Triticum aestivum
  unsure (1)..(254): unsure at all Xaa locations
  Clone ID: PAT_TA_4053.pep
GWKFWGDSNVKSKFWGQSIQVDPVGVLTVEFDDGEIFKWSKVTTTINNLILGKLYCNHHGIMHIKGNRQYSCKLKFKEPSLLDRNPHLVQGFVEDNDGKKASFLIGKWDESMYYSNLDTSKVKSADQLQGASLLWEKNKPSPNPTRYNLSSFAITLNELTPELQEKLPPXTDSRLRPDQRHLENGEYEKANAEKLRLERRQRMSTKLQDNGWKPRWFEQDAEDGAYHGKGGYWEARDQGRWDGCLNIFGEFSET

SEQ ID NO: 109636 - protein, 407 aa, Triticum aestivum
  Clone ID: PAT_TA_4054.pep
MKIAVEGCMHGELDKVYDTMQRLEAAEGIKIDLLICCGDFQAVRNESDLQCVNVPPKFRTMNSFWKYYSGQAVAPYPTIFIGGNHEAANYLWELYYGGWAAPNIYFLGFAGVVKFGNIRIGGMSGIHKQHDYHRGHHERPPYDNATIRSVYHVRHYDVLKLMHVKEPLDIFMSHDWPLGITEYGNRERLLREKPFFKEEVNERTLGSESAAKLLNKLKPPYWFSAHLHCRFPAIIQHGEDGPTTKFLALDKCLPGRNFLQVIDIPSNPGPYEIQYDEEWLAITRRFNSAFPLARGRGTIRNEELDIEDDRQWVRSKLNARGAKTFDFAQTAPPYDPSRPIYNPPIAVPCRNPQTESFLQFLELPYLLDSSNPGGVDINVSSSQAAPALDNDDIELPDEVEDDEDDEE

SEQ ID NO: 109637 - protein, 167 aa, Triticum aestivum
  Clone ID: PAT_TA_4055.pep
MGLECGPSPRQAVDPVFAAGEAEKQQEEEAVPETGRLSSHSENDCSMSSWSTEETTSYDEGGASDDNSVGGSSKDDGSSKVSRSSSSFSFIRRLMSRNGKPSGAPKTVEMRRSGWLERLGVAVCAVDNAADEPSTSSSDSEPIHGGRYERVKVRSYRKRSKELSALY

SEQ ID NO: 109638 - protein, 235 aa, Triticum aestivum
  unsure (1)..(235): unsure at all Xaa locations
  Clone ID: PAT_TA_4056.pep
MATRPPVFSTLTASFSPSPPHLLRRLQTLTRALASSSPQPMASSPPLKKVLVPIANGTEPMEAVITIDVLRRAGADVAVASVEPGAAQVAASWGVKLAADTLLADLAEADFDLISLPGGMPGASTFRDCKILENIVKKHAEKGKLYAAVCAAPAVALGAWGLLNGLKATCHPSVMDKLPNGVKTVESRVQIDGNCVTSRGPXTTMEYSVVLVEQLYGKEXXDEVAGPMXXXXQHA

SEQ ID NO: 109639 - protein, 205 aa, Triticum aestivum
  unsure (1)..(205): unsure at all Xaa locations
  Clone ID: PAT_TA_4057.pep
PDATQLLSRTFPTSAPPSPPARPLAALASSAAPLSPRAPPSPPPPAPALRPGSARPPPGLPRGGALPRRRGAGASNCGRLLQTAHGEQRPASVRARIRAPGGRGAAHDPKIRTTGGRARRGEPITSSQQGRGKVKGRKERKHINKGKNMIMNEKRKGKAQDAVARKEKEAEGRKRKTAAMARDRAWRXRLAKQKQIEEENEATMG

SEQ ID NO: 109640 - protein, 178 aa, Triticum aestivum
  Clone ID: PAT_TA_4058.pep
MLAATAACRAPARPLPAARPGSSYLLGRVLLPKRRAPAARRRRGRSAAVRCGLLPVDPWAPGVDSQSIASQLFAVSLFPYLGFLYFMTRSKTAPGLTLFGFYFLLAFVGATIPAGIYAKVHYGTSLSNVDLLHGTAESLLTLTNLFIVLGLRGALRNLDKAEESSPEAPQDSKEKSSV

SEQ ID NO: 109641 - protein, 276 aa, Triticum aestivum
  Clone ID: PAT_TA_4059.pep
MLPTLLGGYLTVSALPHPTATATPRARVLPGLRPSSRLVARRSAGETVHATATEEEEQEWKELQEEGLPMRGQHAEDDHDHDPEIADIMGDYFDDPKKAQSRMEERIKKKRHKIVQAKTGSPNPMKVVFNKFDFSNSYIWFEFYNALLPKDVKLICDTLRSWHILGRLGGCNSMNMQLSQLSLDCKRPTYDALEAANTTPTSFYNIGDLEIQENLARVWVDIGIQDPLLLDILLNSLTTINSDHLGIKEVQFGGSEFQSWNDSLNTEEAGYSVQKI

SEQ ID NO: 109642 - protein, 126 aa, Triticum aestivum
  unsure (1)..(126): unsure at all Xaa locations
  Clone ID: PAT_TA_4060.pep
RQRLHSAXARGSEHGLGGRRTRISARRLSLPSTLHTARHCFLPYTRGELEMGSAHWSWGTSAGSNSPPLFAPRPWGASAAGSSSGAVSSLCAARPDRRRRGGAVSSPAAPLISSPSANCFFFFRLI

SEQ ID NO: 109643 - protein, 211 aa, Triticum aestivum
  Clone ID: PAT_TA_4061.pep
PSDRSPSPSCRRRRRSRWRATVRTTATAPTASPRRSRARRADQRDETPALLDPAPAAPQGRGAERGGLLDPAEVPQLQWADPISSSPRVYGRKQWRAVCKVLGNDNLLAEILVRLPPKPSSLPRASAVCKRWRGILSDPEFLKRFRKHHRKPPLLGFFEGYANRFAPVMDSPDRITASCFSMPKSSTRYNDHREYMGCRHGLAVLVNKQER

SEQ ID NO: 109644 - protein, 78 aa, Triticum aestivum
  Clone ID: PAT_TA_4062.pep
MAGAPPTPAEKDALVSSFLEIAAGQTPHTATQFLQMTSWHLEEALQLFYIDGEAALAGAHPPAQSAAEAALAAAAAAK

SEQ ID NO: 109645 - protein, 213 aa, Triticum aestivum
  unsure (1)..(213): unsure at all Xaa locations
  Clone ID: PAT_TA_4063.pep
MGMGPLENAAAVEVPVVTAAAAGGGSYALLQCGEDSAYVRDAYGGYFEVFRALLAEDGERWRVYRAVRGELPSDDEAAGIDGFVISGSCSDAHGDEPWILALVDLIRRQLAAGKRVLGVCFGHQILCRALGGKTGRSXRGWDIGVSCIHPTAAAARLFAPLKMPGHLPIIEFXMTRCWELPAHAQVLAPSXRTGVDMLRAGPTAAMGPPGPTP

SEQ ID NO: 109646 - protein, 382 aa, Triticum aestivum
  unsure (1)..(382): unsure at all Xaa locations
  Clone ID: PAT_TA_4064.pep
MRRFSAAGARQQQGEAVSDRLHRYRGVLMVVLSPVLLVSFVLLLMPRSPASVTGGASGVLVATGGRRWGPQAVGGVGDGSNRYAVIFDAGSSGSRVHVYCFDESLDLVPIGNAIELFKQKKPGLSSYAKDPQEAAESLVSLLEEAEKVVPVELREQTPVRVGATAGLRALGAERSEEILQAVRDLLRDKSSFKSQPDWVSVLXGSQEGAFAWVTIQLSVGENWGKPYSHTXVGVVDLGGGSVQMXAYAISEKDAAKAPQVSDGEDSYVKKLXLKGTTYYLYVHSYLHYGCLXAARAEIFKXGENSDYSNCMLXGYHGETQYGDDTFEASRSXSGATFPSARLCNQXPKVDERHPHMKSHWWRWKGGGGNAENPLYTFSDGQV

SEQ ID NO: 109647 - protein, 228 aa, Triticum aestivum
  unsure (1)..(228): unsure at all Xaa locations
  Clone ID: PAT_TA_4065.pep
QTAVKAREXLEGHSIYEGGYCKLHLAFSRHTDLNVRINNERGRDYTGANSAPANHEPSILGPQPMLAAGSTAPPYSSAPSAAADVVAAPGTTSILATPGAPSLPSSQPHPQAASGGPQQYASQGVLQGYGAPGFPQGPNQAQMSQHSGQGNQQMPNHQAMSFPGHGRQQLPPGPQMMQGPGYRGPPFPQGHMQSMPQFPVYGNQQFPPGAGPQMMGFPGTGRSVSSIW

SEQ ID NO: 109648 - protein, 198 aa, Triticum aestivum
  Clone ID: PAT_TA_4066.pep
MLPDGGGDDEERWLAEGIAGVQQNAFYMHRALDSNNLKDALKYSAQMLSELRTSRLSPHKYYELYMRAFDEMRKLEMFFREETRRGSCSVVDLYELVQHAGNVLPRLYLLCTVGSVYIKSKEAPAKDVLKDLVEMCRGIQHPLRGLFLRSYLSQISRDKLPDIGSEYEGDADSINDAVEFVLQNFIEMNKLWVRMQHQ

SEQ ID NO: 109649 - protein, 261 aa, Triticum aestivum
  unsure (1)..(261): unsure at all Xaa locations
  Clone ID: PAT_TA_4067.pep
VVDPLKPXQLKDQHLGLQGEHQYENAGLAVALAAAWLEKQGHVDRMPLNHTDPLPDQFIRGLSSASLQGRAQIVPDSQVNSEEKDQDSSLVFYLDGAHSPESMEICAKWFSHATKEQSQTCSKSRKILLFNCMSVRDPMRLLPHLVDTATQNGVHFDLALFVPNQSQHNKLGSKASAPAGPEQIDLSWQLSLQAVWEKLLHDDNKGSNSTDSGETSLVFESLPLAIEWLRKNAVEDPSTSYQVLVTGSLHLIGDVLRLLKK

SEQ ID NO: 109650 - protein, 142 aa, Triticum aestivum
  Clone ID: PAT_TA_4068.pep
YYTTKSGTSCNLHMTASRYFVSKSLTNSIFLPRLHRNPHLPFSFGCIKEDNLVMFFLLTGLVVLLLFFAIDTASFSSIDIMAYCHTAILLVLPLLDPPIQQLLCSTSAYGRWLTPAYSPSTVCSRRRFLRRSSRVIWEWPPP

SEQ ID NO: 109651 - protein, 232 aa, Triticum aestivum
  unsure (1)..(232): unsure at all Xaa locations
  Clone ID: PAT_TA_4069.pep
RSLRIELPAGELGMDDGVLLKWKADFGSTLAPGGILGAASASASPSSAAKDGATAAPPPPTADCAESDDSGSIPESFYTNGGLKLRVLWTISSLIAASARHYLLQPIISDHALLESLDLTDADGQGALTMDKWQLQELRVRPXSASGDSHRTLMPALXMRLWYAPHIELPGGTVLCGATLLAVGPSEEAMMDAVGNATAGSAGGILGFKMLLRTISDGRVLLLKAEDVIPLR

SEQ ID NO: 109652 - protein, 71 aa, Triticum aestivum
  Clone ID: PAT_TA_4070.pep
SKLNIPMELPFRRLLCACPAPFVLWTRTNFTSDHGQVITDWITFSQGPAKLSNADDQTLLQMCMRRKRLTG

SEQ ID NO: 109653 - protein, 145 aa, Triticum aestivum
  Clone ID: PAT_TA_4071.pep
HPAPPFPLPRALSRDSPRPCARTCPGPRAGPPPAPRPSPPSWSPPRRRPRRPPPPPTTTATSAAPTAPRRTQPAPKCAARHAASAAKPRAPAGGAPAASADPDGCMHACMASHTTQDTRVRPVFGGEMRACLLWSFRPSRLRSSC

SEQ ID NO: 109654 - protein, 81 aa, Triticum aestivum
  Clone ID: PAT_TA_4072.pep
GAAAPAPSRLSGCTGLLPRHDVGARRRRAVAGERGRTRDRGEAARSPLLPPVCDLLICIGHLHRHRESPPPPPPGIPLTAR

SEQ ID NO: 109655 - protein, 130 aa, Triticum aestivum
  Clone ID: PAT_TA_4073.pep
MLPIWVQMVLGGVVYTAVPFYMRARQIEDKAIENVETALDVLERASEVTEKFAANVANSLPEDGSLHKLAEELEYIAEEVDKNAQKAEVMIQKIEALSDKIDAAVEPVIENLEEEFKPNPASHAGSDAQK

SEQ ID NO: 109656 - protein, 63 aa, Triticum aestivum
  Clone ID: PAT_TA_4074.pep
MILFTHCIHKVSFFVILRHPSGYGLPCDFFFSLLVISGVSLQLNFWWYPVCRLSYAEVALYFC

SEQ ID NO: 109657 - protein, 172 aa, Triticum aestivum
  Clone ID: PAT_TA_4075.pep
MGDRERRVVFVTVGTTCFDALVKVVDSEELKQALLQKGYTDLLIQMGRGTYKPSKASGNSSLQVEHFTFSPSIADNIREASLVISHAGSGSIFETLRLGKPLIVVVNEDLMDNHQSELAEELAERNHLFCAHPHTLRETVEAMDLKTLQPYVPGEAKPVVALINRFLGFPVD

SEQ ID NO: 109658 - protein, 279 aa, Triticum aestivum
  Clone ID: PAT_TA_4076.pep
PAQENSFQLRRRRQVLLEGLAASLQLADPLGPSKSANSSGLAPKDDIVFLRIVSLPKGRKLLARYIRLIVPGSELTRIVCMAIFRHLRCLFGGLPSDSSAAETTVALAKTVSTCAHHMELGALSACLAAVVCSSEQPPLRPLGSSAGDGASLIIKSVLDRATELLTDQRAVSSYTPSNRALWQASFDAFFGLLTKYCLSKYESILQMFVMQASGSVIGSEASQAPSREMPVELLRASLPHTNEQQRQMLLDFAQRTTPASSFNPPGASGGHISSESVPG

SEQ ID NO: 109659 - protein, 277 aa, Triticum aestivum
  unsure (1)..(277): unsure at all Xaa locations
  Clone ID: PAT_TA_4077.pep
YTLNDCXAQICSSVSGPAASAYKGYCWSKEKAEYLSSRGTXNASYTITCTLNLREDLLGCPIPGTPPVVLNDSVAGSGQAQGYSVQEHAFSGQEAKPXSSSYSSPNNLNHTGAFDAQPVSKQYMVCVVHFDGASKGNPGKSGAGAVLMTEDGRVISRLREGLGVATNNVAEYRGLILGLKYAIRLGFKRIKVYGDSQLVCYQVKGTWQAKKENMMELCKEVRKLQENFISFEVHHVRREWNSEADRQANIAITLASAPFSEHVAVAFRARDRCPVPP

SEQ ID NO: 109660 - protein, 174 aa, Triticum aestivum
  Clone ID: PAT_TA_4078.pep
ARGKDPRILQFHWHTDFRKLILVLAWRGSPLWSPAAVPVPLRSPLPPPRRGARSTCGSSWRRSSSSRTTPTTPSPPPRPPRSPAPTPTANAAAAAPPPRARRPPPWRTARGRPRRRALRARRGLRPRRARGPRRRGASASTRRRPPRRAPFPSVGGWLSVRVLVPIQHRSRRSG

SEQ ID NO: 109661 - protein, 78 aa, Triticum aestivum
  Clone ID: PAT_TA_4079.pep
YPPFFYPKLGELAKTLLPKLETIYYIHNFKGSKGGALFRCYPGPWKVLRKVGGSFVCLHEQEEMPSLKEVALNILPSA

SEQ ID NO: 109662 - protein, 152 aa, Triticum aestivum
  unsure (1)..(152): unsure at all Xaa locations
  Clone ID: PAT_TA_4080.pep
MAKADKKPVAXNKVXKXAEXTPAGKKPKAEKRLPAGKTASKEAGGEAKTRGRKKGSKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 109663 - protein, 153 aa, Triticum aestivum
  Clone ID: PAT_TA_4081.pep
MAPKADKKPAAENKVEKAAEKTPAGKKPKAEKRLPAGKTASKEAGGEAKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 109664 - protein, 192 aa, Triticum aestivum
  unsure (1)..(192): unsure at all Xaa locations
  Clone ID: PAT_TA_4082.pep
DQVTHLPCLQQTHTYSPPAAPNPTRRRQPWRPKADKKTVAENKVEKAAEKTPAGKKPKAEXRAWPAGKTASKEAGGEAKRGGRKKGSKAKKSAETXYKIDIVKVLKHVHPDIGISSKAMSILNPFINDIFEKLAGASGKLGRYHKKPHQHLPGSSRPPAASSPPAALAKRRARRGHRGRGQHHLLLVLTARS

SEQ ID NO: 109665 - protein, 375 aa, Triticum aestivum
  Clone ID: PAT_TA_4083.pep
MERLGRAGRIIADIRLGADRLLEALFVAASAPPDSAQQHIERNEEVVAKEEVSMHRHFDDLRALGRQLEESGVLNGALKARGNSWGLHMPLVCPDGAVVAYAWKRQLAGQAGASAVDRTRLALKAFTDQKRRFFPHLEDEVLNHLHDGESGIAKRPRMPAGNGELEEKTLSEILKNLENEVPNMKISTYRRLDWSKRASSLASLMDDDFVDPSKELNLQNMGKSRPGSVTTPIDQVAVIELLVPSIFRVVVSLHPAGSVDPDAVAFFSPAEGGSYLHARGLSVHHVFKPVTEHADKALQYFISVEPSKALSILLHWIADYQTLFTKLCSKCRRLLLMDKSLALLLPPVHRPYHQISSIGSDHQEAYHIGCSSYDA

SEQ ID NO: 109666 - protein, 49 aa, Triticum aestivum
  Clone ID: PAT_TA_4084.pep
RPLLHGHGHHGHGRRRRTRCSWRAALLGEAATYVGLVDRRWRWHAEHAS

SEQ ID NO: 109667 - protein, 125 aa, Triticum aestivum
  unsure (1)..(125): unsure at all Xaa locations
  Clone ID: PAT_TA_4085.pep
MKNWIGSSSRHVRPRPAAGVPLSAMCDSFTRYLFYLQEEAKGXGKRWHRRLANLIGYCCDGVVRPRFAEFMPNDTLAKHLFHYSTMSPACSPSPAPGSSTGSFAPPSTSKFKQLKDKKFKRSVPL

SEQ ID NO: 109668 - protein, 111 aa, Triticum aestivum
  unsure (1)..(111): unsure at all Xaa locations
  Clone ID: PAT_TA_4086.pep
ELGGSENCIRLLQIWDFLGFLVSRQKDCQLSHPFYLSITSKSXXVXQSLVNLFFRWLPLSAPGCSRGGWSEASRVAVDRPAPVWPGNVGALPHQALHSSLLSDSKRRNNSP

SEQ ID NO: 109669 - protein, 228 aa, Triticum aestivum
  Clone ID: PAT_TA_4087.pep
HSEKFENLTEQELCLKESLAAYRNAADAASNIQAALRDRTLKLQTKAILLANPEMQATAIVAAMRIQHAFRNYNRKKEMRAAARIQNHFRTWKVRRNFKNMRRQAIRIQAAYRGHQVRRQYRKVIWSVGVVEKAILRWRKKRKGLRGIANGMPVEMTVDVEAASTAEEGFFQASRQQAEDRFNRSVVRVQALFRCHRAQHEYRRMRIAHEEAKLEFSKGQQQAPACRR

SEQ ID NO: 109670 - protein, 112 aa, Triticum aestivum
  Clone ID: PAT_TA_4088.pep
FGSLYASSISEAGQRRWRGNRSLTSASHSSTNGSRFAPFRSLLSPPVSYAGAACVWLNQYNEIKAQLVSQRCKSIYARPIFSMLRTVIGSVGPLLPFIFLFEIIYSCSISQR

SEQ ID NO: 109671 - protein, 164 aa, Triticum aestivum
  unsure (1)..(164): unsure at all Xaa locations
  Clone ID: PAT_TA_4089.pep
MADVEYRCFVGGLAWATDDQSLQNAFSKYGDVIDSKVPIPRLLPRSARXISKFVGGSVVLCLRNPGSDGFGVXLAVLIITDRETGRSRGFGFVTFASDXAMRQAIXXMNGQDLDXRNITVNEAQSRRSGGSGGGFXGGGGGGGYSGQRRXXXXGGGXXGGGGGS

SEQ ID NO: 109672 - protein, 121 aa, Triticum aestivum
  Clone ID: PAT_TA_4090.pep
STPGVLGCRRRASGWPCRTHVPHTCVLTNSWSFVLGSKPNGHALLAGPVLRTLRNALSSSPLAEEHSRVALFPQMPSDESQILAGYQVSSQTLTNLPWTRRTLYGPPRLRLKHIKLLGDVY

SEQ ID NO: 109673 - protein, 186 aa, Triticum aestivum
  Clone ID: PAT_TA_4091.pep
PPRAAAPPRSPPATIALAAIFVFLLVCAVHVLESMLDLAKKRGSVSDEQVKLRVAITQLLKESSALSTPSTFAQAAKLKRLAAAKEKELAKLQQSDIKGKQSLHEKYGKVLKATKVLVYGLLVLSFWSAPVATVPNHLLQPFGRMFSWKGVDAATGRVVVGIIPWLFLTSRVSKLLSQKLAPMFLH

SEQ ID NO: 109674 - protein, 115 aa, Triticum aestivum
  Clone ID: PAT_TA_4092.pep
ADAWADAWGYSRGARAPLPSSFLPPGVDAAAAPGGGQAGAATRRWACARQGRAQARVRGSGIGGVDEELGGARTVGNGGSGGCMQAGRQPCISPGSMTRPCSGRRYNHLKKVLKY

SEQ ID NO: 109675 - protein, 238 aa, Triticum aestivum
  unsure (1)..(238): unsure at all Xaa locations
  Clone ID: PAT_TA_4093.pep
TSNGGGKNGGGGQANDPRRGGGGGAPGGGGQAGQPGKKGGGGGPGLGVGGPMGGIGMPPQQQAMMRPNMMGAAGFPGXGPMGGPMGHHPHMGGAQGGGGAAHGMPAGGMPPPGFFQGGAGGGGGGGMPSGPAEMMQAAGNPMAQQQYMAMMQHQQQMMMQQQQQQQQAMMNGHGHAHAHPHHGGGGAPAGYPAMPMGYGYGRPPMPYPMAYPMPMQPHPHADPYNYFSDENPNSCSVM

SEQ ID NO: 109676 - protein, 118 aa, Triticum aestivum
  Clone ID: PAT_TA_4094.pep
TPHPRKEEQRPRVPRRRSIPTARVRPAAIGCRSTIHEAEPPVGLAVGVEEGGAQSPLPRWSWWGRHPRNPSHGKGSGVSSRGRERRIWPEGREERRQGSSDLCCVPARPAGTRRNQAA

SEQ ID NO: 109677 - protein, 247 aa, Triticum aestivum
  unsure (1)..(247): unsure at all Xaa locations
  Clone ID: PAT_TA_4095.pep
MVKHVQDEENQRLLLDDHKEKHFTSGEVVRDIIIGPSDGLAPPRPPPAGPPPASPSSAPGPIAGXAEGAAPPRATPPGGYLAAKSDADHYYRELQREXQDEIDTVPDTKAAXTIGDILSEYGLGPKEYGPVVTSLRNNPKAXRQSLGKRERARGKPRPRRALTGAATIALACVVGGMVPLSPYMFVASVDSAMMTSVVXTLAALLFFGYVKGRFTGNRPFLSAIQTAIIGALASSAAYGMANAVQAI

SEQ ID NO: 109678 - protein, 149 aa, Triticum aestivum
  unsure (1)..(149): unsure at all Xaa locations
  Clone ID: PAT_TA_4096.pep
MGFLRKFSKQTRKLKSLLELTVSRVAIARKPRLARKSXRRGDVCQLLSLGQTDRALQRVEQVIKEDNMLEALGIIELYCKCLVKKAAQLDKPKECAEEVKKAAAGIIFAAKRCSDLPELQSARKILADKFGDDFTADAGVEVVRRQGKH

SEQ ID NO: 109679 - protein, 462 aa, Triticum aestivum
  unsure (1)..(462): unsure at all Xaa locations
  Clone ID: PAT_TA_4097.pep
RTRLALHHYNCLLYLCSNAAAEDADAARRGFEIFAAMEAQGVEPNEATLTSLARLAAAVRDPAMAFSVVRRMAAAGIPPRLRSYGPALFAYCDARDAVGAAEVEAHMDAGGVVPEETELAALLRVNADTGRADQVYRVLHRTRTLVRQVCEATAQVVEAWFRSDAAAEAGVEKWDARGTREGVVKGGGGWHGQGWLGKGQWDVGQSEMDKNGKCQRCGEKLVCIDIDPSETETFAKSLAELACKREVRDDFVRFQDWLRRNGPFDAVIDAANVGLYNSKAFSFSQVNSVVNGIQRVTKSKKLPLIVLHRSRVNCGPAKAPQNQKLIESWRNAGALYSTPPGSNDDWYWLYAAVNCRSLLVTNDEMRDHXLFQLLGTSFLSPDGKEKAPRSGLTVLRPRGPYNFHLPATLILNSIQGNPQNPGNLGEPWPNQPTREEPTFKPPPGKWGFCRPPPKEFLVGAPP

SEQ ID NO: 109680 - protein, 344 aa, Triticum aestivum
  unsure (1)..(344): unsure at all Xaa locations
  Clone ID: PAT_TA_4098.pep
PPPPARLPPLAPRRPPGGRPAPRPLPPPAAPPLRRGPPRGGCLGVRGRAAPARLGAHAQPRRRGADPSLLPGVAWATHLSLQACVIPPPKRSTCANYARVVNNILQGLTNMQLWLRIPLEKSESLDEDRGRSETVDSWEWWNSFRLLCEHSSQLYVALDILSSLPSMNSLGRWFGEPVRAAILQTDAFLTNARGYPCLSKRHQTLLTGFFNHSXKVIISGRSNHNVSQVSEGVLSRDENHTEDTPTPHALSPYLEYMAYLYQRMDPLPEQERFEIXXRDSLQSPLQPLMDNLEAQXYETFEKDTVKYTQYQRAIAXXLVDXXSXDEVSTAXXXLMVVXXXXXPL

SEQ ID NO: 109681 - protein, 114 aa, Triticum aestivum
  Clone ID: PAT_TA_4099.pep
PEGAASSRGPFQGRVVGLPPVPQALCLRASGRVRGSRRTVSPCSRGCLRGAWEAGRRVRWCCQNSFPTGSGRSSTTKSVEPQVTHQLLSICCDPIPKLALRRVRTRDECNHAYW

SEQ ID NO: 109682 - protein, 162 aa, Triticum aestivum
  Clone ID: PAT_TA_4100.pep
MVNPWFQNLWYITGAQKYGQSLFLDPNVKGGYVDVRFADHNQAQLVVEQREEYPFKVTWTPTVDRSQMITPGKVELYQPPRDRDVYDMELAVPMPWTNPFPVRFEPRKMAGDPVRPIYPEKAQPNPPLSKPPFAQPIWPDPPSRDHFIKYYMTNVPEPDPST

SEQ ID NO: 109683 - protein, 165 aa, Triticum aestivum
  unsure (1)..(165): unsure at all Xaa locations
  Clone ID: PAT_TA_4101.pep
AWRTWCCPGACSRSAPPRCAPPGGPDRRTPPPASTWAGAPPPPPPPPSPRRXGAPPPPPPPPXPPPRASPRSGATHPPPSIPRRQPASPPPPPRATSPPFNRPPLCPSSVGRKEIALFFASFLSLLISFLCLSSSFLSSSSPFWPLVGFFSRALILFYSTCQSLL

SEQ ID NO: 109684 - protein, 273 aa, Triticum aestivum
  Clone ID: PAT_TA_4102.pep
PACPPASPPAPASAAASAPPPRRSGAPSPPPARGPAPAASPPAGAPPPPAAPAPATPAPAAPAPASPAPATPSGGYAPKGPAGTQPKATTEEQNVMEQVNNAFKAAVAAAAVVPGPDKYKKFTDTYIPDVERAIADVFKGSNASTFTTKIGMAQKLAYDSADGATPEAKYDSFIAILSESLRIIAGTLEIHGVKPAAEEVKGPIPVAEMKAVDQIDSAFRIAATAADAAPVNDKFTVFEAALTRTIAAMCVAAKGAAGATNGTDAAGGYKAPA

SEQ ID NO: 109685 - protein, 219 aa, Triticum aestivum
  Clone ID: PAT_TA_4103.pep
SATVRTPPASGGHPRRRRWNAGFTPRRGAGIRWRIRQPPALLQIDGVCGVRGAQAASLPGSVRSCIVLGRSPFLSWVRFTQLHWSPPRHPLPSWSPWPSPPGQWLGPPDPLSAEPPPLLAPPPVGRPAVQFIIPQSSPPASLPFHFLLVLVPPGWFSGPVRYRLVGFRRHWLAARCPAFYPPSARGPPPPPPPFPFFSLAGFLVWLPGFWGIFLCHVFY

SEQ ID NO: 109686 - protein, 232 aa, Triticum aestivum
  Clone ID: PAT_TA_4104.pep
VKDAMDSTDPKTALEGKYKMTALFQKHGVSPFSPLKGMLIQGPMFMSFFFAINNMVEKVPSMKGGGVFWFTDLTTPDPLYICPVLAALTFLATVELNLQEGMEGNSMADKMKTFSRGMALMTVPFTMNFAKGIFCYWVTSNLFSLVYGIVMRRPAVRKLFNLPAWEAPSAPALNSALNMFGGSKAVPSAKSPLALTAAQQSSLEKPDAAALGYRVKNLEKKGKSRGKSRKRR

SEQ ID NO: 109687 - protein, 176 aa, Triticum aestivum
  unsure (1)..(176): unsure at all Xaa locations
  Clone ID: PAT_TA_4105.pep
DAELKRRKIPRNKQVLKETFDEWEEAYPHDAXQRKTDELFLKEALXEAQRAADIWEVPVGAVLVHNGEIIARXGCNLVEDLRDSTAHAEIVCIREASSXLKTWRLADTTLYVTLEPCAMCAGAILQARVDTVVWGAPNKLLGADGSWVRLFPGDGQTSTLDPSNQKQTAGPVHPFH

SEQ ID NO: 109688 - protein, 383 aa, Triticum aestivum
  Clone ID: PAT_TA_4106.pep
RHEQRIDEVAKQRKELQDKPMMYVEACENHVHAKKKIQVLSNGCSEDLQKVQDALQWEDFFKQKAAPEKNKHFRAIEEAEMVKEAFTREAYSKHNAETVTNMATTEKAKVLDALLSRGKSCRRYSRHEIELATENFSDAKKIGEGGYGIVYRCTLDHTEVAVKVIQQDSRGKIDEFFKEVEILSRLHHPNLVLLLGFCPEIGCLVYEYMENGSLEDQLIDNEGRQPLHWFLRFQIIFEVARGLAFLHGTKPEPIVHRDLKPGNILLDKSGGSKIGDVGFAKLISDGAPDGFTEYRDDTVIAGTMYYMDPEYQLTGTVRPKSDLFALGIIILQLLTGKRPQGLILSVEEAIRKGTFPDILDVSLNDWPIAEAEMLAKLGLHCTA

SEQ ID NO: 109689 - protein, 290 aa, Triticum aestivum
  Clone ID: PAT_TA_4107.pep
MANVLLSGLRGAKQLGQNFRSACRSLSSGQLVEPGYVFGRKCFGPGDGVTTSVGQYGLPKSVDWRKVPWLKIPVKDQRGCGNCYIQASLVGIGSLHSIITGINVELSSQHVLDANTITNSGCMGGTIPKVFDFVMRGGVVLESAYPYTGKRGFCQDIKAKGLTIEGWAQVAPAEEALMYAVAHQPVAVGVAAGTEFENYQYGVMNVPVDHGILNHAMLLIGYNATSWLLLNSWSEAWGIKGACRILRKSPNSDGSIGILSRAYLPLNPSFTTVRTRTESCPCYWSRTKSP

SEQ ID NO: 109690 - protein, 169 aa, Triticum aestivum
  Clone ID: PAT_TA_4108.pep
YGIAAQMHGPVSISSQARSPWPPQNASRMRSPSKKERMRSRPSDAAKLHLEHVRTHCARPIHLWNTHEGPVIPLQQDGHHPQRRRCTKVRLQGRPRLRDETIVAAADGRGWRRCGGRQPFSCSGGDHGWGEWMAVVAAADGRGWRRCGGRQPFSCSGGDHGWGEWRMAS

SEQ ID NO: 109691 - protein, 223 aa, Triticum aestivum
  unsure (1)..(223): unsure at all Xaa locations
  Clone ID: PAT_TA_4109.pep
MSGPNQGGQQTSSSTMVPATPSATRYSQNCSVCGSTGHSVQNCPAVAMDMQQPAASGYAASSYGSSPGDAGSGLCFKCNQPGHFSRDXPQQEATSYRSPAANANANSGLCYKCNQPGHFSRDCPGQAANSYNASAGGNAGAGGLCFKCNQPGHFSRDCPGQAANSYGASAGGNAGATGLCYKCNQPGHFARDCQGQAAAPQRQAYGNGAASGGYNRQSYVGSF

SEQ ID NO: 109692 - protein, 138 aa, Triticum aestivum
  Clone ID: PAT_TA_4110.pep
LQDTTLGSLLSSLMQHCDPPQRRFPLEKGVPPPWWPPGPSEAWWPEAGVPDDLGPPPCKKPHDLKKAWKVAVLTAVFLLMSPDVDWGGRLVRQSTCLQDKMTAREIATWLAVLKAEEELSHKLRPGACLPPRPSAGAL

SEQ ID NO: 109693 - protein, 62 aa, Triticum aestivum
  Clone ID: PAT_TA_4111.pep
STAKVRRTIDQVKHIKTQHVNRKDHTNHSFMCRSRKVGERIEDLDETKLNRGCIFGHQHRAH

SEQ ID NO: 109694 - protein, 88 aa, Triticum aestivum
  unsure (1)..(88): unsure at all Xaa locations
  Clone ID: PAT_TA_4112.pep
GLGDDGAICLARSLKIINESLKSLDLGFNEIRDDGAFALAQALKANEDLAVTSLMLANNFFGKFGQVALTEARDHVYEMKXKEIDIYY

SEQ ID NO: 109695 - protein, 346 aa, Triticum aestivum
  unsure (1)..(346): unsure at all Xaa locations
  Clone ID: PAT_TA_4113.pep
TRPHDQPLPAAPPAPVARPRLPPAPPAXRWPPPPPPPLPRLPRSLPLPRASLPXHHAPPPAARCKPAGSAPPAPAPPAPLTTAPASAXPPPRRPRQAPLRQPPPCSARPPARRAPSPPTKPPTLPSKSSPWRRRERGPRRTASATTPKXAEAGLPSVTRHRTPSSATTTTTAPRRRATTAAPAAGYWNPRRSRSASSTPGGASRPRLSQQEQTPQRLPPSSRPSPPLPPAGPLRTTTVPGYTPGRPRPPPPPFPPPSPRPRPGPPRSPPPAPGRPAAPGSSRGLPHRPPRPAADDRRRRDSRRRVRGSCFIIAASIDQLVVAYLHQFAVCLSPLLGINDSCSSMDL

SEQ ID NO: 109696 - protein, 101 aa, Triticum aestivum
  Clone ID: PAT_TA_4114.pep
RHLIIIFADVPPQVHNSRGMAPFGLAEARRARPSRAHVWTLRTRARGVCVDDGAQGVEEVRIKEDPRCEASYPPSQSMSTSNDCERLGKEREWERGNIGSM

SEQ ID NO: 109697 - protein, 158 aa, Triticum aestivum
  Clone ID: PAT_TA_4115.pep
QKQGKKELSSARRRQWTTSSPPDLIPEAAVLVLHTSPRVITLLPTFSNPLCTGLLLVIYRGSHTRGSSTGSTYNNSIHHRPIAVAFAVDDDGGETAVSFLAPPRSAGGPGSFVWGVRALSGGSGGIELTAAGGGASAAATTHAESALVNISLGSPRVR

SEQ ID NO: 109698 - protein, 127 aa, Triticum aestivum
  unsure (1)..(127): unsure at all Xaa locations
  Clone ID: PAT_TA_4116.pep
RGRCRLNPLICLVAVLPAFPLVSNLEDCQAGVILRWRGGRGRSTHAKHCVPSFCPPSLPERIHETSMRTHDRPPLAPFTLPLEASRRLPANGSLGKLVRTAPKWSLXVANFLNTATLITLKVATVTT

SEQ ID NO: 109699 - protein, 201 aa, Triticum aestivum
  unsure (1)..(201): unsure at all Xaa locations
  Clone ID: PAT_TA_4117.pep
LLSDICISTSAAPTYLPARYFKTEDSHGNIKEFNLIDGGVAANNPALVAIGEVSKQIFKQDPDFFPIKPMDYGRVLVISXGTGSSKFEEKYDAQKAKSWGVLDWVXSSGSTPLVDIFTRASADMVGYSHCFCFQSLTFGSKNYLRIKDDNLXGDTSSVDVATRITETVNVGESAKETSTANWRRQMVLQCIRHEEHQRKCR

SEQ ID NO: 109700 - protein, 196 aa, Triticum aestivum
  Clone ID: PAT_TA_4118.pep
MTDAAASSSRRRMEAVRRHLLPRPPPVLSLNQLSAPEAGQSPVIIGGMVLDIHAKPSVPSHPGTTVPGMVKYIGGGVARNIAECMAKLGTQPLMISVIGDDMAGDFLLKYWRLAGLCTDGILQVPDVTTPVVSNVFDGNGELFAGVASVQAVETFLTPTWIYQFYRRISIAPLLMLDANLSPESLQAACKVAALPE

SEQ ID NO: 109701 - protein, 138 aa, Triticum aestivum
  Clone ID: PAT_TA_4119.pep
WAATPGRRRSRRGTTSSSGSAPSTHPPPPRPRPPPAPPRPPPPPPPPPRPPRAAPGPPPAPPPPPPPPPPPPPPPRPPPGQVVLRLRRSHHPPLHPEPPPTAPPRPPTRPPAGRALGGSRRGRGGAAGPRQAGVKRKI

SEQ ID NO: 109702 - protein, 184 aa, Triticum aestivum
  Clone ID: PAT_TA_4120.pep
TTTASSPQNGSTSQPILVRHGGGNGGNNGGGGDGNVSTHSQSTGNYSSDGNSSSGGDGNWNDGGLSGGSNLNSSVHSGAIGGSGIDNSRRVFGSNNWNGNGRGGGSYNNATGSGDGGNRYNGGSGSGHWNNNARHGSGNSNGFGARGGRNRRDHERGSNFSPRGYSRALPVQQQQPGYYQPGPF

SEQ ID NO: 109703 - protein, 172 aa, Triticum aestivum
  Clone ID: PAT_TA_4121.pep
MSSEQEHPETSELEEEAEKDEDAAIVELVTELKQEGTTLFRLRDYDGAAFKFDEAIRLSPRAPRAYNENDIASLHSNVAACYMHMNAHRPEDDYHYHQAIDRCNMALDASPRYTQALLKRARCFEALDRLDLACVDVQEVLTLEPNNAVALELLESLREEMEEKKFLLEQEA

SEQ ID NO: 109704 - protein, 93 aa, Triticum aestivum
  Clone ID: PAT_TA_4122.pep
MNNMQTRWTTIVRAGNKQNSDMPSSVTHRLDVQVHMLVRRNGSKCGHRSNSTPQSEIIGAEPREESDLVLSQSQQTVEFCQANQKDNLQLTKQ

SEQ ID NO: 109705 - protein, 239 aa, Triticum aestivum
  Clone ID: PAT_TA_4123.pep
MESRKPQRSALVDSYVVPGDVILDLADMTNQTIKLGAGLRQDCDTIQATSAGRLRLSKPNKYWVENSQKRYVPSVEDTVLGIVVDTKPDNFLVDIKGPNLAFLPVLSFEGGTRRNIPKFEIGTLIYARVVKANSIMNPELSCMDASGKAAEFGQLKSGYTFETSTGLARMLLSSPTCPLLEALGKKLSFEIAVGLNGRVWVNAPSPSNVIVVSSAIKESESYSRLQQKSMVEKLLAKLS

SEQ ID NO: 109706 - protein, 288 aa, Triticum aestivum
  unsure (1)..(288): unsure at all Xaa locations
  Clone ID: PAT_TA_4124.pep
RPTRPAARNGTPKPDASIASRGHLXDLLDYINPDDELKAKEMQKKQARAKIKGRTGQNPSELADDEDQRSPPPNSDRSSTEKENSDVKEKLTEKKNSQAKENGTVVEHVKVKLEEAKPGNTVVHLPQDDYTEENISEEGWQEAVPKGRTTGNRKTGASVRRPNLSKISTNAINNSENGRYKGRVPSNSSPRVSPNEAAASVASSPLAKKLAKSLSFNSKAGNPTISSNSGENSPKPKSMAASLATTPAAAKVMPSAAPIVSQTVRKSLSYKEVAIAAPGTLAKALNDV

SEQ ID NO: 109707 - protein, 218 aa, Triticum aestivum
  Clone ID: PAT_TA_4125.pep
MLVYGFIAIRDELDCLRNYIFNCTREQAHEITPDSRALPLISPVRGNSILDGVVLEYSLKVKSNGSDNAEMDYVLADGCIEYTDHMILRGTTLKSRLFGKLGPVDFHYAFLRQGIEATIDIEIPMASPAWGLKAVTAFTSGLSDAIVLYDGSTNSSPTQSVFPISSVVAVQLGHELKLKFDITSQDIVPKGCARSCPPRSGNTKADWWGEQRISRPNH

SEQ ID NO: 109708 - protein, 439 aa, Triticum aestivum
  Clone ID: PAT_TA_4126.pep
MSFRSIVRDVRDGFGSLSRRGFDVRFLGHRRGKSHSAVHELHDPAPVIQSSCWANLPPELLHDVIERLEASEATWPSRKHVVACAAVCRTWREMCQEIVKNPEFCGKITFPVSLKQPGPRDGTIQCFIKRDKSTQTYYLYLCLTSAVVAENGKFLLLAKRHSRPTCTEYTIFMNTDNTSRSSNMYIGKLRSNLLGTKFVIYDTQHPCNIPNVSQSGKTSRRFYSRKVSPKASPSTYSIAQVSYELNVLGTRGPRRMNCVMNSIPASSLVAGGTVLCQPDSAVAHSLDESFGSISFSKSSIRDRSIRFSSTRFSGISIGGSRNGGQALGDNDECKEWPLTLRNKAPRWHDQLQCWCLNFKGRVTVASVKNFQLVAATESTAEAPTPSQPAPPPPSEHDKVILQFGKVAKDMFTMDYRYPLSAFQAFAICLSSFDTKLACE

SEQ ID NO: 109709 - protein, 71 aa, Triticum aestivum
  unsure (1)..(71): unsure at all Xaa locations
  Clone ID: PAT_TA_4127.pep
FAHGDTFLLLYLSVTICFLVCCSLHTVNVFGTKVKSLIVCRDRDNYSPKGSYSPHTXDKMQHISDGRSPSL

SEQ ID NO: 109710 - protein, 89 aa, Triticum aestivum
  Clone ID: PAT_TA_4128.pep
MSQNNPSQLLPSELIDRCIGSKIWVIMKGDKELVGTLCGFDVYVNMVLEDVTEYEYTAEGRRITKLDQILLNGNNIAILVPGGSPPDAA

SEQ ID NO: 109711 - protein, 245 aa, Triticum aestivum
  Clone ID: PAT_TA_4129.pep
MARYRSRSRSRSYSPRRRYSRSPPRYRHYDDPRDRYRGGGGGGPRRGYDRPSAPTGLLVRNISLTARLEDIRGPFEQFGPIKDVYLPRNFHTKELRGFGFVKFHHPEDAAYAKQEMNHQVICGREITIVFAEENRKTPQEMRFRTRSSGRHMDGNYRRRQSLSRSPRSRYPSYSPEPSPVRRHSRDRDNYSPRDSYSPHTRDKRQHISDGRSPSLDGHERRISPSSNGHGPPVDRTEPNLISARP

SEQ ID NO: 109712 - protein, 207 aa, Triticum aestivum
  Clone ID: PAT_TA_4130.pep
MARPQQEAIDTFISITGADEAVAIRKLEEHAGDLNQAVNAHFTEGDSTVNAINQSIPPVNHDDMELDGPLDNTFQRPLFPEALHDPFALMDPNFQQMFFDSVGSAGTPNRDAQGPHPRETSNEVNDNNIQIGPSGQASVVENVTGRGSSYGPEVRDTIIIDDDDEELSSGLSSQHASIRSNVPQPNPLPTAPPLVHVTDNDIEEEMI

SEQ ID NO: 109713 - protein, 168 aa, Triticum aestivum
  Clone ID: PAT_TA_4131.pep
MGERLAGAEKEVLVEIVRFTQKNGLKGAEGGWKDFLARNDKKFGASVSDPKKRTKDVLLAFLVTFSKDLQKYFRKLVRRHAERRAIEQYMNEFSGMISPEQKLVQLTTEHLDYRKNYYFPSYQEGWKVMRIGKVSSSMNSGVMLAIDCEMVLCHDGTEAVVRVCVVDN

SEQ ID NO: 109714 - protein, 111 aa, Triticum aestivum
  Clone ID: PAT_TA_4132.pep
MHLKVEQAADPKTPAIHLKFEQAADYPTSSFKTRSTGIKKSIVQECLSFLNSANKEQLKSLKGIGEKRANYIIELRENSPELFKGIDDLRDVIGMNKTEIKKMMAGIINSP

SEQ ID NO: 109715 - protein, 316 aa, Triticum aestivum
  Clone ID: PAT_TA_4133.pep
SHCYILQDGASFFTWLGSLSSPSDHVLLDRMMDKLCPLKQSLLVREGSEPDRFWTTLGGRSEYSKEKCVKGWPTDPHLYTCTFQQCLFKAKEVFSFSQDDLATEETLILDCGEEIFVWVGLHSGVTSKEHALDFGKMFLQAGIARDGPRSINDATVYAVAEGDEPAFFTSFFNWDSSKQAAAMLGNSFERKLAMLKGLSPKLESPDRSLRKSSSRRQGMSSEPTTPEQQQQQQPAARRTFGSASAGRTARERLPPSSSAASPSPATPSWSLKSRGSSSPSMPATARRLFPSSLHAPGTAAAHLPSPTAIGSPGRRR

SEQ ID NO: 109716 - protein, 378 aa, Triticum aestivum
  unsure (1)..(378): unsure at all Xaa locations
  Clone ID: PAT_TA_4134.pep
GGPSSSQAARYALARRAVLLGVSALPLLRDTAAKAAAPSSAGLVTETKDVPKVDEPQAGGTMVGEPQTGGTQSETPLLEAPQPESSLPVVQTQSSGNPLAGLLNAIAVIASGVLAGLYGTSQQEKKALQSVVSSLEVKLAESEAAISLMRETYEKRLLEQQAAQKKQSMKFQEQEASLLDQLASTKKTVTSLSEEFRREKARAEELKDEIRRLESSIVKAGDDKDVLEAKLTEKVGEMNDLQEKLSLLSQQYDSKEKRIEELNSSLSSKEAEYQNLRRFSHQTKESLELANAKIQQLXEEEIHTTKNDLASKISSVDSLSEKLQVLSSAKKEAEEKINELIKECTDLKASSEIRANHDSELLSEKDDLIKQMEEKLSV

SEQ ID NO: 109717 - protein, 123 aa, Triticum aestivum
  Clone ID: PAT_TA_4135.pep
SIAPLQHMGSQKLANILHANELARRFKQEGVNITANSLHPGAIITNLLRHHSIIDVLHRTLGRLVLKNAKQGAATQCYVALHPDAKGVSGKYWSDSNLYEPSEKAKDAELGKKLWDYTLDLVA

SEQ ID NO: 109718 - protein, 319 aa, Triticum aestivum
  unsure (1)..(319): unsure at all Xaa locations
  Clone ID: PAT_TA_4136.pep
MLPWIFSRKGASGFSWASTADQVTAGISAAGLTAIVTGASSGIGAETARVLAARGAHVVMAVRNLAAAEAVRQAVLAETPXASMEVMELXDLSSLASVRKFCXDFAATGLPLKILSNNAAXVVDPFLPLKRVALEKQFATNHVGHILLTNLLXETMKKTSRESNVEGRIVNVSSDGHRFAYKEGIRFAKLNDEEEYSTIAAYGQSKLANILHANELARRFKEEGVNITANSLHPGAIITNLLRHHXSIIDALHRTLGKLVLKNAKQGAATQCYVALHPDAKGVSGKYWCDSNLYEPSDKAKDAELGKKLWDYTLDLVAA

SEQ ID NO: 109719 - protein, 193 aa, Triticum aestivum
  Clone ID: PAT_TA_4137.pep
SLRPLDITHSNGLLSGLHCRAPACPPGSHLPLLSPLPSRRSKVRDGADVPALRGGVRGGGAEGAGGAVGGVGGGGVVGGVVRGGPPPARPPGVPPPRHCPRPGAHGVGPPPPAPPPVRGPLPPPRPPRARPPAAGSPLPPGGSSGGRPTDGGENGCARDAPEGRTHRTFLASRLVTSVRSSCMHGSFFLLFFF

SEQ ID NO: 109720 - protein, 134 aa, Triticum aestivum
  Clone ID: PAT_TA_4138.pep
NTPTPFDPNTPPFSTGPYGYWMSHPGVIWGLFGYWCPLVRLFGPSAAVPFGYDLTVPEALANTRADGVGALYREGTASLLNSMVSSGFPFTTAQVKDAFGAALSSGDDRAAAAQAQLFKMANEGLAKHYAWVRD

SEQ ID NO: 109721 - protein, 152 aa, Triticum aestivum
  Clone ID: PAT_TA_4139.pep
RRRQDVLCFFLRFALHFAQRDHNFHVVSIDVLPKQRSTCQVGFLQYVFSHTVVQILRSFDVLANEALRQGLMEYSSWPAFLEYYIDGVSHNTDSNMGSAFLSGAAIVFRWPALTSCQSSAQRFRPATPSVAAPTWWCRLCGRSVCPSQRSMR

SEQ ID NO: 109722 - protein, 292 aa, Triticum aestivum
  Clone ID: PAT_TA_4140.pep
MSVATAHHLRPSPPAARDRLPGCAARASSFRPLRRRGLAAGATAGGEATAAVSAVTASAKRDPVRRHTISVFVGDESGMINRIAGVFARRGYNIESLAVGLNKDKALFTIVVSGTDRVLKQVIEQLNKLVNVLNVEDLSKEPQVERELMLIKLNVEPDQRADVMFVANVFRAKVVDISENSLTLEVTGDPGKIVAAQRNLRKFGIEEICRTGKIALRREKIGAAARFWGFSAASYPDLVEASRKNPLTSVNKTVNGSFDQSSSAGGDVYPVEPYESLSMNQVPDAHWGVLDD

SEQ ID NO: 109723 - protein, 164 aa, Triticum aestivum
  Clone ID: PAT_TA_4141.pep
CYPSRPESPIFASFCLRVPAGRTAALVGSSGSGKSTVVALLERFYDPSGGEVALDGVDIRRLRLKWLRTQMGLVSQEPALFATSIMENILFGKEDATPEEVTAAAKAANAHNFISQLPQGYDTQVGERGVQMSGGQKQRIAIARAILKSPKILLLDEATSALDT

SEQ ID NO: 109724 - protein, 176 aa, Triticum aestivum
  Clone ID: PAT_TA_4142.pep
RGPSLCKIPQNTWTAIGGLRRRPRPHRRHRSSATTTCSARSCSASASPPASSAQPSSASGGSSTPPTRPSSAASASATRPASSASASAALTGILSCRCHSPRSSPSPYAGRPPPAPPPSPSKSIESSTAGTAASSPTTSTAAHIIMPSWRRCCTGNPQPPSRRSRYTPVTGPGALK

SEQ ID NO: 109725 - protein, 184 aa, Triticum aestivum
  unsure (1)..(184): unsure at all Xaa locations
  Clone ID: PAT_TA_4143.pep
MAWQVTHLGCGGMVLCTAINHCLCDGIGTAQFLHAWARAARSDIAGGGDHPVVHDRRALRPRCPPRVEFTHPEYXKDAVAHDEPTLLEHLLGQPLSPVSLTFTXAHLGAPQRSSCCCRRRRSKRCTSFEGAGGHGLACCAARAGPAGRPPPPAPLPRGRPPGPAARAPPASRLPRHLKAGAPPW

SEQ ID NO: 109726 - protein, 224 aa, Triticum aestivum
  Clone ID: PAT_TA_4144.pep
MDPAAPPRPARPAVRRMDAVKQALMLFLHSKLTMCPDHRFAFASLRDTVSLISKEFTSDAASSIETIRSLAATDTRYAVADLTHLFKIAYEEGKRAETQGRLLRVVLIYCRSSTKPHHQWPVKPKNFTMDIVYLHDKPTADNCPQNVYDSLVDALEHVSQYEGYILESGQGLARVLFRQICIILSHPLLRCMQDDLDIPKQVVKKILAIEGVQSEDGAPASSSQ

SEQ ID NO: 109727 - protein, 80 aa, Triticum aestivum
  Clone ID: PAT_TA_4145.pep
SYNQTATFDIEEELWFHEKCLLSLLREPFLSPAPESSRVPLLSMVNESVATYCFAMFLQSAALFLHLVGFHKTTPYDSIE

SEQ ID NO: 109728 - protein, 242 aa, Triticum aestivum
  unsure (1)..(242): unsure at all Xaa locations
  Clone ID: PAT_TA_4146.pep
MRSGKNQMDCSAIAPEIFPEIEKWKPSWRSFDYDELCAATDRFSSDNLIGKGGHAEVYKGQLADGQFVAVKRLTKGGNKEDRISDFLSELGIIAHVNHPNAAQLLGFSVEGGLHLVLQFSPHGSLASLLHGAKGGLRWKARFNIALGIAEGLFYLHEGCHRHIIHRDIKASNILLTEDYQPQISDFGLAKWLPDKCTHQVVFPIEGTFGYMAPEYFMHGIINEKTXDVFAYGVLLLELVTGR

SEQ ID NO: 109729 - protein, 167 aa, Triticum aestivum
  unsure (1)..(167): unsure at all Xaa locations
  Clone ID: PAT_TA_4147.pep
MALETRKLYVGGLPPSAQQEELQEHFSRYGEVLRVRVVRDWETGQCRGFAFVEFADDEGPRAALQEKEKANHVFGDRTVDVKRARTRPMRYQNEQSFYQYALNQSPIQSPIQSPVHNQWYTQSSSNNSYAGNGHRTCDPNKVFVGGLRGNVTKEHLQSYFEKFGXQM

SEQ ID NO: 109730 - protein, 210 aa, Triticum aestivum
  Clone ID: PAT_TA_4148.pep
MDLDMDDYMDPYEEAEAEAAAEAAGVTGPVAASADEESDGEDDSEAESDYEEKSYGLLKSGKHRVRNPDGTFRCPFCPGKKKQDYKLKDLLQHADGIGISSKHRRHGRERAFHRAFARFVRADPSFAQELSTIVGIPGATPSATANADASDKGKAVANGHTSGSSPVAVAEGPPQDGEEKFAWPWCGILAAGAGFNAESFADRVAMFSPE

SEQ ID NO: 109731 - protein, 172 aa, Triticum aestivum
  unsure (1)..(172): unsure at all Xaa locations
  Clone ID: PAT_TA_4149.pep
PPARPPPSPWPLLAAAAPPSLARPRRRSSGPPPPAPRPSPGRPRRLPAGPAPPPPGVAPSRRRELPARTHTQPRXSPRGLPAPPPAGPPPAPLLPPPGAPAPPPHPFAASSLVPAAGPRSGPWLVLARGSPGLQASVRRTGVPPGSPCRRSFCRSYYFQVRPIQVFIHSGLF

SEQ ID NO: 109732 - protein, 316 aa, Triticum aestivum
  unsure (1)..(316): unsure at all Xaa locations
  Clone ID: PAT_TA_4150.pep
MERAGLLAPSPPRARATARVCMVSSFATELLEIRSREPSPSLHVLVVPGNPGIVGFYRDFVQALYENLGGQASVTAXGTFHMGRRITSTDDCFHYTNRLSTRLIFLSKNFYIPNSPXIVVGHSIGAYIGLEICKRFQKKVIFFVGLYPFLTLNKNAMKQSAIGYVARSSLLSKGVSLLASFIGSLQASVTRSIVXRFLGSSWSATAIDAGCSHLLQYHTMRNVLFMAKTEFQKLHEEPDWNFIRAKQAQIAFLFGVDDHWGPLTHLEEISRHAPGVALSVEKEGHTHGYCCTEAGSFWVADYVANLIKNQMLVGDS

SEQ ID NO: 109733 - protein, 139 aa, Triticum aestivum
  unsure (1)..(139): unsure at all Xaa locations
  Clone ID: PAT_TA_4151.pep
MANSASGLAVHDDCKXEFSDLKARRSFRFXVFKIDEKSXEIKVERLGETGYGYEEFTNSLPADECRYAVYDLDFVTDENCQKSKIFFFSWSPDTARTRSKMLYASSKDRFRREMDGIQCEIQATDPSEMSLDIIKSRAH

SEQ ID NO: 109734 - protein, 293 aa, Triticum aestivum
  Clone ID: PAT_TA_4152.pep
MAAAAAATLAPASPPLLPAVCGRLRLAPRRAAACRCRATAQFQGGPAASYAREMERLSAKESLLLAFRDSGGFESFVSGKTTEMQKIDVNERIVGLERLNPTPRPTTSPYLEGRWNIEWFGDSSPGTFASKLLFERSPTSVAHFTGLDVVIRDGYCKISSNVKLLNTIQNRFVLTTQLSVEGPIRMKEEYVEAFLETPKISEETLPEQLKGLLGQTAGALQQLPASIRDAVSEGVKLPLNGMYQRLFMISYLDEEILIIRDAAGAPDVLTKLEGPQPNPMENTPDVVIPEYQS

SEQ ID NO: 109735 - protein, 184 aa, Triticum aestivum
  Clone ID: PAT_TA_4153.pep
MADGVLSPAVHPNGHSPEFVFRHYRGRRAGIVKALTEDVEEFYQQCDPDEKALCLVGLPDGTWEVSQLPEEVPVQLPEPVCGINFARDVTPKKVWLSMIAIHSDAWLMSIAFYHAGRVSFDRVGREQLFRLINRLPTVYEAVTGSYERQAQTPNGSRKNKSSSQPPNQFTSNCKPVTPALPMPK

SEQ ID NO: 109736 - protein, 154 aa, Triticum aestivum
  Clone ID: PAT_TA_4154.pep
MATLKDVATRKPILATIRLLVPAGAARPAPPVGPALGFYRLNLMAFCKDFNARTQKYKAETPMQVTLTAYKDSTFEFVVKSPSVSWFLKKAAGVETASSRPGHNMVTSLSLRHVYEIAKLKQSDPFCKHMSLEALCKSIIGTAKSMGIEIVKDL

SEQ ID NO: 109737 - protein, 167 aa, Triticum aestivum
  Clone ID: PAT_TA_4155.pep
QLGAGTPAPRRHAAAVSAFLFLLLVGHCHGGKTGICYGRNADDLPGPDKVAQLIRQQSIKYVRIYDTNADVIKAFANTSVELMVGVPNADLLAFSQYQSNVDTWLKNSILPYYPATAITHITVGAEITESPINVSALVVPAMRNVHAALKKVGMHKKITISSTHSLG

SEQ ID NO: 109738 - protein, 65 aa, Triticum aestivum
  Clone ID: PAT_TA_4156.pep
YVYSYVITALSFLRHIITSSNRDNNISPLGLKQDNDHTKFAKALLDAWKLRSPPTARHASTMMCT

SEQ ID NO: 109739 - protein, 346 aa, Triticum aestivum
  unsure (1)..(346): unsure at all Xaa locations
  Clone ID: PAT_TA_4157.pep
GARDSSCTPAPAAQPWAEEAAAAASASATNFEVDLGHLVAYDPSPHLAAGAASARAGLRDERLQKDTELAQANANAPLPVTATEVRDVARLRPPTPSIPRAEQXPRPKPPHHSGRXFAKWKGIIKHKKKKRAWDEQTNSCKRTYGYDRVNDDRDVPIIEAKLTDEPGVDPFAQRREEKKGRVDKQEKNRLGNLKNAAKVGALPSHIQLAATSVPITGTKADLPRKAKKEDLENVAGMASAATASGGKFDKKLPGEKPLKKAGKNRKFLPVVQGKGMGNLEKQQNDKILNSLLAKNFEEPLDVSKAITMYKVKKDNKRRKDKQSSSSGSNKLKPQKKIHKKSSKKSA

SEQ ID NO: 109740 - protein, 381 aa, Triticum aestivum
  unsure (1)..(381): unsure at all Xaa locations
  Clone ID: PAT_TA_4158.pep
DADRXPSFRNKXKMYYTRQRTQRSTFKRRKMLDRHSTLVSEEFAKSNAKRTTKVNAREPHAASLEANKGSNSMPFHGSCKSNDCHVKLKIKSFKVPELLIEIPETASVGSLKKTVLEAVNAMLGGGLRVGVLHHGKKIRDDSKTLMQAGIGHDDILDNIGFSLEPNCTRHSSQLAAPEDIEFLETVETTEPLARIAPADSSSKHGEVDASQELALTPLTANYQGNDHDSVHSPGGISSPEKASANSRAIVPVTPVDSSAGAIVPANKAKRSAEQGQRRIRRPFSVAEVEALVLAVEKLGTGRWRDVKLRAFDNAKHRTYVDLKDKWKTLVHTASISPQQRRGEPVPQDLLDRVLAAQSYWSQQQAKLQPKTPPLAEARLLT

SEQ ID NO: 109741 - protein, 262 aa, Triticum aestivum
  unsure (1)..(262): unsure at all Xaa locations
  Clone ID: PAT_TA_4159.pep
MSIPPSDRQTSPTQPRQTSHADAWRSGLGPWGSYMLRKNASYNGTSKCTCCAGEMXCICEFGESECXEFMLGIEVFLCFGNSVASTRFLLQDEFNIQTTKCDNCIIGFMFCLQQVACIFSIVAAIVGSEELSEASQILSCLSDMVYCSVCACMQTQHKVEMDKRDGKFGPQPMQVPPMQQMSRIDQPVPPPAGYAPQPAYGQPYGAYPPPPAQGYPPPPAQGYPPAGYPPAGYPQAQGSSYPPPGSYPPPGSYPPQQGYYGK

SEQ ID NO: 109742 - protein, 123 aa, Triticum aestivum
  unsure (1)..(123): unsure at all Xaa locations
  Clone ID: PAT_TA_4160.pep
SNPLPISPPFSSTPTKNSLYRYPXAKGRRADSSSPSPFFRPLFGRFHTGKEKQEFPRIARRLGPKGARIPREAIDGEKKDQRMAYLGVGERDQERKQRPSARFRKQRRGLLKTAQKEAGGTSL

SEQ ID NO: 109743 - protein, 547 aa, Triticum aestivum
  unsure (1)..(547): unsure at all Xaa locations
  Clone ID: PAT_TA_4161.pep
EQQCLAWKRLLTFEKGNPQRIDVTAANRRITFTYEQCLMYLYHHPDVWYDYATWHAKNGSTDSAIKIFQRAVKALPGSEVLKYAFAELEESVGAIQPAKTIYESLVAENSSMSSLAHIQFIRFPRENRRALKQLASNFLEVXKLPSCTYHGYGAYATMSFAPDKDAKYLLNILLXVAQNVFEVGLKRFMQEPGYVLEYADFLCRLNDDRNVRALFERALSLLPPEESVEVWKRFAQFEQIYGDLSSMLKVEQRRKEALSRTSEDVVSSLENTLYDVVSRYNYMDLWPCSSKELDYLSRQEWLAKNMSKKADRSVMLTSGGGSTLDKGTVGVGANAKLLPQSTKVVRPETSRMVIYDPRQMKGPVISATSSGYTKEVDEIFKMLSPPLXSFITNLPAIEGPSPDIDIVLSVLLQSTLPTGHDVGKPSAPVPGRATTDISGPRNQNGSVRRPPKRKAVERQEEEDAAAAAQSRALPPISARGQIQRSRGGGPAQSGSAAMSKWKHVFRGTVSQQLKLVHQSVASSLDSRSSFGSYVVWPLMGKVMHVQM

SEQ ID NO: 109744 - protein, 79 aa, Triticum aestivum
  Clone ID: PAT_TA_4162.pep
SSLQLIITATRALDSILSRALRSSISVHGAVHHHCRRAAGLWLEERPEGRGGAGGGRGGGGGAAAASPERRAGAGGGAA

SEQ ID NO: 109745 - protein, 149 aa, Triticum aestivum
  Clone ID: PAT_TA_4163.pep
VVGRLGLPLGGLVFGMYMVAPRRGLLLGAGGLRGSLLVFLTFRLRCPGLTCSRCWACGPVLSVSTGPEVLAVLAWFSLAFSSLDSASLAPCGVPHVSRFFRFRRFLWSGYIYRCLFVFLPGCFVILTFASMLQVLAFMARIFLAYSNLY

SEQ ID NO: 109746 - protein, 167 aa, Triticum aestivum
  Clone ID: PAT_TA_4164.pep
MIASSATPTGRATTPTPGAQSRWPRAVAQLHLALRSPAARSGSSGRWMGCFRPAPVPAPSSPAVTVAVNEGRGKRPEATEVDMEPARGGGEDLWSVQAEAEVAQGGEYPEHLVVMVNGLVGSADDWKFAAEQFVRRMPDKVIIHRSQCNSATQTFDGVDLMGERLAN

SEQ ID NO: 109747 - protein, 265 aa, Triticum aestivum
  Clone ID: PAT_TA_4165.pep
YFQELVSCSFLQQGGEWPDWFTIPDLLHDLLDKISGTECFRIENARSQRGEGWKGDVPQDVCHLLVENYDGELITEKILGLENLHTLIIYVVERGTSVEENVMDSICKRLHKLRVLAVAFSREHLPITQPKKFPFPESIGQLKDLCYLAFRTFECTVILPSTLTKKLHQIQLLDFGNHSHGQIWEFTLDNLINLRHIICEKLECPNIGRLISLQTLPSSRFTIRNEKGYEIKQLRDLNKLRSSLDIYSLENVKSKVKAVEANLTA

SEQ ID NO: 109748 - protein, 451 aa, Triticum aestivum
  unsure (1)..(451): unsure at all Xaa locations
  Clone ID: PAT_TA_4166.pep
MGHGVSCARTGDEHDFFRAAQLGDLDALGALLAADASLARRATLYDRLSPLHIAAANGRLEALSMFLDRGAQRDAVDRHKQTPXLMLAAMHGKIGCVVKLLQAGANILMSDSVQARTCLPHAAYYDHIDWPDATLPAAGTTRGDCPWGFALFVNCGDDHCTTPLHPPARHGRPRCRLLVLENGAIVSALKGSYGFPGSTSLHLAARSGDLDCIRKLLAWGADRLQRDSAGRIPYVVAHKRNHGACAALLNPSSAEPMVWPSPLKFISELDPEAKALLEAALMEANREREKKILKDAKCSPQSPLQYDDDHIDDDMFSEVSDTELCCICFDQACTIEVQDCGHQMCAPCTLALCCHNKPNPATLTLPSPACPFCRGSISRLVVAQTQTADNGDPDRPASPQLAHRRSRRSHNLSEGSSSFKGLSSAISKIARGSSRMAESDGAAMDKPEHDL

SEQ ID NO: 109749 - protein, 330 aa, Triticum aestivum
  unsure (1)..(330): unsure at all Xaa locations
  Clone ID: PAT_TA_4167.pep
GGDGILRSHRQSSPIQLERWLSASLPPISASSDCLTGGRSTAPAQHLPPPSQVRRRAAARGRRRWSGRWPVREPPRGCVAARPAALCASGGAPMGQWSCSPSCPRTSPKRSSPARGGAAPRLALHQEAPAPAASCAGVRDRRRRESGCAGSAGGAGPASSGSSWSCGGGGCRTIHGPQPCTGHGRGGGGXQVPAQRRRPLRRPRAPVPRPHTGLERPVRQESRPGVAPPPXHAGSGGALEGPAPSRPRAPCPRRGPRRRKPFRWPLNRRRSRAWRLWRRSPPTPWRRRRPCRRLPPLRTRCRKKDRRPQGILSPFPFFLSGSLFRLLSPA

SEQ ID NO: 109750 - protein, 177 aa, Triticum aestivum
  unsure (1)..(177): unsure at all Xaa locations
  Clone ID: PAT_TA_4168.pep
TQWLLRDNPRFPYWQRPLGAAPHGTVACQGRIRIPSTKECNQDAERTLEVSVDSPDDKSQHVISTLPAERFYRRLATSSLAREFNDRSPRFGVVAPATAAAISPAQALPSGSLAPCRVTTEISRFLTAFLRAIPTGNEQENEEQGRWPRAEFGTRRSHXEQHRQPRXGSEEXTERXX

SEQ ID NO: 109751 - protein, 118 aa, Triticum aestivum
  Clone ID: PAT_TA_4169.pep
IDPLIMHGFLVHILLSSMSLSALNLLTLDSIGFSLLSESRNHLRILEVRQKSLVKGSGCTLSGLTFACSTSPCFSFSTGLGRSTGNESLPEQRPNSRRLLKLTILELPPAASAGRRRQ

SEQ ID NO: 109752 - protein, 472 aa, Triticum aestivum
  Clone ID: PAT_TA_4170.pep
MAFFRGLAAVSRLRSRMGQDATTLGGVRWLQMQSASDLDLRSQLQEMIPEQQDRLKKLKSEHGKVQLGNITVDMVLGGMRGMTGMLWETSLLDPEEGIRFRGLSIPECQKVLPAAVKDGEPLPEGLLWLLLTGKVPTKEQVDALSKELLSRSIVPGYVYKAIDALPVTAHPMTQFTTGVMALQVDSEFQKAYNKGMPKTKFWEPTYEDCLNLIARIPQVASYVYRRIFKDGKAIAADNTLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGVLRNTDPRYSCQREFALKYLPEDPLFQLVSKLYEVVPPILTELGKVKNPWPNVDAHSGVLLNHFGLTEARYYTVLFGVSRSIGIGSQLIWDRALGLPLERPKSVTMEWLENHCKKAAA

SEQ ID NO: 109753 - protein, 174 aa, Triticum aestivum
  unsure (1)..(174): unsure at all Xaa locations
  Clone ID: PAT_TA_4171.pep
MASSRSLSSRSGAMLAGALLLLLSTASAVAQLGVGFYSKTCPHVEEIVRQEMLGILKEAPTLAXGPFLRLHFHDCFVRGCDASVXLIDSTDAASNPAEKDAPPNKSLRGFGAVHRVKDRLQSACPNTVXCADVLPLWAXDALFSPAGPNWPSAPARGPASPLTEKPFPTNSLTA

SEQ ID NO: 109754 - protein, 257 aa, Triticum aestivum
  unsure (1)..(257): unsure at all Xaa locations
  Clone ID: PAT_TA_4172.pep
MDCGGEEQARQNGHAGDGGDPAEWKMVAELRAVVEAQDPAAKEEDDFMLRRFLRARDHNVGKASAMFLKYLAWKRAAKPCGSITEAEVRGELVQDKLYVQGFDKTGXRPMIYLFGNRHFAAKRRPRGGSSDSAATPAPAPAQRYVVYILDNTCTKLPAGRGTRAATSGQSWRRWASCGTPARRAALEIMQNXVPYVFMAAWKMVYPFIDDNTKKKFVFVADKDLDATLRDAIGXSQLPEQYGGKLRLEGYKSSSTCN

SEQ ID NO: 109755 - protein, 185 aa, Triticum aestivum
  Clone ID: PAT_TA_4173.pep
MTPSASVGKEVNLKEVNFNLKEDKNIPCAIQFVTTMLGTSSTLTIGDRNKKFRVSRSSTWITVVFTQSMFIATTAGWIYDMYNKPIWNAGFPWWLPVAVLLGAYLAVVDLARGYLTLFVPQAPLAAWNALDEVGFKVIGFSVILISVPVFLFDQAWLHITFACLLSVLIATILAFCVCLVRTYRQ

SEQ ID NO: 109756 - protein, 109 aa, Triticum aestivum
  Clone ID: PAT_TA_4174.pep
FRRVQAAGHRVCAGTRATSRSMKTSSPRGKETMSCVSNNRGGFGRLIPVPASMLLARRTQTVIFPTFLRKLTLLLIMSSLMMKLCFLKISLEDRVQAMKFNSEGGSFTI

SEQ ID NO: 109757 - protein, 127 aa, Triticum aestivum
  unsure (1)..(127): unsure at all Xaa locations
  Clone ID: PAT_TA_4175.pep
QAFVGVAHNLNAIIVAIRGTQENRFACSXVQNWIKDLVWKQLDLSYPDMPNAKVHSGFFSSYNNTILRLAITSAVHNARKTYGDIGVIVTGHSMGGAMAAFCALDLAIKLGSDNVQLMTFGQPRVGN

SEQ ID NO: 109758 - protein, 201 aa, Triticum aestivum
  unsure (1)..(201): unsure at all Xaa locations
  Clone ID: PAT_TA_4176.pep
PAITRDVHNARKTXGDIGVMDTGHSMGGAMAAFCALDLAIKLGSDNVQLMTFGQPRVGNAVFASYFAKYVPNTIRLVHGHDIVPHLPPYFSFLSKLTYHHFPREVWIDESDDNTTEQICDASGEDPNCCRCLSILSLSIQDHFTYLGVDMESDDWSTCRIITVQSVERLRKDLVSNIIMTKHGVEVSIVENSMQTDWSSSR

SEQ ID NO: 109759 - protein, 98 aa, Triticum aestivum
  unsure (1)..(98): unsure at all Xaa locations
  Clone ID: PAT_TA_4177.pep
FFFFFFTALKTLQLLIIVPICMSKCFATCTKGTTHXKSKVLLGILSPAYGGILSTFHHHLIRMQLVVRSCIFADLSWNTRATIKRRQDTYHLNALAKI

SEQ ID NO: 109760 - protein, 81 aa, Triticum aestivum
  Clone ID: PAT_TA_4178.pep
LTCQEADTTIDKKSVAIPAAQDMSVSDSKSILLMTHNVTRQEESKAAAENTACPFFFSFLTAAWRYLKILTQLPAACAFNR

SEQ ID NO: 109761 - protein, 226 aa, Triticum aestivum
  unsure (1)..(226): unsure at all Xaa locations
  Clone ID: PAT_TA_4179.pep
MPATDYQGSSSSSHSPFASFGRSLLSRIRDTXRPPAMLPTGGEAEVEASQRHADVXASPALRDGQPRRADGWIRQLLQAFLLSQEEFRAAAAEVRXAAVEARLPERLVGEYHERAVRALQRANGERDXLDQVRRWGRRPGTALCALLAHREIHAXAPAESHERQLRRARKALSDLSILLVDDAAAPGGRGAASPPSSPPTATAPSAAGAARPRLARPPPPPPRPPP

SEQ ID NO: 109762 - protein, 314 aa, Triticum aestivum
  unsure (1)..(314): unsure at all Xaa locations
  Clone ID: PAT_TA_4180.pep
LLRTTNIHLFSYKEIRRATNNFHRSNKLGRGGFGTVYKGTFGDGTAFAAKVLSCESEQGIKEFLTEIESIGEAKHANLVSLLGCCVQKQNRILVYEFAENNSRHQALSALGSASGAAILPWSVRSDICMGTAKGLSYLHEEHEPNMVHRDIKASNVLLXQKLHYYSPKIGDFGLAKLFPDNVTHVTTCVVGTXGYLAPEYVVHGQLTKKADVYSFGVLVLEVISGRRVSETIRSDTFLVRQAWLLYEEGRPLDIVDASVRDYPEAEVLRYVKGGLACTQAAPDGRPTMRQVVKMLSRPAAFRELEMHLTDHVLA

SEQ ID NO: 109763 - protein, 48 aa, Triticum aestivum
  Clone ID: PAT_TA_4181.pep
NKPELFVQAFQQPPKFDNDGNLIDAEIRERIKKVLLSLQAFTLRVQKD

SEQ ID NO: 109764 - protein, 197 aa, Triticum aestivum
  Clone ID: PAT_TA_4182.pep
MEVAAAKPILRVAAVCGSLRRASYNRGLLRAAAEVCEESIPGMRVEHVDISALPLLNTDLETPDGGFPPAVEAFRERIASADCFLFGSPEYNYSIATPLKNALDWASRGKNCWADKPAAIVSAGGGFGGGRSQYHLRQVGVFLDLHFINKPELFVQAFQQPPKFDSDGNLIDAEIRERIKQVLLSLQAFTLRVQKKD

SEQ ID NO: 109765 - protein, 309 aa, Triticum aestivum
  unsure (1)..(309): unsure at all Xaa locations
  Clone ID: PAT_TA_4183.pep
NSARGAAVEDAVARVSQLWDALTAEQKEHWVGLFFYTELLQTFYLLRVCDYKAASKHVERLDTAVKNEMERGHRIKELGTELSAVEGTLAQTMLKERERVALAHKQGQLRXXLQALCGYDTLKDVLDYGDKLLLAPPPMHGEWLPRTAVFVLVDLMVVMVSRPKGIFKECGKRIHSGLQLIHEELSKLGIVDGVTEGDLEHSTIWTAGLYLMLLLQFLENNVAVELTRSEFVEAQEALAQMKNWFTRFPTILQGCESTIEMLRGQYAHSVGCFDEAAFHFLEALKLTENKSMQSMCQVYAAVSYICKGD

SEQ ID NO: 109766 - protein, 119 aa, Triticum aestivum
  Clone ID: PAT_TA_4184.pep
HKRDHELEDFFQLVVAGEDCGEGRSKPCPDPYLRALDLLGASAERSLVFEDSVVGVQAGVAAGMPVVAVASESREAKVVAAGASMVVRDYRDAELWAALEAAAGAPKIDSEPSAVDAKL

SEQ ID NO: 109767 - protein, 254 aa, Triticum aestivum
  Clone ID: PAT_TA_4185.pep
METQLGGNGISRAAPLEALLFDIDGTMCVSDPFHHRAFSELLQNLGYNGGAPITPEFGMAHMAGRSNEQIGRFLFPDWPQARLDAFFAEKEALFARYAGEGLREVPGLAELCRWARERGLKRAAVTNAPRANAELMIGILGLADFFQLVVAGEDCGEGRSKPCPDPYLRALDLLGASAERSLVFEDSVVGVQAGVAAGMPVVAVASESREAKVVAAGASMVVRDYRDAELWAALDAAAGAPKIDSEVNAVDAKL

SEQ ID NO: 109768 - protein, 346 aa, Triticum aestivum
  unsure (1)..(346): unsure at all Xaa locations
  Clone ID: PAT_TA_4186.pep
TLEKPVSFLAAHMDRIGSDIFEEIGVPNSKVSIVSMHSLASKYSTRVVFGVLPYPKDASISLPALSVLRSSLIGMMLKQLNLSLTPSIFGYPSSIELLGFPGGITVVPAQSGSIWASTDPLFNFVLNNSIGQILGNLTELKNQLEFGLNLRSYERIYLQFRNEIGSSVEAPATIEASVLDGTXYSVAXRLKQLAELIKEPDARNLGLNHSVFGKVKGVQLSSYLQHSISYLSPSPAPSPSPYPPPSPSPSTSVPPSSSPSGSVPYLAPPTSSPSPRASPPLPNHPPCFPCSDCNPFSSKLVGQIVKTTPFGGPSLASNLNSKQCWFPSPPFQQSLPPQFPNPLGRC

SEQ ID NO: 109769 - protein, 179 aa, Triticum aestivum
  Clone ID: PAT_TA_4187.pep
APAAPAPAAAAAAEGEQPECYFDVSIGGEMEGRIVMDLYASVVPRTAENFRALCTGERGVSAATGARLHYKGSSFHRIIKGFMVQGGDITAGDGTGGESIYGLNFEDENFVLKHERKGMLSMANSGPNTNGSQFFITTTRTPHLDRKHVVFGRVVKGMGVVRAMEHVCAGEADLPTDDI

SEQ ID NO: 109770 - protein, 255 aa, Triticum aestivum
  Clone ID: PAT_TA_4188.pep
LECLPPANRQSFGNGGAVPGPGQMANGGLPMNTLQQRGGLDGAGDLIGMGGSDPMSSSQVSLGNHLGSDNLQQQQQKMDMQDLQQQQQQHHHQLPMSYNQQQVPTQPLQLHATVKMENGGSTGGVKLEQQMGQLDQNGPAQMMRNAGNVKFEPHQLQSLRGLGAVKMEQPNSDPSAFLQQQQQQQQHHLLQLTKQNPQAAAAAQLNLLQQQRIMHMQQQQQQQILKNLPLQRNQLQQQQQQQQQQHQHQQQQLLR

SEQ ID NO: 109771 - protein, 150 aa, Triticum aestivum
  unsure (1)..(150): unsure at all Xaa locations
  Clone ID: PAT_TA_4189.pep
LSSRVSLIPADTMPPRPPGSLGRGRGRGLGSPVANPVPTSLGAGGRHLPRHRVLHFDVPIINGREIISVDSNGPLTAARSSSDDGPVIFVDVDMDGSFLTDHDIPGEPFESMDQLIHAASVTCSSPPAVICLDIRRTASQDACSXLSISL

SEQ ID NO: 109772 - protein, 453 aa, Triticum aestivum
  unsure (1)..(453): unsure at all Xaa locations
  Clone ID: PAT_TA_4190.pep
HASLPLLAFLLPLALPPLPPAALVPPSRPQPPPLRAPPTPPRRSSPDEQANTATTDIDCRPARRQRLSVESSAFKTNRPTWRAGTASSPWWPTDELRTHSPYIAALTIPLAYLPNVHEPLFPPEXSSVFPPLPYLPEFHPVIFACGSTHLVSDSPITSCTESGALVTSISXVFPAALGCVTASFRNHVKHELXSVKTGEPLLEKRADELDREMSLMRSQEETGRHVRMLIHEXSTLDRHTILKTTLVARELGLHECAFXCPSRSGSSLELTHTMRSTTTGLSSVEINLPVVNQVLSTNRAIIVPHTSPFARIHPVQGRHVPPEVAAVRVPLLHLXSNFHPELLAKSYAIMVLMLPSDSVRKWLAHELELIEVVANQVAVALSQAEILEESMRARDLLTEQNVALDLALREAEMAIHARNVNRVGVELVGPEDTDNVATINSSASAAKVHNAEP

SEQ ID NO: 109773 - protein, 352 aa, Triticum aestivum
  Clone ID: PAT_TA_4191.pep
MTMVTPRAPEPPPQDQDEEMLVPQQEVEVFEGPQPMEESMPAVDNESLPDASTSRFTWKIESISKHSGRKTHSDIFVVGGYSWRVLVFPTGNNVNHLSMYLDVADAKSLPIGWSRSAQFSLAVINQLDSKHSVRKEVTHTFNSRESDWGFTSFMPLIDLYDPSKGYIVNDQCIIEAEVAVRKIVDYWNYDSKKETGYVGLKNQGATCYMNSLLQTLYHIPYFRKAVYHMPTVDTPSGSIPLALQSLFYRLQHGDNSISTKELTKSFGWDSYESFMQHDVQELNRVLCEKLEDKMKGTIVEGTIQKLFEGHHMNYIECIGVDYKSTRKESFYDLALDVKGCSDVYASFDKYVA

SEQ ID NO: 109774 - protein, 211 aa, Triticum aestivum
  Clone ID: PAT_TA_4192.pep
MATAMALLRLAALAGAVALLLPGAAEARILLSLDDFGAVGDGTADDTQALVDAWTAACASTNGHVVIHVPAGRSYQIWPVTLAGPCRDEIMIFVSGNIIAPDSPEDWERRDGGKWLHFFQVQDLTVSGGGVIDGRGQEWWAQACKGRHRNDKHCTAPEAPKALHFEECHGVRVQGVTLQNGQQQHLTFTRCSNARASFLRGGLAGEQPGTD

SEQ ID NO: 109775 - protein, 151 aa, Triticum aestivum
  unsure (1)..(151): unsure at all Xaa locations
  Clone ID: PAT_TA_4193.pep
ADAPPPAPPRSRPPAPRPRRADGGFAAGVGWPPRSLDRLLSGGARRGRAGQPPFRRPGVWVPHLASAAPRPPPRAGVPPHPPPPAPPPPHRHAPAAPAQGPGGPLARHRGPRPGERPPPSXPRPRPFASPTGRSIGCSSCRGRDGRSVQPP

SEQ ID NO: 109776 - protein, 125 aa, Triticum aestivum
  Clone ID: PAT_TA_4194.pep
AFAPSCPCIGRLTWMSPSWPLLHGFRVFPRLCVASPLTRGNRLLSPLPFASVPPARNCVPGAPLSCPFLCSCPEVRFIPFLCSGLLGKPDYLIQLLTCVKCKLVCSLPILLLLEMHSPAFHSSNG

SEQ ID NO: 109777 - protein, 105 aa, Triticum aestivum
  Clone ID: PAT_TA_4195.pep
FLGDPADAREGISWRTMRVMPHLMETAPLTHKRCNNTSVFERAFMVVADPFRCRGVQVRVYIPPFLSLFAHPFHSSSRTSFSKPRQATATDPRRVHGLLSGGACG

SEQ ID NO: 109778 - protein, 84 aa, Triticum aestivum
  Clone ID: PAT_TA_4196.pep
TGRPLACHVALRPQTVAQAQSIAKVTRNGIRVCILGADEGAGAVVPLFNLAAGRAGSDTSESISRGIGASAGGCAGLLMSCSRS

SEQ ID NO: 109779 - protein, 144 aa, Triticum aestivum
  Clone ID: PAT_TA_4197.pep
DVEMKPAEANDAAKNADVEMKVAEEVKAAPSEDAGKTEDSTPAPAEHKEDVKPAESDAAPALAAEDKKEDVKPAETDAPPAPTVEDKKEDVKPAEADAPPAPAVEDKEDAKPAEADAPPAPAVEDKEDAKPAEADAPPAPAVED

SEQ ID NO: 109780 - protein, 412 aa, Triticum aestivum
  unsure (1)..(412): unsure at all Xaa locations
  Clone ID: PAT_TA_4198.pep
MATGGDRAAEELVSVEMPAPEGWTKKFTPQSRGRSEIVFVSPTGEEIKNKRQLNSYLKANPGGPTSSEFDWSTGDTPRRSARISEKVKVFDSPQGEKIPERNRNSSGRKGKKEKKQELETARSEDAGKNVDSTPAPVEHKEELKPAESDGAPAPAAGVKKVDVKPRGTDAPPAPPVEDKKEDVKPAEADAPPAPAAEDEAXPNPPVATAPPPPPLKXAPPAPAEADAPPAPAVEDKEDAKPYEADAPPAPAVEDKDDAKPAEADAASAPAVEDKKEDVKPSEADAPPPVSSEEVKIEEAPLVSSEGAKTEEVAPPASKPTENSVVAPSEPAIAPAPACSIRKPNQTAAAVRQPTWVRPPMSRRPPSTMGSCRLAPLTVKCTCKQLPPPPRRRFLGSFNIRIVINQPLVCMLI

SEQ ID NO: 109781 - protein, 217 aa, Triticum aestivum
  Clone ID: PAT_TA_4199.pep
KPLPAIITENNNNNNAESTHRHFERNSHEKDLKEVKVVNGKDSEPSKTDKFRDGDKHTMPENIDKKGTYKEEKGSSRYAKHGLDRWDDAKRDRKDLPKDARERKRDSADRSDASEDGNDDRSRQITKSSASHSSRRSRSRSPSGRSRTRNESSSRVRGSVSSDEPSDNAKRRKSHSRKNSMSPSPPKSRSRYINIPPFSVIYVNSGKFLLVSSNMFT

SEQ ID NO: 109782 - protein, 182 aa, Triticum aestivum
  Clone ID: PAT_TA_4200.pep
LAAFWDKLTVGQAQAILSLEGVAIEETSALFILTSLSSARGKPGYASLPLPYARAGNELLDLIQTAASRLPISSNELFIMLDEASENTFLCTNAADAACVQKFLFDGEVEKVATELKNVVACTSYILEQKLVEAWSADKAAEALRCQKLLVEEEDAAQKRQAEIMERKRMKKLRQKEQRLKD

SEQ ID NO: 109783 - protein, 315 aa, Triticum aestivum
  Clone ID: PAT_TA_4201.pep
ADREIPQISAGNRAAKSIVEGRGIARRSISKAMAGNKKKKEEAAARKCMMRPCTAAKSTEGAVAGGHGPVTRPLCRRKAVAGSSGEQRPEGSSDLLESARREDKMLGKAKLSSFVPKQAGANATVAAAADAAQGSSKSRRLTKSSEIMTVLLKPEPPPPAADLLDRLADYDPPERIAEQKRQHEEDAAYFAKMDAEFEVFRQKVIDGLNNDGYYEVDEDYLEAREKANEEAMRHPMGLWADMDPRERRLRVATPEERLLLIGDAYIPYVPDEEDEALINLGDDDFSASDEEDDFPPSDEEAGDNAHKRPHLIVSN

SEQ ID NO: 109784 - protein, 73 aa, Triticum aestivum
  unsure (1)..(73): unsure at all Xaa locations
  Clone ID: PAT_TA_4202.pep
MKLHLLLKVLFGPVPVYFSALAILILLTNAQYFGLGGVGVPRATKLASSTPVVVXVKTADLPRXWXPRLLQTA

SEQ ID NO: 109785 - protein, 192 aa, Triticum aestivum
  Clone ID: PAT_TA_4203.pep
PSIILDVKTRLGVALPIQVKDIGFTGVFRLIFKPLVEQLPCFGAVCFSLRQKKKLDFKLKVIGGDISAIPGISAALEETIKNAIEDSITWPVRKVIPIVPGDYSDLELKPVGTLEVKLVQARDLTNKDLIGKSDPFATLYIRPLPDKTKRSKTINNDLNPIWNEHFEFIVEDADTPSVTVKIYDDDGIQESD

SEQ ID NO: 109786 - protein, 85 aa, Triticum aestivum
  Clone ID: PAT_TA_4204.pep
STLLSTSCIRLDRHSRFFASDSIARRGNPRSSTDADSRPYGTMCLAYYRGSCLGESRPHRTWRVVHLWRQLSYHGLQGSRRRSWV

SEQ ID NO: 109787 - protein, 119 aa, Triticum aestivum
  Clone ID: PAT_TA_4205.pep
GFGNSLSAHECSQRSNPHGIALDINKVVPDGTSLALTQKGLVLQSAELEKQCLKIENEALELAEQRLKWELSSKIKDKELERMRSDNEHMKIEIKRLELEVRRKELELELKLKGNGSHS

SEQ ID NO: 109788 - protein, 130 aa, Triticum aestivum
  Clone ID: PAT_TA_4206.pep
ARKYFQQLVAAVAFCHSRGVAHRDLKPENLLLDEEGRLKVTDFGLAALPEQLRHDGLLHTQCGTPAYVAPEVLRKRGYDGARADMWSCGVVLYVLLCGFLPFQHDNYVKMYQKIFKGEYQMPPWVSGEAR

SEQ ID NO: 109789 - protein, 137 aa, Triticum aestivum
  Clone ID: PAT_TA_4207.pep
GQASPGRPVRLRFNERSTATNVEIEVPVPYDATNPNIRTSMGSAAYAPERDAMVWKVKSFPGGKEYMCRAEFSLPSISAEEAVPEKKAPIRVKFEIPYFTVSGIQVRYLKIIEKSGYQALPWVRYITMAGEYELRLI

SEQ ID NO: 109790 - protein, 380 aa, Triticum aestivum
  unsure (1)..(380): unsure at all Xaa locations
  Clone ID: PAT_TA_4208.pep
SHLIKRYALYLYSPVVYDDAGVTYMFIQHNNIFLLTASRQNCNAASILLFLHRVVDVFKHYFEELEEESLRDNFVVVYELLDEMMDFGYPQYTEAKILSEFIKTDAYKMEVSQRPPMAVTNAVSWRSEGIRYKKNEVFLDVVESVNILVNSNGQIVRSDIIGALKMRTFLSGMPECKLGLNDRVLLEAQGRATKGKAIDLDDIKFHQCVRLTRFENDRTISFVPPDGAFDLMTYRLTTQVKPLIWVEAQVEKHSRSXRIEIMVKARSQFKERSTGTNVEIEVPVPXDATNPNIRTSMGSAAYAPERDAMVWKIKSFPGEKEYMCISELSLHNLSSXENQVLYIKVIXREEYQAPHWVRYSTRAGDFELRLKGTWLPLPWL

SEQ ID NO: 109791 - protein, 278 aa, Triticum aestivum
  Clone ID: PAT_TA_4209.pep
MDPLRLLLPRAQAQPLLPLPAGVPAPSVRPRLVPRRRARRHRNGAARMLPASAVASESPWTEQEPASGEKEERFDWLDQWYPFAPVEDLDPGAPHGKMVLGIRVVAWYDRGAGEWRVFDDACPHRLAPLSEGRIDDKGRLQCVYHGWCFDGRGACKFIPQAPALGPPVHNNSKACVASYPCVVQNKILWFYPRAEPEHRDVLQRKRPPFIKEIDDPSFVTSFLVRDMPYGYDVLAENLMDPSHVPYAHKGLLRGLPRLVDPGREEYDKGRRRADGGER

SEQ ID NO: 109792 - protein, 110 aa, Triticum aestivum
  unsure (1)..(110): unsure at all Xaa locations
  Clone ID: PAT_TA_4210.pep
XKVLAASFLLAPLSLRALNYLPLLATLLSRLERLSQLPKLKRLPPLEMLFSLHPCQPFDMRLKPQLLRIQRSSFLTPLRPRGQTTLARVLASQRNRSGSSFMEWSFHVVI

SEQ ID NO: 109793 - protein, 210 aa, Triticum aestivum
  unsure (1)..(210): unsure at all Xaa locations
  Clone ID: PAT_TA_4211.pep
AYINFGLAPSLGPYHQSPLPPIXPPSVLIVGAGFAGLAAARHLMSLGFKVAIVECFSSPSGRVGAETMRSSAADYPDIAGGADLGGSVLTGINGNPLGVIARQLGFPLHKVRDKCPLYLPDGRPVDPDMDGRVEAAFNQLLDKVCQLRHVISDSVPHCVDVSLGMALEAFRAAHGVAAEPEERMLLDWHLANLEYANAAPLADLSMAFWD

SEQ ID NO: 109794 - protein, 201 aa, Triticum aestivum
  Clone ID: PAT_TA_4212.pep
MAPLSWRHHTLLQALLSRGPLSERDFHALFTAISGGMNPATHQQLFTDTLMKINNELGYLQFDLRACINQYDGTVYYGVVNNISDEESKLGSKYSVPQIAFYKGLLEAIVHEAGNDGSITSIEALNVRIDNQVVIADGTQDTQSRLPSSITNFLFSQKEKTLIELIQDRWLAYTSEGKIGLGIRSFLDLRSWFRSNDIPSC

SEQ ID NO: 109795 - protein, 276 aa, Triticum aestivum
  unsure (1)..(276): unsure at all Xaa locations
  Clone ID: PAT_TA_4213.pep
MGSTDETGTPYGEYTYAELERELYWPSEKLRISVTGAGGFIGSHIARRLKSEGHYIIASDWKKNEHMTEDMFCHEFHLADLIFMDNCLKVTTNVDHVFNLAADMGGMGFIQSNHSVIMYNNTMISFNMLEAGRINGVKRFFYASSACIYPEFKQLETNVSLKEADAWPAEPQDAYGLEKLATEELCKHYTKDFDIECXIGRFHNIYXPFGTWKGXREKAPAVCPARGLRFTYFWIKEQIEKERTEGKDVALYGSSKVVSTQAPVQLGSLRAADGKE

SEQ ID NO: 109796 - protein, 293 aa, Triticum aestivum
  unsure (1)..(293): unsure at all Xaa locations
  Clone ID: PAT_TA_4214.pep
VFNLDGQIGGVGCMQHYHYVVILYNNCMNFNILQTARVIXALRVFDDSTAGFNHAFIEEDIISKHLVGGSRESRSAKIFMAPGKFIYRELIKPYTKEFSNEXRIGRFHNIYGTYGTWKGVRGEGARAPLWKTATNLSTDSDLRLWVRRSARLQFFTYVGECVVRLXRLSETSDFCEXPYTLESDETGEAWNEMAEIVLRFENKXLPIHHIPGPEGVRGRNSDNTLIKXEKLGWAPXTMRLKDGLRITYSWIXSSWEKEKSEGTDMSAYGTSKVCTTQAPVQLGLPTAPQIGKE

SEQ ID NO: 109797 - protein, 436 aa, Triticum aestivum
  unsure (1)..(436): unsure at all Xaa locations
  Clone ID: PAT_TA_4215.pep
VVYHSNEPLPAFKDVPVSEKQNLFVRKATLCCAVYDFADPTKNLKEKEMKRQTLMELVDYVTSANGKFSEIIMLEISKMVAINLFRSSNPTPRENKAIEGVDMEEEEPLMDPAWSHLQIVYEVFLRFVASQETDAKLAKRYIDHSFILKLLDLFDSEDPRERDYLKTILHRIYGKFMVHRPFIRKAINNIFYRFIFETEKHNGIAELLEILGSIINGFALPLKEEHKLFLLRALIPLHKPKCVAMYHQQLSYCITQFVEKDCKLADTVIRGLLKYWPITNSSKEVMFXLGELEXVLEATQLAEFQRCMVPLFRQIASSMNSSHFQVAERALFLWNNDHIENLIKQNYKVILPIIFPALERNARGHWNQAVRSLTLNVRKIFTDHDSAFFGECMQKFDDDELKQEESSSKREALWKRLEEMGGESNPSGIPNGKSSQ

SEQ ID NO: 109798 - protein, 251 aa, Triticum aestivum
  Clone ID: PAT_TA_4216.pep
MGEHLALLVDRLLTESTLEAAIVSRKQPAADDTPAAIVYCCDIAAAGGDPSKMVECRICQEEDWDTGMEAPCACRGSLKYAHRKCIQRWCNEKRATVRQAGWQLASPGLTPPQRLFPLGSVPWVLRGNWEVARHDLHDSQVITMVPSERDFMDEYDDYFPVRTRSSALCCRTVAIIFLALLVLRHTLPLMVGGDGEYSFALFLLLVLRTAGILFPILVMVRAMATFHRRRRQQVIPSLNDQPLLGLEPGQA

SEQ ID NO: 109799 - protein, 275 aa, Triticum aestivum
  Clone ID: PAT_TA_4217.pep
LSQASPSSLPRPAATRGGRRRSRAAVSEGGGEVPAALHLVGSFGTPGRRPWVRRRRRPRLAGGAAGVGWPSRSRGRRWLLAAWSAPAAAPDLDPGGLLRPHPSSPAADSAVSGSRASGRPVDVVREDLGGGKPPVDLNANSGSGPVFPLEGALDSLLPPPPSTSSRVKTLAACGQATAALRRRYLLEDATLGWLEGCGCASSYRLRLRLCGSCRMSLVVGVWSPSRSGCCGSPSGGAVGLLASGGAPLGRAEMRSPLRQCVRKDGGLSSIPGLQF

SEQ ID NO: 109800 - protein, 231 aa, Triticum aestivum
  unsure (1)..(231): unsure at all Xaa locations
  Clone ID: PAT_TA_4218.pep
GGRWGGRRPPAPRPRRCASCACPPASPGRRGARRRRLRSTRRRQGPRRRTRRCTGSAWTGRGRGRCGPPSPTPPRPRPCPPPAPGPPPAPAXKAPXRPGLRQPAPTAQSPPPPCPAPPPRRTPPVTTPTCSPTPSPPSSSTPGTSSCSPTGRTSSCRTASSPPIDSTASRAPPPTTPPVLNRLMGCFSAGGRPPPPPTYPAPTSPAPPPTASTTTPSATRRCLPSPTRGTG

SEQ ID NO: 109801 - protein, 126 aa, Triticum aestivum
  Clone ID: PAT_TA_4219.pep
FRNCADLSITTSVGGGLPPEFAGSDNPFLLYVRDLRAPNYVFPLVIISQVCVATPWYRSIPGMDSWCETNCLRYPPNCPPSVCHCPESCEGIGDLAGKEGADVYCQDKCIVYRSVSECPTHRCRCY

SEQ ID NO: 109802 - protein, 269 aa, Triticum aestivum
  unsure (1)..(269): unsure at all Xaa locations
  Clone ID: PAT_TA_4220.pep
PSSTSFSTAQPSTTATKTSRQTRGFCCFCSSTSSAGAGDEVSSSSMMTVSITGATGFVGRRLVHKLLSEDHKVCVLTRSTSKASSVFPASRYPGVTVADKEGDWERCIRDSTGVVNLAGMPISTRWSPXEIKREILQSRVNVTSKVVDHINSSDSSNGNGPSVFVSATAVGYYGTSETDSFDESSPSGNDYLAHVCREWEGRARQVKQEHVRAGAHSDSGSSSGKGRAGALAKMIPLFMMFAGGPLGTGRQWSTLLLLLLSSSSLLGSR

SEQ ID NO: 109803 - protein, 179 aa, Triticum aestivum
  unsure (1)..(179): unsure at all Xaa locations
  Clone ID: PAT_TA_4221.pep
MDDGDLDFSNPEAYLDTGADLPGGGCSMDSYFDEYLNDTEHLACTHTHTCNPPVDDSSHTHTCVHAHTKIVSASXDGGADNRAAVHGAGKKRTTGFRAAPSVDRGMDLAHAPLRGGVVVQLKALNFRRRPGPQLPAARGADAARRRGLLARGRGRTRGVPASFPYXRPVKNGDLVSGVD

SEQ ID NO: 109804 - protein, 337 aa, Triticum aestivum
  unsure (1)..(337): unsure at all Xaa locations
  Clone ID: PAT_TA_4222.pep
RGLTFCPWXIGKLQFLQTMNLRTCMVMPSSVGRLGHLMCLYVDITVRLPVEIGNLVSLEELNEVMVGGTDAIEKELGKLAELSVLGLWWEGDDESVCNSLVVSLANLWKLHKLTSFLCGDARFDDSWDRWVPPPHLHAFYFYHCTSTLPRCFNSSLFPVLSCLHVVVDRVRLEVDIQILGKFPALRSLWLGTTKDQCTLLSXRFIIGNDAFPFLRQCVFDNFQTGPSMFPRGSMPMLESLSFYARVSHIAAGDLDVDMQHLPSLQKVDACLWSEENCSPAVKKVADLLELASNAHPNRLTFRWGLLSLPKEWEEETASLSTGNDSSEGEAVRANPIN

SEQ ID NO: 109805 - protein, 132 aa, Triticum aestivum
  unsure (1)..(132): unsure at all Xaa locations
  Clone ID: PAT_TA_4223.pep
PPLPSSSPPSPSSSPPRPPSGRTSPRTSPSPGAXSCTSRSRARRPTTSSPGAASSSSRGTTRRRPTTPPPGAASSTSRRARSPSRRRGSPSRRASSSSRGTTRRRPTTPWPGAASSTSRRARSASRRRGSPS

SEQ ID NO: 109806 - protein, 152 aa, Triticum aestivum
  unsure (1)..(152): unsure at all Xaa locations
  Clone ID: PAT_TA_4224.pep
PSPTPLSPSSRRTRGSACPLPSLAASAFPSIDQAIPQETRKKLWQLSCSTDRSARFTRKAEQIEPERVGHTAAPPMKPAAVRKEAGGGIGSGAFGISCLDIKSFGASLVLFALIMALWQFHPYQPILAITLSWSLLLPFPGGTAATHTXSSS

SEQ ID NO: 109807 - protein, 202 aa, Triticum aestivum
  Clone ID: PAT_TA_4225.pep
TMHHLIYADLIPCNFDTFGLIKCLVNSLDSSSPQHLIVAHVPPGRIHLYVFRIGRLIPITKYFHLGSPSRRNEFANTERKQKKNWSQIGGESWTEGGMGFYAQHAAGQDGDDGAACAWRSVKGSEKGAYEGRIRRGRLPSDVGFICPTATPIARHPADCGSTLFSAGQSPPVGYAEPITAGSLLQRWDYGEAEPAATGDARV

SEQ ID NO: 109808 - protein, 239 aa, Triticum aestivum
  Clone ID: PAT_TA_4226.pep
MASGHIAQCLGGILARRAGATVAVSGDLRLNGAQLVDGVRSLAAGLLERGVRPGDVVAVVGFNSIEYMELLLAIPYIGAIVAPLNYRWSFEEAVQALELVRPSAFIFDGAYSSWALRLMESQSFSSICLYITIGDPVNTGQGANFVSVDHVKRSCRGTAEMEPVSAPRDVALICFTSGTTGQPKGVAISHTSLIIQSLAKIAVVGYGEDDVYLHTAPLCHIGGISSCLAILMAGGCHVL

SEQ ID NO: 109809 - protein, 178 aa, Triticum aestivum
  Clone ID: PAT_TA_4227.pep
MSWLAGTCGPKVIIQYWPRATQCFIYNATGDTLYHVGNHDWSGHILNSRGYPERIGNGQWAAFVHCQGSFSGSMASVIYRGKNKDGGDQHYLVSWNNPIRYTFGFNKAYCGIGPVDYFHTRWDHTLDNLSNSDNYSYAKSDGCEIDSKIGKRDAPFFIAKITSLVGHLQHCARIYMDK

SEQ ID NO: 109810 - protein, 174 aa, Triticum aestivum
  Clone ID: PAT_TA_4228.pep
MDRMRDALERVKMLVGMEFDEESAPPPPEEQSFFDDINRHCTLNTTQRLYGFATCLAAGLTCTFLSMIVFFNPVKFGVTFTLGNAMALGSTAFLIGPKRQFDMMLDPVRIYATAIYIASIIISLFCALLVHSKLLTLLAIVLEFGALIWYSLSYIPFARSVVSKLMASCFDTEF

SEQ ID NO: 109811 - protein, 175 aa, Triticum aestivum
  Clone ID: PAT_TA_4229.pep
RPAGAASRRRAAGGPAPALRFLCAVPSSSSSRSGKSVPRARRRDGDDDGDGAAVTKERIVQVELHKEATDAYMSYAMSVLLGRALPDVRDGLKPVHRRILYAMHEMGLASRKPYRKCARVVGEVLGKFHPHGDSAVYETLVRMAQDFSMRYPLVQGHGNFGSIEADPSAAMRYTE

SEQ ID NO: 109812 - protein, 133 aa, Triticum aestivum
  unsure (1)..(133): unsure at all Xaa locations
  Clone ID: PAT_TA_4230.pep
KLELDHQVKPXGDHKLTKENAMNQPWSRLPPAPVRSNGNYLAPKEHIPRGGGAPDIAEKLSQLSMASTTNRAPAVPSGRFADLKGTSRAHQPEPVRRPVPLGPRDTWHARNDPFRRTYEMPGERALLQRKLVS

SEQ ID NO: 109813 - protein, 484 aa, Triticum aestivum
  Clone ID: PAT_TA_4231.pep
MERYNIITEVGDGTFGSVWRAINKESGEVVAIKKMKKKYFSWEECINLREVKSLRRMNHPNIVKLKEVIRENDMLFFVFEYMECNLYQLMKSKGKPFSETEIRNWCFQVFQALSHMHQRGYFHRDLKPENLLVTKELIKVADFGLAREIISEPPYTEYVSTRWYRAPEVLLQASVYSSAVDMWAMGAIIAELFSHRPLFPGSSEADEIYKICSILGTPNQHTWAGGLQLAASIHFQFPQSGSINLSEVVPTASEDALNLISWLCSWDPRKRPTAVEVLQHPFFQPCFYVPPSLRFRSTGYATTPPSVGAKGAMDQKNARRYPVGTLSNGRPAVNNSYLSTNAPARAAGVQRKLELDHQVKPVGNHKLTKENAMNQPWSRLPPAPVRNNGNYLAAKEQIPLGGEVPDIAEKLSQLSVTSTTNRAPIMSSDRFADLKGATRAHQPEPVRRPVPLGPRDTWHARNDPFRRTYEMPGERALLQRKLVS

SEQ ID NO: 109814 - protein, 139 aa, Triticum aestivum
  unsure (1)..(139): unsure at all Xaa locations
  Clone ID: PAT_TA_4232.pep
PPHPAAPTHPYPPSSPAAPKSXPPPSLLRPASKPPAPPPRASTTPPRASPPLPPPPPAIASAVRRSARPPSPVDHAAPNSPNRRPYPSPVTRRSTRAPPPLGRRPLAXPTPXPSSPSGGAPPCSTIPVSRTMRPLCWPP

SEQ ID NO: 109815 - protein, 201 aa, Triticum aestivum
  unsure (1)..(201): unsure at all Xaa locations
  Clone ID: PAT_TA_4233.pep
SPSQPTEEPPSQPCVGVQRQGRCGSMMVQQRRGCEIEEGASRCRGDGRRGCAVVRHRHRRSRSAVRGEAGYVTPAGARGYVLRDDAAAPVFSPRWSTGAITVVLSRRTAGRRGGRLRPALVPPYLCLSRPPRPRLAGGRRGELSSQDAGGWLSPTPRSAPLASAALCSGSPPPRPALPSXXPMGRRIRRPPMDFAWNAGWX

SEQ ID NO: 109816 - protein, 144 aa, Triticum aestivum
  Clone ID: PAT_TA_4234.pep
MGLDGDVSVCNSLLSMYARCMDFSSAMDVFHETKDRDVVTWNSILTACVQHQHLEVVFELFNLLQRSVPSLDGISLNNVLSASAELGYLEMVKQVHAYTFKVGLVNDTMLSNGLIDTYAKCGSLDDAAKHFEMMGTNCDVFSWS

SEQ ID NO: 109817 - protein, 397 aa, Triticum aestivum
  unsure (1)..(397): unsure at all Xaa locations
  Clone ID: PAT_TA_4235.pep
AVADAAVPCSGATGAGQGYVWMSHRTPGSDTWDLAVRSKHLWEDLAAERGARLRAGGARESLGWXETGSLLVGRTSKELATLEEKTKVLSQAGINAECLSASSLHALEPALCVGNDGGAMFLPXDDRQIDAFQAVSLIEKINRSYTPKGRYMELYNDPAMSLIRSEVTGRVEGVQTSENILYGRKATVVASGAWTRSLLHSFLGPNSTLDIPVXPRKGHLLVLENFDMLKLNHGIMELGYVDHQGDNSHSIHLSSTSNKDEHDAASISMTATLNTKGHLVLGSSREFKGFSREVDKSILKSIWARAGEFFPAINNVHLDIDEDKEIRIGHRPYMPDGKPVIGFVPDMSNVLIATGHEGSGLALALGTAEMVTDMILGDPGRVDFTPFSIENRFSGTA

SEQ ID NO: 109818 - protein, 330 aa, Triticum aestivum
  Clone ID: PAT_TA_4236.pep
FLYRNWTCNFHDDAVRLDYIPKIWLGGGFVYHRVGNKLVLNDPSLPKSDLKKKKNKPKLSMKESMKVLISSKYVRDLATLVVAYGISINLVEVTWKSKLKAQFPSPNEYSSFMGDFSTATGIATFTMMLLGRIIFQRFGWGVAVMITPTVLSVTGTVIFSQIWFGQPLAPLLATWGMTPLLAAVYVGALQNIFSKSAKYSLFDPCKEMAYIPLDGDMKLKGKAAIDVVCNPLGKSGGALIQQFLILIFGSLANSTPYLGGILLVIVLAWLGAARSLDKQFSSLAKEDLRKEMSKEKVETAAPKEPEAATDVLVEQSNGTENSPSDSSPAQ

SEQ ID NO: 109819 - protein, 205 aa, Triticum aestivum
  Clone ID: PAT_TA_4237.pep
IGPGRRRARGHGPGGAPPALTRGAGGDLWSADLPLRQVRARFAAGRRSPGLAARCAGREGFTGTYRWMAPEMIKEKTHTRKVDVYSFGIVLWEILTALVPFSEMTPEQAAIAVALKNARPPLPASCPVAMSHLISQCWATNPERRPQFDDIVTVLEGYKEALDNDPSFFLSYIPPPTHHPHQHQQSLLRCFPRVKSMRRSASLKA

SEQ ID NO: 109820 - protein, 191 aa, Triticum aestivum
  Clone ID: PAT_TA_4238.pep
MRGAQLPAAPCRRASAIPLEQERLLQSAPAAIPDFPSTSLVQEMPRKNQECTRMGGGASTSKKRKASLQSNSNREDSPPPRDDLSRILRKSLLPRGYPMPSKITGGMRLVNTFELCFGNLDGYSEEHTSIKLLALSLCQSIVSLAAFKGQNRRFTCTGTIIQHTASSMSILTSASLIRSSEDESKILDKLE

SEQ ID NO: 109821 - protein, 80 aa, Triticum aestivum
  Clone ID: PAT_TA_4239.pep
MEGDPMGVALPEDALAEILRRLPPRSLATSRCVCKAWRSIVDGRRLLLPELLPHSVRGIFLEYNEASYPGFLSHPSMEPG

SEQ ID NO: 109822 - protein, 128 aa, Triticum aestivum
  unsure (1)..(128): unsure at all Xaa locations
  Clone ID: PAT_TA_4240.pep
GSRSSRGPSPGGVCSGSTPLRSWVSPPARFPASSFSATPASTARALFEAPLQCCRGAGGSRLSLYPIPRSGPVNIFYVYTSTICCSIHPWKLFGGSSPVMPTCHNLHVAYGHYCENMGFAFLCLLCNX

SEQ ID NO: 109823 - protein, 316 aa, Triticum aestivum
  unsure (1)..(316): unsure at all Xaa locations
  Clone ID: PAT_TA_4241.pep
MDQRARHPPGIGNGRGGNPNYHGRGPPPTQQHHQQPSPPSPQQAQGHPQQYMQRQWEHSQHSQHHSQQLQHQQWLRRNQTAGEAAAGAARASEHHAPAAAGDADLSSQDWKAQLKLPPPDTRYQTEDVTATKGNEFEDYFLKRELLMGIYEKGFERPSPIQEESIPIALTGSDILARAKNGTGKTAAFCIPALEKIDQDKNAIQVVILVPTRELALQTSQVCKELGKHLKIQVMVTTGGTSLKDDIVRLYQPVHLLVGTPGRVLDLTKKGICILKDCSMLIMDEADKLLSPEFQPSVEQLIRYLXPSSRQILMFSA

SEQ ID NO: 109824 - protein, 73 aa, Triticum aestivum
  Clone ID: PAT_TA_4242.pep
LCFSRLKLYSCYITKFDQVRFEPLCVRSTRSPRFFIDLNFQNFFVHFGLTDSSISFIPSSLSRSRFSISVQPI

SEQ ID NO: 109825 - protein, 86 aa, Triticum aestivum
  Clone ID: PAT_TA_4243.pep
MMHCCRLEQESGFYFNVKYFEEKVHAGEWDEVERYLSGFTKVDDNRYSMKIFLEIRKQKYLEALDRHDRAVDILVKDLKLDINEDY

SEQ ID NO: 109826 - protein, 233 aa, Triticum aestivum
  unsure (1)..(233): unsure at all Xaa locations
  Clone ID: PAT_TA_4244.pep
TRPSSWGGTRCRGGRCGATSSTSRRGRSRAACSSRCRTACTRSASAATRRRRITCPCAPARSTPPPSPAPAPAPVTAPAPAHASPQAQDAEGLLINGNFENAPRKVNKTLIVGRHSLPGWTLRGHVEYVSAGPQPGGMFFAVPHGVHALRLGSHASASQNVSVRPGSLYALTFAATRTCAQDEALRIXVSPSLSAPADVAVRTLYSADTADTWAWGFRAXSPVARVTFSNPGV

SEQ ID NO: 109827 - protein, 244 aa, Triticum aestivum
  Clone ID: PAT_TA_4245.pep
TTRSSARLKKPACPPQVVVGEIGWPTDGNKNANAKLARRFYDGLLKKLGKNEGTHLRPGKLDVYLFGLFDEDMKSIAPGNFERHWGILTYDGKPKFSMDLSGQGNDRRLAAVSGVEYLPKQWCVFDDEAAKDEDMDKLGGNIQYACASGDCTALGYGCSCNGLDEMSNISYAFNMYFQMQDQDVRACDFDGLAKISDKNASTKSCLFPVQIISAATVPARPSSLLLLALLLAHALVMTTGFIIM

SEQ ID NO: 109828 - protein, 119 aa, Triticum aestivum
  unsure (1)..(119): unsure at all Xaa locations
  Clone ID: PAT_TA_4246.pep
MAAVAEGSPAASAAAAKEAEYRKDVQKLVDLLSKLNPAAKEFVPSSAAATPRKGLSADAPVFYYGPIGGRNGGIAGYPGADAGYIGYQQRMRRNFVDNERRNVYINHGRRTNEXARRAX

SEQ ID NO: 109829 - protein, 456 aa, Triticum aestivum
  unsure (1)..(456): unsure at all Xaa locations
  Clone ID: PAT_TA_4247.pep
MLLAHGVLLTYSQVWRGREVAQKEMFHVMRETFGHLPWYRDRLFQTVPPSPPALSLSVHPRRAFGAFPPSLPAGALRGSPRLGLVPAPLAAAMAFSLRAAAARVAAGGLLPGAGPGGGGGTLGGRVWCWLQLRGALPARXWEGPLTPSIDYKAKDEITKAGKLTVLCSXRLCLKCGAAVFLLLILQTANARAGGGNFLAAPARAAVPCGTGEFNASIESIRNISTEAADWIIASKPEHWSPAGSPGCRALQLSSRLPGPGHHWIPAGSGGSPAXATTLIRLCSRCKQAGHNKAPRVAAWPLTXPSIVFCALGDRFTARKLTVLCSSETVFEVRGGGTFVVNLANWGCTCRGWQLSGLPCVHPVAVFNWIGRSFYDYCSKFFKIESYHMPYSRSFLPSPVVVPSDSCAGPTSPPPLPRSSAAPCCGRFNPNKVTTLIRLCSRCKQAXHNKATCEALL

SEQ ID NO: 109830 - protein, 232 aa, Triticum aestivum
  unsure (1)..(232): unsure at all Xaa locations
  Clone ID: PAT_TA_4248.pep
NALIKVLQSINAARYVESTLAQWCEDVFFLEMENLPVVGEEGGSVFQQEINQLKEFISEWVDKISTVILRAFDARSRDYLKNKRQWQEHSEEPAISRAIIESSGYIQGRLSKLEDGLNVLDFVTVGRAVATGVDQLXFFTGIFAGSPKFSNGGVERLHADLSALFAVFQAWCLRPEGFFPRLSEGLKLLKIDERQLRDSRLVTDKNWLRGHGVRHLTAGEAEKIIKNRVYDA

SEQ ID NO: 109831 - protein, 162 aa, Triticum aestivum
  unsure (1)..(162): unsure at all Xaa locations
  Clone ID: PAT_TA_4249.pep
KGALFCIDYFALRSQQYKWLEQFAEEYQCDNSLWLFPNFSFSLAIARFYLERDAEDVSDHADKSTAVDLMKQALMLHPLVLSKIVDKAPLKDSSWTQILKNAFFGSAKPGSPSLEHVINIYVEXRHYIMWRFPELQNLLKEAALLVIESLKHDSREAQDWAC

SEQ ID NO: 109832 - protein, 197 aa, Triticum aestivum
  unsure (1)..(197): unsure at all Xaa locations
  Clone ID: PAT_TA_4250.pep
TRDPPPAGLRASERERERPWRGRGARRTSIPSSCRPCWPPRRCGRSATASCSSSTACRTSRPTPPPPPPTPTPTLSSGSSPPTSSRSTTSAWRPAPACSRPASRSPPRRAFTSPRPTWLSRSCPTSSSTTRCSRSSSLPAPGPRPRPSTASWPPSWPSSCWRSTSXXAASSASPAXXXRPRQDPDSSSPDSSRDDDD

SEQ ID NO: 109833 - protein, 230 aa, Triticum aestivum
  unsure (1)..(230): unsure at all Xaa locations
  Clone ID: PAT_TA_4251.pep
TRXLXFVXFGVLVSSQFXVPLXXFCLARAGRHKAGMTETPRMWGGPREQSVHVFTVVPLAFDENPYVFLIFWTENKGEERYVVPDSQSPSPFQLLRFAAAADGLQRDDGRVAREVLHDLDVAVDRVLDVSVLVNNVDDDDKAAVVLAVVHQGHPPDQHEPLERHRSERSRTCVDLVAELVVGDDDRVGIFGRLETQSKSTEAASWDGAEGGGDNPSQRGENEGKEEKGAA

SEQ ID NO: 109834 - protein, 328 aa, Triticum aestivum
  Clone ID: PAT_TA_4252.pep
LCAFKTPVDQSDLSLRKFEELTKELESLQKEKRERLKQVMDHLNTLHSLCEVLGIDFKQTVHEVHPSLDEAEGSKNLSNTTIERLALAVDRLREIKIQRMQKLQDFASTMLELWNLMDTPIEEQQMFQNVTCNIAASEHEITEPNTLSIDFLSYVEAEVLRLEQLKGSKMKDLVLKKKSELEEHRRRAHLIGEEGYSDEFNIEAIESGAIDPALVLEQIEAHIATVKDEAFSRKDILEKVERFLNACEEEAWLEDYNKDDNRYNAGKGAHLTLKRAEKARILVNKIPGMVDVLTTKIIAWENERGKEFTYDGVRLLSMLDEYMIVRQE

SEQ ID NO: 109835 - protein, 146 aa, Triticum aestivum
  unsure (1)..(146): unsure at all Xaa locations
  Clone ID: PAT_TA_4253.pep
PSGTATAALINGFHTPQGDKNARQQVRXGFLKYFGISFFWSFFQWFYTGGDVCGFRRFPTFGLRAWKQTFFFDFSLTYVGAGMICSHLVNLSLLFGAVLSWGVMWPLMSKQEGKWYSAKASASSMPGLSAVYVCVGPGLAAFVPFS

SEQ ID NO: 109836 - protein, 164 aa, Triticum aestivum
  Clone ID: PAT_TA_4254.pep
NQSPRRTKQRILMPVDPHSLQFISCWMLNWTTLGLLDDNLSSTSQSSDIKTELIRTSSLGRSSLPFNLQRRSPEPDPESPLSHVSHPNFSEPMASNSSTFCTSLFSSSSTNSAPCRQMGALPFLPHPPKYEQQVLPGQSSTSSLQLSGDTGNVHDEAEQTDDIK

SEQ ID NO: 109837 - protein, 391 aa, Triticum aestivum
  unsure (1)..(391): unsure at all Xaa locations
  Clone ID: PAT_TA_4255.pep
AHPQVSAPACIAAATCCSSSSFPANHSRHIATYSRASRLPLHRPAWRRSLLAASPPASRLRFRPRTSLSASPAAAHAYAVADTNGFVELEARLVDRFGSEGTLAWCCQVAVCVAVVDMSLLIRAQSGGTLRTWMDVGTLFDRVKSSXTIWCIDEDQLVVNLKKVEQELKWPDIDESWQSLTAGITQLLTGISVHIVGDSTEINEAVTXVMAEGIAYLPVCTSELLESATQKSVDTWAASEGADSVAEAECVVLESLSSHVRAAAAALGGKQGAASRFDKWQYLHSGFTVWLSVSDAGDEASAKEEARRSVSTGSVAYAKADVVVKLGGWDPEYTRAVAQGCLVALKQLTLAXDKKLAGKKSLYIRLGCRGDWPNIEPPGWDPQSDAPPTNI

SEQ ID NO: 109838 - protein, 127 aa, Triticum aestivum
  Clone ID: PAT_TA_4256.pep
ASKADDLAKPLEEAKIPYKIHIVKDHDMKERLCLEVERLGLSAVIMGSKGFGSARRATKGRLGSVSDYCVHHCICPVVVVRSPDDAVAEGGESATAMEAAVGAEDVLHPVPEEDAEYHDAAEEHKDT

SEQ ID NO: 109839 - protein, 257 aa, Triticum aestivum
  Clone ID: PAT_TA_4257.pep
MQAPTNPPVDLPPLVAPPPRVKAPTPRPPPPASLQPDSPGVFFTNAAAAAPLGSAHRRIAIAVDLSDESAYAVSWAVANYLRPGDAVILLHVRSTNVLYGADWGSVTPTSPEDDAEVAARKMEEDFDALTASKADDLAKPLEEAKIPYKIHIVKDHDMKERLCLEVERLGLSAVIMGSKGFGAARRASKGRLGSVSDYCVHHCICPVVVVRSPDDAVAEGGESATAMEAAVGADDVLHPVPEEDAEYHDAAEEHKDT

SEQ ID NO: 109840 - protein, 282 aa, Triticum aestivum
  unsure (1)..(282): unsure at all Xaa locations
  Clone ID: PAT_TA_4258.pep
MAAGRAFFCAPSSIGATARRLAFASPPARPLASAPHRRVRGRCCASISSSSDASAPAPPPYVLTTPLYYVNAPPHMGSAYTTIAADAVARFQRLLEKRVIFITGTDEHGXEKIATSAEASGRNPKEHCDIISNSYKMLWADLDIEYDKFIRTTDPKHEAVVNDFYSRVLSTGDIYRADYEGLYCVSCEEYKDEKELAENNCCPVHLKPCVPRKEDNYFFALSKYQHKLEELLTRNPNFVRPSHRLHEVEGWIKSGLRDFSISRASVEWGIPVPNDTKQTIYV

SEQ ID NO: 109841 - protein, 186 aa, Triticum aestivum
  Clone ID: PAT_TA_4259.pep
PARPPPADPLLPHGRDRGLPPPMIPSDGGADPSLALDAVTSGRGAPGHAFPSTVSPGCLRSSGSAAPVRRSPPARAQSMPTCTRKGRRQEQSCKGRTSRAVNRAILLHLGRHVPRRRRRPLWRSPPWRPALPRLPNQIYELRLLPMASARGWSRPVACEPEDISNLERWCWWILAASRRHAVACRR

SEQ ID NO: 109842 - protein, 57 aa, Triticum aestivum
  unsure (1)..(57): unsure at all Xaa locations
  Clone ID: PAT_TA_4260.pep
NCGSLVPGRYXDLKGAXSKXXGVLDGKYDDISEHAFYMVGGIDEVIAKAEKIASENA

SEQ ID NO: 109843 - protein, 151 aa, Triticum aestivum
  Clone ID: PAT_TA_4261.pep
PGCMDSFAVGRSYAATPTSILRRLRWLLPCSAPPPPSSADRTRGRGPSPGGPRSPPIKCPRFLSAGAGGVVEPKACCVAHMRMEAALEKFSENLCVMEKDIGILLEHERRFERREQFHEEDCRTSSFLGAIFVFCPDKEEGTLRRRGSQGV

SEQ ID NO: 109844 - protein, 248 aa, Triticum aestivum
  unsure (1)..(248): unsure at all Xaa locations
  Clone ID: PAT_TA_4262.pep
DDSEDDDMTAETGGSPDGLGKRKRGGGGSKKMMAFFEGLXSRSYRGRRRCSSGSWRPWRRGRPSXHAREEAWRRQEVARXNREQEQLAQERAAAASRDAFIIAFRTRGRTRGVHVPPVVMPMPTPMQVQTPPPPKKPRQHLPPPPPSQATQQPQPQPQPKPAAPLQQQPPAQPPQHKETTREEVGTPRSAPAPTSAGLSLALVPVATEQHVVEAAGLGRGESGGGPSSSRWPKTEVHALIQXRMDMDN

SEQ ID NO: 109845 - protein, 104 aa, Triticum aestivum
  Clone ID: PAT_TA_4263.pep
MSLFAYFPLHRLSLLDLLAAACPWRRPHPHSGLSGWSVSSTRPSASPAPTPQALPCWPARCSCSPCPSSPTLPSAPPSSPTPSPPPTPAPASSVSPRTGHPSSS

SEQ ID NO: 109846 - protein, 237 aa, Triticum aestivum
  Clone ID: PAT_TA_4264.pep
MRMRVLPAFSFSFSTAAAAAEPPTAAPSVAPAPAPAPAATYAVYLNIYDISPINNYLYWFGLGIFHSAVQVHGMEFGYGAHEYATSGVFQVEPKSCPGFIFRRSVCMGTTNMSRAEVRAFLEDLAEDYHGDTYHLIVKNCNHFTADVCKRLTGKPTPGWVNRLARLGSVCNCVLPENIKVSAVRDETAHLEFSDDDLESDTSIIDSDIGDLDHLLTTPNSDVVPPKDKTLTPGRDSL

SEQ ID NO: 109847 - protein, 233 aa, Triticum aestivum
  unsure (1)..(233): unsure at all Xaa locations
  Clone ID: PAT_TA_4265.pep
CNNFLLGGLGAILVVAVVVGVVATVTSSGNNKAGDNFNVPGEANLAXLRQVGQVSVRPHAVQGVVREDPHLGLQWHREPQRGVRHRCQVGVGVDQVGGGAVKKYRGGQXSDPLTEGARQDCKELLEDSVDDLKGMVEMAGGDIKVLLGRTDDLEHWITGVMTFIDTCADGFADEKLKADMQGILRNATELSSNALAITNSLGAIFKKLDLDVFKTDSRRRLLSADESRYPAWM

SEQ ID NO: 109848 - protein, 377 aa, Triticum aestivum
  unsure (1)..(377): unsure at all Xaa locations
  Clone ID: PAT_TA_4266.pep
PPFGRHKWGDSTERRVPTNSVQNQAKEREHNFDGKQDHKKLPPDPKKSPLDRFMDVSMPSRNSESVSPSSARSHRLDCVFDDVSECEILWEDLVIGERIGLGSYGEVYRADWNGTEVAVKKFLDQDFYGDALDEFRSEVXVRIMRRLRHPNIVLFMGAVTRPPNLSIVSEYLPRGSLYKILHRPGCQIDEKRRIKMAIDVAKGMNCLHTSVPTIVHRDLKSPNLLVDNNWNVKVCDFGLSRLKHSTFLSSKSTAGTPEWMAPEVLRNEQSNEKCDVYSFGVILWELATLRMPWGGMNPMQVVGAVGFQDRRLDIPKEIDPLVARIIWECWQKDPNLRPSFAQLTTALKTVQRLVSPSPAETQSPPVPQEIWVNSSTP

SEQ ID NO: 109849 - protein, 146 aa, Triticum aestivum
  unsure (1)..(146): unsure at all Xaa locations
  Clone ID: PAT_TA_4267.pep
GPDAHRQSTEEMVVTAAGGFTVPAGTAVFINLWSIARDPANWDAPLEFRPERFLAGGRNEALGPRGQHFQYLPFGSGRRGCPGMGLALQSVPAVVAALVQCFDWAVPADIDGKKIDMEEADGLVCARKHPLVAPPLXRLSPFPAVV

SEQ ID NO: 109850 - protein, 226 aa, Triticum aestivum
  unsure (1)..(226): unsure at all Xaa locations
  Clone ID: PAT_TA_4268.pep
NREGTRPATSPTNESAHRASAAPDLGTKPHRPAKDGQILHHKPQPKVVASRNLVQRAGTPAPPPATTASQRKQGRAPASPTPEPPPETPLXPEPTSPPRSRRQGTKKPXARSSPPPPRPSPXPPKPAKSIDRRAPYDGRSTASPQNTVPXGRRAADGAEEGGEAGTPPPPPAARPQPTINTPKAQNPGPSTLPPPEWRPERRETADGGGRWKGEREEFVRRGEGPA

SEQ ID NO: 109851 - protein, 149 aa, Triticum aestivum
  unsure (1)..(149): unsure at all Xaa locations
  Clone ID: PAT_TA_4269.pep
HLDXGPVXLRMLNEVLXXISCMLXLCYPXCXLISKKASPRQLKLRARPGTEACAGGRPGKDWGPRSRAPLRDSLAEEAKDGGPALRWYTRGGTAEKPGKGCGTSWAIWRVPNFPHSQPVTSQVISTLSYHLLLCRRKFYNCKIKHFEGK

SEQ ID NO: 109852 - protein, 451 aa, Triticum aestivum
  Clone ID: PAT_TA_4270.pep
TRPDGGYRAHCKGASEIVLAACDKFIEETGAVTPLDKETAGKLNGIIDGFANEALRTLCLAYREMEEGFSIEEQLPQQGYTCIAIVGIKDPVRPGVRESVAICRSAGVTVRMVTGDNINTAKAIARECGILTEDGLAIEGPDFREKTLEELLVLVPKIQVMARSSPLDKHTLVKHLRTTFNEVVAVTGDGTNDAPALHEADIGLAMGIAGTEVAKESADVIIVRDNFSTIVTVARWGRSVYVNIQKFVQFQLTVNVVALLVNFSSACFTGNAPLTAVQLLWVNMIMDTLGALALATEPPNDDLMKREPVGRTGKFITNVMWRNIFGQSLYQFVVMWYLQTQGKTFFGLGGSDADIVLNTIIFNSFVFCQVFNEISSREMEKLNVLKGMLKNYVFMCVLSSTVVFQFIMVQFLGEFANTTPLTSLQWLASVLLGLVGMPIAVVVKLIPVGSS

SEQ ID NO: 109853 - protein, 194 aa, Triticum aestivum
  Clone ID: PAT_TA_4271.pep
TGYRAADDSGPGASGGHQKLGTDSVVKMEQDSLDQDRGPPPCPPPTTPAGRAPKVVKLSAAEDTTASPKFESKGTSERTDAGEGTSLAGEKIEQMVDPLHAMLLDMIPSLREDASSDPPAKVEHDPSRVRSSTSDNRVPVPETGGSASNPVAPAPRAGSSSYSAGVPAPDPNPVAPKKKKVSYKDLADEFLKDW

SEQ ID NO: 109854 - protein, 68 aa, Triticum aestivum
  Clone ID: PAT_TA_4272.pep
MFVRDLESDPELRFAINLYQNEDYRLEMASTIGDDVLTVPIEELIEDLTLGDDEEEEEEDGADAGMVE

SEQ ID NO: 109855 - protein, 130 aa, Triticum aestivum
  Clone ID: PAT_TA_4273.pep
PLPLIGSAASPASPVPPIYPSTRDLAEGVRGEVRLCVREEAHVCVCGVVRLEGQPSSQPWLPSSSLSGWTASVQEQCAIHPVGQMIEKELKEQGCVWVAAIDPEILYLGRCYRSCGLEEQGWTSKLLFCL

SEQ ID NO: 109856 - protein, 117 aa, Triticum aestivum
  Clone ID: PAT_TA_4274.pep
PVCPSTSVQPCRLPWSKWLLCEYQISGCSSIAGLIHVSELRPSSPSRNCTGQLIIEFGSPFYLLSVLSLQSSEEVSVVFMTNGEAVTLKVSQPSVKASMATTACSTKSASFNRLYRA

SEQ ID NO: 109857 - protein, 58 aa, Triticum aestivum
  Clone ID: PAT_TA_4275.pep
TLLVSSDLVAHRSVRCRRRGESLAGFDGKLCAVTAFGKFFILQFRNNGKQRSKKKKKK

SEQ ID NO: 109858 - protein, 122 aa, Triticum aestivum
  Clone ID: PAT_TA_4276.pep
SLPNLHRPATTAAVGAASAGASSSWFLMLPLRGRLPRRWCLDSWRGTAATPRGMPRRAAWWPRGGRPMLCLRRLGVFIDRRHLCRPHPVAIASLPYESDGSNSLSSDRFQVLAAAAQLALTC

SEQ ID NO: 109859 - protein, 174 aa, Triticum aestivum
  Clone ID: PAT_TA_4277.pep
MTKNKRRLMRGDEEQQRPYKRATRPRALSELSEQVVSRLRRSVVSLASFDGDTKLRECTGICIETSCSDSEATILTSRRLVPPTWPASLTIKVRLPNDQIVTGWIEDPGIYVDFFIVNIKEVSRVDATSLDRDIQFEPHTKAAAVCRCFSSGFLTVTSGLNLASPTSETIVSTC

SEQ ID NO: 109860 - protein, 163 aa, Triticum aestivum
  Clone ID: PAT_TA_4278.pep
SGGPSSGHARAMCWCCRPCRLVTRRRDRRAHRGKHGRAVRGVRHAHALHGCGGGGRGRRGRRRGGEAGGAAGAAGAGAGRLLGRQSHALPPQSLALAKPPWPPAGSPGSSRRRRDARIYTPRTECRQLRKPINPSLVKNEVLPSTSQSFTAEEITSKKLKRER

SEQ ID NO: 109861 - protein, 132 aa, Triticum aestivum
  Clone ID: PAT_TA_4279.pep
IRFAEWRCSPVCATGPRVVPSGSTAMFFIVFLVVYGRVVGMERPRVEACCGLATSVSFHLCNVLQLCNITTCCTPVNSSQEQDDETRLVPREAESSTPNRLRRRSCGEWTHNAWLRGFGGAVGCGLQPHRTG

SEQ ID NO: 109862 - protein, 88 aa, Triticum aestivum
  Clone ID: PAT_TA_4280.pep
TQDRAASWCSARVTNGRGKKKRKRINKLICTHARRRNQLVFLDESSSEEVVLLLVVLLLVVVLSSLLLSLLSLLVLSRSGTIAAAGST

SEQ ID NO: 109863 - protein, 190 aa, Triticum aestivum
  Clone ID: PAT_TA_4281.pep
LLVFASKKAKEASEGIPFEWNYVVESQYGNEGMVEGKCPNRGESPAMDSKSQSLVLVNFFTTDPNPTGVCGNNSAPLVSMLKTCHDLSGNRWPNYIAVDYYMRSDGGGAPLATDVANGHLVCGCDNIAYCKANSTFGTCVIPPPPPPSPPRAPAKGTSPGGDPSAAVARLPAFQWSCFLGLTSLALLFLS

SEQ ID NO: 109864 - protein, 350 aa, Triticum aestivum
  unsure (1)..(350): unsure at all Xaa locations
  Clone ID: PAT_TA_4282.pep
MTVVAAAAAAAAQELPGHGQTVCVTGAAGYIASWLVKLLLERGYTVKGTVRNPDDPKNAHLKALDGAAERLVLCKADLLDYDAICAAVEGCHGVFHXTASPVTDDPEQMVEPAVRGTEYVINAAADAGTVRRVVFTSSIGAVTMDPNRGPDVVVDESCWSDLEFCKKTKNWYCYGKAVAEQAAWEKAAARGVDLVVVNPVLVVGPLLQPTVNASAAHILKYLDGSAKKYANAVQAYVDVRDVAAAHVRVFEAPGASGRHLCAERVLHREDVVHILGKLFPEYPVPTRCSDEVNPRKQPYKMSNQKLQDLGLQFTPVNDSLYETVKSLQEKGHLPAPRKDILPAELDGATA

SEQ ID NO: 109865 - protein, 96 aa, Triticum aestivum
  Clone ID: PAT_TA_4283.pep
TPSHSENCTHSSIHSENYASGDDDKMHRCTAVTLSPGRSLHFICCIRYILLTMTINSMVLNVLLGPWIQSTQICRTLRMVICTELTCCSYLPVTKV

SEQ ID NO: 109866 - protein, 64 aa, Triticum aestivum
  Clone ID: PAT_TA_4284.pep
FRFELSKKKSRISHQGELGKSMYQEPEIRGERGCRAATDDAECTIPALNMLNAQPLTILKISKH

SEQ ID NO: 109867 - protein, 186 aa, Triticum aestivum
  Clone ID: PAT_TA_4285.pep
MSRLASSPVLPLDDEDLLQEILIRLSPQPSSLPRASLVCPCWRSILSNHKFLCRFRKHHRKPPLLGFFARCLITKTTVFTSVLDSPDRIPAGHFLVPHSHNPSKRLRFTGCRHGLPVQFEMSLNSPMPTGLIVWDPLTGQQHIHLTMPPGLNGDKWKCSKSTVVSAGVPLGRALGACFAMCMVIAS

SEQ ID NO: 109868 - protein, 64 aa, Triticum aestivum
  Clone ID: PAT_TA_4286.pep
TEKEWYCTQAAETEITVRGGTVITQTGEYYFTRAGTDRPPSNEVYSSFAHSITLQHVGKKKLDT

SEQ ID NO: 109869 - protein, 152 aa, Triticum aestivum
  Clone ID: PAT_TA_4287.pep
VMVYRSNASLPGAEGYFTAIYTDSHHEDSLLRTTAQMLEDKDRENRALRLELFNSRSDHWDTLTRFAPAVQAGYMDMRDLYPVRSSLLDHMDCRDVGGITPPHGPLLSPFVGPRPHLCPYGLQAPQDRLFPDDHVQLPGHGGNLYEDYYGDV

SEQ ID NO: 109870 - protein, 86 aa, Triticum aestivum
  Clone ID: PAT_TA_4288.pep
MANAGLRAYREVLRLVRRLPADARPYYAKYARENFVNYRHLSADDDLAGLLRRAHAHSSWVLSKYSIDAAEAAGRLKEICGERGPH

SEQ ID NO: 109871 - protein, 232 aa, Triticum aestivum
  Clone ID: PAT_TA_4289.pep
VSQAATSAAPPLPPRRPARRRLLLLRHRLHPPGRRSCDDLDPPGGGRSDDVDGGSVDHISRVPDAVLGSIVSLLPTKEGARTQVISRRWRPLWRSAPLNLAVDCGPNKRDSIPKILSEHPGPARRFSVRIFTDCSDDKIDGWLSSQALDNLQEFELTYICWLFWRSNGEKLGLLPLSVFRFSPTLRVAKFPRPPFPRSNLIVQLSLKFPCLKQLTLEKVTISEDVLQSMLSG

SEQ ID NO: 109872 - protein, 95 aa, Triticum aestivum
  Clone ID: PAT_TA_4290.pep
TENRGDIIFCKNLSFSMTSPKDTAAILIGKLDQTYPEYAILSLTIINFCKETLPGCKETCPWYVFSLSNNNYLVYYLDNLVNGLYCSITHIIFMW

SEQ ID NO: 109873 - protein, 196 aa, Triticum aestivum
  unsure (1)..(196): unsure at all Xaa locations
  Clone ID: PAT_TA_4291.pep
MPASAAAAAAEGEEKAAEAGGRELLYCGTVRFDIMGRKVKGXMQGRGNLVSPTRLRPLVGVDIRLVASGCAACHCVALSADGRCFSWGRNEKGQLGHGDTLLRNLPTVVSELSKYNIIAACVGRNHTVVVTDEGKSFXIGGNXHGQLGNGSLKXGTVCPNPLPCYTTKAFVLYVHNPSQYTSLPGNWHGHSSPYHP

SEQ ID NO: 109874 - protein, 89 aa, Triticum aestivum
  Clone ID: PAT_TA_4292.pep
MVGSDPEPDIARLFCHYNALYFEDSLGACAVSWAEEPLPYGDTSGCEYYPGGGGCIVLLSKSLYEFHTYSDLKNALLHEMIHAYVCIKR

SEQ ID NO: 109875 - protein, 169 aa, Triticum aestivum
  unsure (1)..(169): unsure at all Xaa locations
  Clone ID: PAT_TA_4293.pep
MMREGDACVALLSCLLHGLIERGHTLEEENKQLRHQVSRLKGQVSSLEGQDTERKIMWKKPENSATSNNYFKEKQFVHNNDDVKEAMDLNSSACYSRQQFSRTPSVKSRAPRVPNPPPSPTCIQPIIKAKKEGSMGPPPPXXPPLPSXLLKSTXXVQRXXRVVELYRLL

SEQ ID NO: 109876 - protein, 238 aa, Triticum aestivum
  unsure (1)..(238): unsure at all Xaa locations
  Clone ID: PAT_TA_4294.pep
EKVLSNENVINAIIMTLSHILSETSEIKFTMLRDSTNEADSNNLDYVDKVTLLENKVQPHSSSGPCPLIPHPSSDPEIVGPNDAGFDVKTAVQMCSPEDYERLKSEKINLETELARCSEMIEDTKCRFSEMEKNLEELTSRLSASENSNSLAETQLKCMVESYKILESRKVELEKEIEVLQSKIETLTAELGDERQSHQDDLARYKDLEEKMERSXNEQSSMHVEEVDRTKSKQEVEI

SEQ ID NO: 109877 - protein, 125 aa, Triticum aestivum
  Clone ID: PAT_TA_4295.pep
MPSTTPHAEVHREENIGLIEYSSSLLSFVWPARPLPPTPRGAGEPPPTVPVSEPPSATDPGRPPPTPRGAPPPAPARAAPPGPDAGPPPRPPPRGATGRQGGGRDGEGGRRAGVGGAGEPTGGGP

SEQ ID NO: 109878 - protein, 163 aa, Triticum aestivum
  unsure (1)..(163): unsure at all Xaa locations
  Clone ID: PAT_TA_4296.pep
QAHLRRCGHPICQFVESPRTFLHSVDPRVXXVWLLALVVLPARSNIYVRFGLVACLALLSMWVLPNHVWKDQLGRVTLLSGIIFIMLGFGXSDGAPSLVRTRTPPPSVLGVPNIPSALSGYSYTIMKLGPLQFTRKGPSVASTSACLSFAIXQSASLCLTTTT

SEQ ID NO: 109879 - protein, 315 aa, Triticum aestivum
  unsure (1)..(315): unsure at all Xaa locations
  Clone ID: PAT_TA_4297.pep
MGCGSIARKSALMGSSPPRVAAVASRSEXKARLFAAEXGLRSGTRIHGSYEALLDDXYVDAVYMRGGTSLHVKWATAAAERGEHLLLEKPTAPCAADLEPILAACEANGVQFMDSTMGMHHPRTAKMRQLVADQDTIGDVRFINTMVSFLANEDFLQNDIRVKPDLDGLGVLGDIGWYCIRGILWAVDYELPKNVVALRHPVKNQAGVLLACGASLYWADGKVATFHCSFLTNLTMDLTVVGTNGTIHVTDLVIPYEEKSAPFSVDSKTNFAELSTGWDPHPSKHVVTTDLPQEGLMVQEFCRLVQGIKRCRCQA

SEQ ID NO: 109880 - protein, 384 aa, Triticum aestivum
  unsure (1)..(384): unsure at all Xaa locations
  Clone ID: PAT_TA_4298.pep
HKPQXKQLLQNGGLKRRVTIIPLNKIHTGTIPDRVQQAARRMVGAENVTLALELVGYDEEVKNAMAYVFGSTFVCRNMEAAKEIAFNREVGSTSVTLEGDIFQPSGLLTGGSRRGGGDLLRKLHELAKAEADLSDHEDRLSVIEQKIAVLLPLHKKYAELKSQFELKSYDLSLFQSRVEQNEHHKLGELVKKLEQELQESKEELKEKQVEHKKCVSTVSDLEKTIKTYGSEREGRLKALEKKIKSLKSEMQAMSKQLKAYQSERERLIMEKDAVANELASLEEQLITSKAQITALXETWGTHKSKVAATKLEYDQAESELNIGRSKLKECDSQINSISKEQQKLQQLLGDSNVERKKMENEVKRMEIEQKDCSSRVDKLMEKYS

SEQ ID NO: 109881 - protein, 160 aa, Triticum aestivum
  unsure (1)..(160): unsure at all Xaa locations
  Clone ID: PAT_TA_4299.pep
MDCFAEAEGKRSHDPGDCNPHSPPATGFPVDNIPAPVVIVGAGPAGLGMAALLGEAGVPFXLLERCSCGGSLWGHRTYDRLCGRRPKQFCELPLMPFPKSFPTYPARDQFLEYLESYARRFNIEPQFRQAVVSAEFNGDFWWIRTKEVTSLPMGGEQATH

SEQ ID NO: 109882 - protein, 190 aa, Triticum aestivum
  Clone ID: PAT_TA_4300.pep
PSRATPPPGEIHPPAELSQRQRQPWSSGSATGGASGGRSSAGGTAPTASAAGPRPSSAWSSWPCSGAPSPSSSSPSPSSNRPRPAPTTPSSHASTSPRPPTPRPRRGRRSSSCPTTPRSPSPCATPTCTTASLRGRRGFSFNGTRFESGNRSDLDAHGRRHVPSRGAVGRACQTAGRRRGGKQKEAAFLE

SEQ ID NO: 109883 - protein, 245 aa, Triticum aestivum
  Clone ID: PAT_TA_4301.pep
ARFSRWFVPLPSSSHARSSDRRGSLALHAAASPPGSARRLGIPAPPPRRPMAALLAPAISGEVGLRLLLAPLSSNVVIRTASCAVGIGLPVYSTYRAIEKKDQDEKERLLLYWAAYGSFSIVESFADKLVSSVPLYYHAKFAILIWLQFPSNGGSKHVYRRYLRPFFRKHQAKIDRILNILSKELTKFVSNHEDEIRFVENMAIRGATTANYIVNGLDQPGQSEEVSVTEDPNPTPTEEPDTPRS

SEQ ID NO: 109884 - protein, 114 aa, Triticum aestivum
  Clone ID: PAT_TA_4302.pep
FRSGRPGRPQGSWIVRQSVGSTPCLLGKAVDCSYIRGPEYIEVDVDIGSSAVANGVLGLVFGVVTSLVVDMAFLIQANTYDELPEQLIGAARFSHIEPSAAVVPVLDDTSSAVE

SEQ ID NO: 109885 - protein, 199 aa, Triticum aestivum
  Clone ID: PAT_TA_4303.pep
MGGSTNLPPGFHFFPSDEELVIHFLRRKAALLPCRPDIVPTLPQNRYDPWELNGKALQAGNQWYFFSQATQSRTSRNGCWNPIGADEAVSSGGSHVGLKKTLVFSIGEPFQATKTNWVMHEYHLLDGNGGTSSSGSSRKRSHKKKDHPDKECSNWVVCRVFESSYDSQVSFHEEDMELSCLDEVFLSLDDYDEVSLPKN

SEQ ID NO: 109886 - protein, 144 aa, Triticum aestivum
  unsure (1)..(144): unsure at all Xaa locations
  Clone ID: PAT_TA_4304.pep
MAEMPRVETAGDGRVEHLEKFSHYVARQIGFEDASECPHLCKAANNYLRRADNCMTDVXGLLGRRPGXPDALYVKLGGTSWERCILRYFAFXLGTIPPPPSPRPCSVDSANKRKFRNGVLQANRKQRPERITDSKPCFSTWGTN

SEQ ID NO: 109887 - protein, 106 aa, Triticum aestivum
  unsure (1)..(106): unsure at all Xaa locations
  Clone ID: PAT_TA_4305.pep
MGGDHGGHGPSGGDFRQKVWSMTGGPYCRPVHWRRNTAIAMVGILXVCIPIAMKSAXLEQRPHHPXVRPIPSQLWCKNFGQEGILKDVPTFKDKASFYLCCSLLLS

SEQ ID NO: 109888 - protein, 275 aa, Triticum aestivum
  unsure (1)..(275): unsure at all Xaa locations
  Clone ID: PAT_TA_4306.pep
LAPPLGTPRDPPRPRRPPPPXPPPPPSVPSTSPPPPRPDAXQPTGEMEMKKAPLPAPAFHKEYTLPRARHYLDQHYSLRPPLSKDDYSKKDPTSEMEKKKKAPLPTPHFHKERPLPRAERSPDRRYSPYPPPSMDGCSGKNAGSWPLPPIYYGPPSEAFHVDWRNKDGVVDMEHYSTELFAAMDKHSILSVHRCTRPQFGPNVSAEYVLDPIFEDTFLANPRFSYLLPLIGHKVSSAAEAPNSTTQVGTTTGYWQCDGSIEVPVREVAALKISDN

SEQ ID NO: 109889 - protein, 189 aa, Triticum aestivum
  Clone ID: PAT_TA_4307.pep
VLEVRERWFRVASVARGARRRACGAPRARAARYTPGDTPPAAPRGRYTPRAPPTREQRPPPPCVLIRAGGAHSGGGVRPADSACSSAANALKQRGKRAPPPAALNDRGGTTPSLRRHRPLQRTARNHSWQPRGPATPPPRPPSPRPRPPPTPPQPPRPPRPPPAPRATPRPPPSLLPPPARHSESRGHR

SEQ ID NO: 109890 - protein, 167 aa, Triticum aestivum
  Clone ID: PAT_TA_4308.pep
WFSGSVKELQWRIDSPVVLLPVTLGLLLNTYAKPVVNVIQPVMPFVAMVCTSLCIGSPLAINRTMLLSSQGFLLLLPIVTFHIAAFVVGYWVSKLPLLRQEEPVCRTISVCTGMQSSTLAGLLATQFLGSSQAVPAACSVVIMAIFGLTLASYWGNGLRIRDIGSRF

SEQ ID NO: 109891 - protein, 439 aa, Triticum aestivum
  Clone ID: PAT_TA_4309.pep
SPPARHVLLRPGGPRRGRPPCPRPVPLTVDPLASLEKYHQTAVVPRESILRTEAEWLRSRKADLVVSDVVPVVCRAAADAGIRSVCIGNFSWDSIYAEYIMAAGYPHRSIVWQIAEDYSNCETLLRLPGYCPMPAFRDVTDVPLVVRGLRKSRSEVRKDLGIAESTKVVIFNFGGQPAGWKLKQEWLPDGWICLVCGASDSQEVPPNFIKLEKDTYTPDVMAASDCMLGKIGYGTASEALAYKLPFVFVRRDYFNEEPFLRNLLEHHQSSIEMIRRDFLAGHWKPYLLRALTLQPSYDGPTNGGQVAARILQDIAVGKKCASDKFNGARRLQDAIVLGYQLQRTPGKDVGIPDWYSLNGTEIGAHPIIENTEKVKTAESCCEDFEILHGDLQGLTDTMAFLKSLSGLTGNGLKNSKKPKKKHLFTWGKGPKTPGVTGGD

SEQ ID NO: 109892 - protein, 139 aa, Triticum aestivum
  Clone ID: PAT_TA_4310.pep
PLASGNHLSVSEGSPEACYQAELDRIVEEISFIPDENYLLKGVQLQSVVPVTEVSLDVSTAEMQKVTQEVLASDGDLLSPDKGELTLERNDVLAGGQCQLAVSDGSAKESDVAEAERIVEEKATKSDENSVLNGKDIQS

SEQ ID NO: 109893 - protein, 141 aa, Triticum aestivum
  unsure (1)..(141): unsure at all Xaa locations
  Clone ID: PAT_TA_4311.pep
AEPHGDEPAEKPYLLSAPIDAPAGLLPAPPPPPTSLHNIXPPQPPPPSVVXLPPFASPCPPSPPPPTTRSAAPSPAAPAAPPSPPSSSSLPVPPAPPSPPPPARGPGPALPPRRSPWLSPSPASCGCPSVRVPGRHCILQI

SEQ ID NO: 109894 - protein, 109 aa, Triticum aestivum
  Clone ID: PAT_TA_4312.pep
MAGEKSPRAFSMEELPGHLIGEVLSSGRLAAGDLARLEGTCRALRPLAEQAASRLCAARMACSVIGPAARGELLARCGGSWKKVLRFLQSVEQSFDTVHTSSGNMQVAT

SEQ ID NO: 109895 - protein, 229 aa, Triticum aestivum
  unsure (1)..(229): unsure at all Xaa locations
  Clone ID: PAT_TA_4313.pep
MAVRMFRTKVGSFQHHVRGCVAFSTERPKLVTVGIDFGCKNSRVAIIDSLVPHVVDSEIGRFTPSYVTFTQQNSYLPYKWSLQHLDPVGNYVGYNIKRLIGXNFKDPSVQEMGRRVHFSIIEGPGGEAWVGICGMELSPVCIATAIFQKLKHIVLMDQFHDELQAVISVPAFFDELQKEHIKSAAHRAGFKLLQLIDEPIAAALSSITTEDGIVVAFGMGARSYSATIL

SEQ ID NO: 109896 - protein, 388 aa, Triticum aestivum
  unsure (1)..(388): unsure at all Xaa locations
  Clone ID: PAT_TA_4314.pep
MAPSADVAAPAPTPPLAPLIAAQLKFLLTNSRSXIKVVQIWSGCSSGRYADRFTLGIPFCLDYVYWDFLPIMAMQPQSAPQAVIFGQRDLQKTALVDYDESGNGGKSCLAHWDYRDPGGLLCLVEELRLLYIEYQKKLVEKVDDARLKFEISTVLAKEGIEVSVVSSTGRSDEVKFAVPLLDLDLKMMVPGCPWKLPQKIHLQAIFPVSSSYLSVPSAPGLKLTSTPDLKSFFSVDGVKLPAWVDGMCMAEYIPTLEEDLKLQVVDASASIGCRRRFIEALAPAFGRPLEADPIFCRKATVLSISGIFTFLVHFVIPLQFPKQQPILTLQSCQHCNSQGIPITSSPKNSYPWSPRWEVTEMAERIYDYLADECQNFKKLCSDGFPQAK

SEQ ID NO: 109897 - protein, 101 aa, Triticum aestivum
  unsure (1)..(101): unsure at all Xaa locations
  Clone ID: PAT_TA_4315.pep
HEARLFPSLDLHQSYLPTPAAPPTILRLPPPSPPRSYPDAAPSASPPNAPXLTPALTTEAYSCRRARTLAASPPTPQPPLPPPHPTSTHPHEAPRPLRRVA

SEQ ID NO: 109898 - protein, 182 aa, Triticum aestivum
  unsure (1)..(182): unsure at all Xaa locations
  Clone ID: PAT_TA_4316.pep
MALSLSPSVISSSQETSEISGQMAPFRVFQNGASLFQGLVDRARKTVRGSADDIGWLQRTQGLPAAEDGTTRFLEILDSVRKNEHKLPDAVVYLLVPGLFSNHGPLYFVKTKAYFSKMGLVCHIAKIHSEXVKTKSTRPRKEYIEEIYWGSRKRVLLLGHSKGGVDAAAALSLYXXQXXKQG

SEQ ID NO: 109899 - protein, 204 aa, Triticum aestivum
  unsure (1)..(204): unsure at all Xaa locations
  Clone ID: PAT_TA_4317.pep
MASSSSCPPPSPRLSHLLPVLVAAVVLLGRGGEARQPAPLHGVVRSMAFDEGYTQLFGSGNLALRREGKRVHLALDESTGSGFASQDLFLHGFFSAAVKLPADYAAGVVVAFYLSNADAYEKXHDELDFEFLGNVRGRDWRVQTNVYGNGSTGAGREERYDXXFDPTDDFHHYSILWTQHRIIFYVDXXPMREVVRXXXMGAAF

SEQ ID NO: 109900 - protein, 120 aa, Triticum aestivum
  Clone ID: PAT_TA_4318.pep
KHLSHAYGTLAERVAAIAQNEGLGKRLAHGYPFLEARGPGRARPGYCESAVDFVARRCRLAFLDTDAAGRALPRIIEILASEHKWDKARRKLEQQKGIEFLETFKSSKNAQFRDGKHNGQ

SEQ ID NO: 109901 - protein, 67 aa, Triticum aestivum
  Clone ID: PAT_TA_4319.pep
MWRLKIAEGGADPWLRTKNAHVGRQVWEFDAAADDPDALAVVDAARREFGVRLHQLKHSADLPMRIQ

SEQ ID NO: 109902 - protein, 236 aa, Triticum aestivum
  Clone ID: PAT_TA_4320.pep
AFPPNPKEHVGVPSSALCRPASLSPLDLFITGLSMLFDGFFLSRGVRERERARGTGTGEETAGAADEQTGDNDSPAAVVDVGPHLADCGLVRARPAGCGRGVDVVSVAVWPAIRACVGVYRELAPPSRCSGADGDSTALPVAYSLSPDLVVLCAVRPRAPVVGACLPFFRPSPAVPIYLEPLLIIKVNLNVFTNFDHVNDGHAISFQGDLTFYHDQFEKAICNADHGTVEVQIGYR

SEQ ID NO: 109903 - protein, 124 aa, Triticum aestivum
  Clone ID: PAT_TA_4321.pep
PLGEWRILAFRVSITRPHGIAGANSSNTSVSWATTRELSRTMLRATRMRCGGGSARASRRHPRKYLDHATMTTGRRRAREHLLTPDEPFAAAPPSPAVGCGVPAAGVSRRGRRRGRPLGPRRPR

SEQ ID NO: 109904 - protein, 70 aa, Triticum aestivum
  Clone ID: PAT_TA_4322.pep
IASAQGLPLIILLNCGSQGCSKLPIEVVDSYPLFCLYKNEFCGSNSELPYLKELQLLLHVKFSVLVWTIR

SEQ ID NO: 109905 - protein, 274 aa, Triticum aestivum
  Clone ID: PAT_TA_4323.pep
MPRSLAGDLTDPEMAQPYMKKDDDDSDIEYSPFFGIEKGAVLQEARAFHDPQLDARRCSQVITKLLYLINQGESFTKVEATEVFFAVTKLFQSNDAGLRRLVYLMIKELSPSSDEVFIVTSSLMKDMNSKTDMYRANAIRVLCRIIDGNLLTQIERYLKQAIVDKNPVVASAALVSGIHLLQANPEIVKRWSNEVQEAVQSRAALVQFHGLALLHQTRQNDRLAVSKLVSSLTRGSVRSPLAQCLLIRYTSQVIRESSNTQSGDRPFFDYLESC

SEQ ID NO: 109906 - protein, 131 aa, Triticum aestivum
  Clone ID: PAT_TA_4324.pep
LLPVASSKLQFNPPAASTPSSSGALRLWHAPPRPRAPLRPRQLQGLRLRVLLDPHLLRLKEIEPRRTCTVCDIDRGFAETRLFVVVVLDSTARWRRKAWLPVCIQAKHSWMVLLRSGISPQNIVGKKTRRR

SEQ ID NO: 109907 - protein, 113 aa, Triticum aestivum
  Clone ID: PAT_TA_4325.pep
MRKSSEISMKASSSMASDASGNTDPGQQGARFSSMDQSCFARPGQSIPGYPPFFGPQSSNFYLPDDSVAKACDPFEPNPPQNNPVADWDPQAMLSNLTFLEQKIKQVKDIVQS

SEQ ID NO: 109908 - protein, 222 aa, Triticum aestivum
  Clone ID: PAT_TA_4326.pep
DITVVVGEQSFHLHKFPLLSKSGLLERLIREKIEKGEDSCAIDLSDIPGGAKAFELAAKFCYGVKFELTSSNVVHLRCASEYLEMAEEIAEGNLIAQTENFLTQTVLKSWKDSIKALHTCDDVIDLAEKLQVVKKCGDSVATKSSTDPDVFGWPVAQYGGPTQSPGGSFLWNGISTGARPRNCSSNWWYDDVSCLSLPLYKKVISAMEYRGVNQDIIVGSLN

SEQ ID NO: 109909 - protein, 139 aa, Triticum aestivum
  unsure (1)..(139): unsure at all Xaa locations
  Clone ID: PAT_TA_4327.pep
LPSLATTHSQGGCLAAAATAGAAPAASAATAAAGARCSPTWRPPPARPPWSCPPPPTRGAPAGSRWPAGRPAAATAPPASAAPRAAAPAAAATEPAHRRPAGRGEHEDEXRRSKQSSSPPPPPSVSVPLAAACARARAK

SEQ ID NO: 109910 - protein, 219 aa, Triticum aestivum
  unsure (1)..(219): unsure at all Xaa locations
  Clone ID: PAT_TA_4328.pep
MQHAPARALNKIKPPSLVFHLNSVVPVRLARSVRPASSLLTASSSRFLVSFPPPTGQGGCLAAAASAGAAPAASAATAAAGARCSPTLRPPPAPPPWSCPPPPTRGAPAGSRRPGRPAAATAPPASAAPRAAAPAAAATEPAPRXAGRGEHEDEEEDKQASTIVTQRISLITSRCMQHAPARALNKIKPPSLVFHLNSVVPVRLARSVRPVCPSSCLHF

SEQ ID NO: 109911 - protein, 171 aa, Triticum aestivum
  unsure (1)..(171): unsure at all Xaa locations
  Clone ID: PAT_TA_4329.pep
AGRSGTLDRRWKLPSYTPSTPASSLLTVAASSQSSPSSPRHHPPRKGGCLAAAATADAAPAASAATAAAGARCSPTLRPPPAPPPWSCPPPPTRGAPAGSRRPAGRPAAATAPPASAARPAAAPAAAATEPAPRRPAGXGEHEDEEDNWTSNHXPPPPPSLAAACARPRAR

SEQ ID NO: 109912 - protein, 163 aa, Triticum aestivum
  Clone ID: PAT_TA_4330.pep
APPGGNQPASTPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 109913 - protein, 192 aa, Triticum aestivum
  Clone ID: PAT_TA_4331.pep
HRLTHCKFLPGISTNTWWTPPTQLDPDQTNQCDRPFRDQKGLGFSGVPTPGRHCPRWGRSLGHHLRRGGSSRVLLLLVVERAAEQHDVRLRPVDGVVHPPAALLHAQRAPLVLGEEAVLGEELGDFRREDHVPVLEGVVEVLLGVLDLAHVHRRRSSIEALGAGGGAGGGAGSVGDGRRRRGRGRGDERARG

SEQ ID NO: 109914 - protein, 98 aa, Triticum aestivum
  unsure (1)..(98): unsure at all Xaa locations
  Clone ID: PAT_TA_4332.pep
CYTVVXSLTQEEQAWSKCLLEHTRKSSITNILNSRFHISATPSGIVHVIRRFSSMPQFLHLPGFPGFFGASSLSRQVVRLCPSQRHMLQNLLHLLRPS

SEQ ID NO: 109915 - protein, 175 aa, Triticum aestivum
  unsure (1)..(175): unsure at all Xaa locations
  Clone ID: PAT_TA_4333.pep
PPARLLGRTPALRRAAPEARASQQRLPVPASDPSRPPAPSGAGRPLGPPGRELPRRRRRAPLQAPGARPGILPPPLPEPARRGGPAPGAVPRQRAPPPRRRGPRPLPPAAQRALARGPPPARHLPAPAPPARPCPAAAPWWLFLPVPXPGCHPPLRGRPRPSRGRRRPHASRAFF

SEQ ID NO: 109916 - protein, 181 aa, Triticum aestivum
  unsure (1)..(181): unsure at all Xaa locations
  Clone ID: PAT_TA_4334.pep
MTALAKPAASAPKPSAAKPKAAAAGASHPTYFEMIKEAIAALKDRTGSSSVAIAKYIEEKHGKALPANFKKMLSVQLRASASKGKLVKVKASYKLSDAAKKDAPKPKAKPAAPKAAAKPAKDAAKPKKKAAVKPKKAAAAAGTKRKAPEKKTLVAKAKKSPAAKAKAKPKTVRSPAXKXXR

SEQ ID NO: 109917 - protein, 55 aa, Triticum aestivum
  Clone ID: PAT_TA_4335.pep
THTLGCPYISLLIWSLTIVPILVPNTMHALHPYMHPLHQLRQPWRGPSSDEHLHT

SEQ ID NO: 109918 - protein, 181 aa, Triticum aestivum
  unsure (1)..(181): unsure at all Xaa locations
  Clone ID: PAT_TA_4336.pep
LCCGSHASHLLHSFGIHIGHGTFLDVLHNSYVKCGLAMVALFGPGRDILFDGLRAFKQGSPNMNSLVGFGSAAAFAISAVSLLNPELAWNSTFFDEPHXVMLLGFVLLGRSLEESARLKASSDMNELISLLSPQSRLVITSSSDDLPSDGILNSDAITVEXVPVDDVRVGDQYKSSRRNIL

SEQ ID NO: 109919 - protein, 218 aa, Triticum aestivum
  Clone ID: PAT_TA_4337.pep
MAAIAGRAYEDFVPPHNMVTEPATHTLSVDLTAAGYKKEHIRVQLVRSHGLVVVRGERAVAGNRWSRFRLEFRVPDGCDLKGIHARFEGGVVRVTMPGLRTAVGDVSGKQVPPAAKADASGVGAGDKEDENVQKHPAEERGADAVKDSARLDQGQDSGRLDQGQGTPADGVRGVESPATSSGRGYSYLPERRKLVTTVVGAVLVLFSLGIYVRYSFGP

SEQ ID NO: 109920 - protein, 297 aa, Triticum aestivum
  unsure (1)..(297): unsure at all Xaa locations
  Clone ID: PAT_TA_4338.pep
MARKHGWQLPAHTLQIVAITVFFLLVVAFYAFFAPFLGTQVLEYVAIGIYTPMALAVFILYIRCTSINPADHGIMARFEDGFVDVPANSDGLEGINLPQKANSAIGTHSPTSTCRSSLDGHSNHRGTSIGEANVNVSSQLPKKRSSCFLFGGLVCALFVMEDCRKPDDSEQQANGEEALFCTLCNAEVRKFSKHCRSCDKCVDGFDHHCRWLNNCVGRKNYFTFIALMAISLLWLAIEFGVGIAVLVLCFVDKNSPRILQEKLGNGLTRAPFAVIVGVFTLLSLVACVPXGELFFFT

SEQ ID NO: 109921 - protein, 110 aa, Triticum aestivum
  Clone ID: PAT_TA_4339.pep
PAGMRVAAGEHAAHPNSSGELACRAPPGRRPGDRRRGAMARKHGWQLPAHTLQAASGGGVLWCSWRLRGGSDGDRLPSEGKGADLPSPVSIHWRGHHRLDLHPFRRCAMS

SEQ ID NO: 109922 - protein, 101 aa, Triticum aestivum
  Clone ID: PAT_TA_4340.pep
IIAIRRAVPDENDHLNDLLQEEEDLVSAHRKQVEETLDMIKEEMNLLVEADQPGNQLDDYVTRLSGILSQKAAGIVDLQDRLAQFQRRLNENSVLLYSECP

SEQ ID NO: 109923 - protein, 148 aa, Triticum aestivum
  Clone ID: PAT_TA_4341.pep
MTEAMNTSVENPWRLPPSSQTTTFPLSSYAPQLGATSDLGQNNNSSSSNSAVKSERQQQQQPLSFPGCGDFGGGGAMDSAKQENQTLRPFFDEWPKTRDSWSDLTDDNSSLASFSATQLSISIPMTSSDFSAASSQSPNGMLFAGEMY

SEQ ID NO: 109924 - protein, 164 aa, Triticum aestivum
  Clone ID: PAT_TA_4342.pep
MAAFTTTAAAAPAAYAVARSPAPSPSQWAPTRRSPPAVGLRRAAAPPRRGAALLVKAKKETFSTFDELLEKSEKPLLVDFYATWCGPCQYMVPILQEVHEKMSDKINIVKIDTEKYTSIANKYKIEALPTFIIFKDGEPCYRFEGALPADQLILQIESALEAPK

SEQ ID NO: 109925 - protein, 175 aa, Triticum aestivum
  unsure (1)..(175): unsure at all Xaa locations
  Clone ID: PAT_TA_4343.pep
SGSSPSSRAPLPGHPAVPLLLVRRPSGITPRDLECMLCDETAEPKPLPLSLLEEITGDFSPQQQIGXRGGFAVVYEGMLENRSVAVKRMSNTYVYEKEFLREVECLMMVKHKNVVRFLGYCADTQGSMEKYDGKFVMADVQQRLLCFEYLPKGSLHEYITDTSSGLPWRDRYRII

SEQ ID NO: 109926 - protein, 274 aa, Triticum aestivum
  unsure (1)..(274): unsure at all Xaa locations
  Clone ID: PAT_TA_4344.pep
WSLESTPPPLPLPAAPALGRRPLSILRPPAAAALRRPAPPRRRSPAPGSPRLPAAPAPAPAQLPRSLPRPADAAAAPAELPLGPPQRGYSRFVGRFTPLAPEQLGSILDVERAKGLSPEHLVAAWDDYHLGRGHIGVSMXANLYRLLGRKSATCPYFVIPFWRGSGFAAMIVQGKLARMIYTGLEDXKARGTQASPYYTVTHFTEFAETKDTVLVRGDVVFTSKLTDAEAKCLLETAHSFYLNDVRYKLVERFNKETHDFEFKDVLQALEMPSM

SEQ ID NO: 109927 - protein, 821 aa, Triticum aestivum
  unsure (1)..(821): unsure at all Xaa locations
  Clone ID: PAT_TA_4345.pep
HHGHLPASFAEQPSNSKYGVEQMKPQPQQPKMVRMYSAASQQPMDYALKETSPFLGGGQIVGGRVIGGEKHASTYDLVERMQYLFVRVVKARDLPNMDITGSLDPFVEVRVGNYRGITKHFEKQRNPEWNAVFAFSRERMQASVIEVLVKDKDLVRDDFVGMVRFDLNDVPVRVPPDSPLAPEWYRLVHKDGDKSRGELMLAVWIGTQADEAFPDAWHSDAATLEDPSAVTHMKSKVYHAPRLWYLRVNIIEAQDILIHDKTRYPDVFVRAQVGHQHGRTKPVQRGNFNPFWNEDLMFVAAEPFEDHLILSLEDRVAPNKDETLGRIIIPLTMIDRRADDRIVHGKWFNLEKPVLVDVDQXLKREKFSSRLHLRLCLDGGYHVLDESTNYSSDLRPTAKQLWKPSIGLLELGVLGAQGIVPMKTRDGKGSSDTYCVAKYGSKWVRTRTIMNNPNPKFNEQYTWEVYDPATVLTIGAFDNGQLGERHGDKPSSGKDAKIGKVRIRLSTLETGRVYTHSYPLLVLHPSGVKKMGELHLAIRFSSTSLVNMLYLYSRPLLPKMHYARPIPVLQVDMLRHQAVQIVAARLSRMEPPLRKEVVEYMSDFDSHLWSMRRSKANFFRLMNVFSGLFAISKWFSGVCAWRNPITTVLVHILFIMLVCFPELILPTVFLYMFLIGIWNYRYRPRYPPHMNTKISHAEAVHPDELDEEFDTFPTSRSQEVVRMRYDRLRSVAGRIQTVVGDIATQGERVQALLSWRDPRATAIFVLFCFIAAIVLYVTPLQVLAALGGFYAMRHPRFXRHRLPSTPVNFFRRLPARTDSML

SEQ ID NO: 109928 - protein, 176 aa, Triticum aestivum
  unsure (1)..(176): unsure at all Xaa locations
  Clone ID: PAT_TA_4346.pep
MADRANHPSVMQKFGGQFHLASSFSEGVRARNICPSVPSYERRFTTSCYMTQNLGISVPMMSSSPLFANAPPEKXSVKNFAIDFLMGGVXAAVSKTAAAPIERVKLLXQNQDEMIKAGGSLTIQGFVTVLPHIRIRLAHVEKNTVKYRTSTRFEFVRILQGFTLKERRTGRVGNLL

SEQ ID NO: 109929 - protein, 99 aa, Triticum aestivum
  Clone ID: PAT_TA_4347.pep
NHVANRKPERFAPPGGLSRGGLERNARIEVPGHQRAGRAQRAGGQGAGCVRRRRPAAGPGAVGGPRRARAASRRGAPDPGKRNRAPRTEPGAGRGPRAA

SEQ ID NO: 109930 - protein, 169 aa, Triticum aestivum
  unsure (1)..(169): unsure at all Xaa locations
  Clone ID: PAT_TA_4348.pep
TIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKXPFVPISGVEGDNMIERATNLXLYQGPTLLEGFDQKNRAKKPLNKPRGFPFGT

SEQ ID NO: 109931 - protein, 384 aa, Triticum aestivum
  unsure (1)..(384): unsure at all Xaa locations
  Clone ID: PAT_TA_4349.pep
MKDGNIHDKDTERDDNISRSWKSSHPVGRGRGDSSYHPSQISQKPPSLYGYGRGKPDNEITGFSGSRGKFTPSSGSTNAGSTGSSRPFHLGRLAGSPGGPSGVRSEVRCGRMKLLDIYRTTSHVTDFKMPFDVCEEGSAFMQEEMLEPSALFAPTTDEAVILKAIDKGEIINSGVHLGSKDGSVGKSNPDVVPSKQPKLGGRDDQPGSADDLKGETAGSLRGVPGNVDSLRTETPSYVVPQRSRFIGDHRLGPTDFPQQMPNVFDQESKVVGMTGVDELTSPIQPYPNPENLSLYYKDPQGRIQGPFSGADIIGWFEASYFGIDLLVRVANAPPDAPFLMLGDVMPHLRAKXGPPPGFCTTKSSDLLMPETPPTGKFVSFQYLT

SEQ ID NO: 109932 - protein, 213 aa, Triticum aestivum
  Clone ID: PAT_TA_4350.pep
MLLTAGGQGPVGEGSRSKRKKKVVKKVVKRVAADGTSADPWAWRKYGQKPIKGSPYPRGYYRCSTDKACEARKMVERCRDDPNSFILTYTGGEHSHPAPAHRNSLAGTTRNRQQAPEPAAGQSAPAAKAKEESSSAAAEPSPAQSTSGGMSPTTPLRTPSMEEYNQDSKFDEAAGGASQPAMDVEKDREDELLKILEGCVHGGQLPHCRRGKR

SEQ ID NO: 109933 - protein, 177 aa, Triticum aestivum
  unsure (1)..(177): unsure at all Xaa locations
  Clone ID: PAT_TA_4351.pep
FXNKXFGGGARNTKGASEEHTPPKGQPRQDPGYTGWRAKRLKMLPRPQRRQAVRQMVDQGLANHCFQSLRPQTVLSDGSLLARFASVLNSCPGRRASVAQQSTRQHQGQACKALAHPPTYHLPWLVHRRRHRPSYHPSYHRLHQLPSFYFGKQHLLEHACSLASQSTNSCFAGILHA

SEQ ID NO: 109934 - protein, 231 aa, Triticum aestivum
  unsure (1)..(231): unsure at all Xaa locations
  Clone ID: PAT_TA_4352.pep
KVPASLLDSGSKRRTRIIVSVVIVLAVVLAACGFLLWKCRRRIREKLGVRGGKKRAGAALMLRPATMKAKHDLSGPKQPDQEVAENGDGCELPMFTLETLAAATGGFSEANKLGEGGFGLVYKGSLPGGEEVAVKRLSRSSGQGCQEFKNEVTLISELQHRNLVRILXCCIHGHEKMLVYEYMPNKSLDAFLFXPARRGLLDWKTRAPIIXEGSRRGLLDLQRDSSFPVVP

SEQ ID NO: 109935 - protein, 162 aa, Triticum aestivum
  unsure (1)..(162): unsure at all Xaa locations
  Clone ID: PAT_TA_4353.pep
HPPRAYRSLRRRRYTSGVGREVLVGDGCSRSLSIWPPSQRTRDAVVRRVVQTLSAPSVLSQRYGRPSLSPERXAGAASQPVRCASWAFAAASGGPACRPPHLPGRDGIXEVLQAYSKEXVSRRLLELAKSRAAAAAATETPAEPSAEESEGSSVTAPPPTEE

SEQ ID NO: 109936 - protein, 133 aa, Triticum aestivum
  Clone ID: PAT_TA_4354.pep
SLEPSAAAATSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 109937 - protein, 206 aa, Triticum aestivum
  unsure (1)..(206): unsure at all Xaa locations
  Clone ID: PAT_TA_4355.pep
MSHRRVEACDSWRPPPAPAHAPALLLRAGNPWGRSYPPCAFASLSVREGGVKAEDVGEEKERTLAQAAAEVSGTKGKMPPVAQLLKHPLALLALVPSSVALFAAGAGAGAVAKTVTAPLDRVKLLMQTHSVRMAGESTXGIGFVQAMAEIGKEEGIKGYWKGNLXQVIRIIPYSAVQLFSYEVYKKVFRRKDGEPTGFGRLAAWAC

SEQ ID NO: 109938 - protein, 129 aa, Triticum aestivum
  Clone ID: PAT_TA_4356.pep
PPLVRRPWQPKPAEGSSADPPPPSLLQCSRPPMAPAHAPGGGDDVTVAECPICMEELVDNNNRGLVTRLPGCLHSFHESCIAQWFCRAATCPCCRRDMPTYSMCTYPLPSYYPERVITIALPIPRRPQQ

SEQ ID NO: 109939 - protein, 254 aa, Triticum aestivum
  unsure (1)..(254): unsure at all Xaa locations
  Clone ID: PAT_TA_4357.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEENXXXVSSYLKKVATPLTRSLLPISGFEVTTLLKVNNPDWYXGPTRLEALNXITNPKGPKQTPRLPLKVVTKWGIWTCAFWPVKTG

SEQ ID NO: 109940 - protein, 152 aa, Triticum aestivum
  unsure (1)..(152): unsure at all Xaa locations
  Clone ID: PAT_TA_4358.pep
AEVFDMVKDLKVIFGKGPGGQSVPKGADGHAAMWKKKSIFWELEYWKVLEVRSAIDVMHVTKNICVNLLSFLGVYGKTNDTKEARQDQQRLKDPDDRHPEWFQGRASYALTKEEKVIFFECLSSLKVPSTFSSNIKGIINMAEKKFXNLKSH

SEQ ID NO: 109941 - protein, 217 aa, Triticum aestivum
  unsure (1)..(217): unsure at all Xaa locations
  Clone ID: PAT_TA_4359.pep
STTRPAAGASGGLIVPKKEKKREXRHRLMRKLGRSKSESAESQTHRQPGLVGLLEILRAQLEITESMDIRTRQGLLNAMVGKVGKRMDNLLIPLELLCSISRAEFSDMKAYLRWQKRQLNMLEEGLINYPVVGFGELGRKVNELRNLFRKIEESESLSPSAAEVQRTECLRSLREVATSFSERPARGDLTGEVCHWADGYHLNAACMKKCFAVFLTP

SEQ ID NO: 109942 - protein, 420 aa, Triticum aestivum
  Clone ID: PAT_TA_4360.pep
MGATEPQWVLMATGRSPTNIAVIKYWGKRDEALILPVNDSISVTLDPDHLSATTTVAASPSFPSDRMWLNGKEIALSGGRFQSCLREIRKRARDVEDEKKGIKIKKEDWEKLHVHIASYNNFPTAAGLASSAAGLACLVFTLGKLMNVNEDYGELSSIARQGSGSACRSIYGGFVKWCMGKNDDGSDSMAVQLADESHWDDLVIIIAVVSSKQKETSSTSGMRDTVETSPLLQYRAQTVVPSRILKMEDAIKNRDFESFARLTCADSNQFHAVCLDTSPPIFYMNDTSHRIISLVEKWNHSEGTPQVAYTFDAGPNAVLIARNRKTGTLLLQRLLYTFPPQENDLDSYMLGDKSILSDAGLQSIADVEALPAPPEMKAPNQKFKGDVSYFICSRPGAGPKVLTDESHALIDSATGLAKGV

SEQ ID NO: 109943 - protein, 170 aa, Triticum aestivum
  unsure (1)..(170): unsure at all Xaa locations
  Clone ID: PAT_TA_4361.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTXNVSIYKAQASALEAHAAPNCKVLGGANPAXTNALILKEVAPSIPEKNNNXLTRLDHNRALGQDF

SEQ ID NO: 109944 - protein, 104 aa, Triticum aestivum
  Clone ID: PAT_TA_4362.pep
HEKPHDPALLMYFLDSGGGSYPEVVSCAQVTWFHSQARFLNPDGRIPELVFWHIPSTAYVKVAPKATSEVRKPCVGSLNEEDVAPQVAEWGIMCSLSLSSCMIR

SEQ ID NO: 109945 - protein, 204 aa, Triticum aestivum
  unsure (1)..(204): unsure at all Xaa locations
  Clone ID: PAT_TA_4363.pep
MAFDFDHERLCALKAFDETKAGVKGLVDAGITAIPSIFHHPPESFAPLAPFSTDVAIPVIDLSGRRSEVVSTVKAAIEKLGFFLVVNHGVPEVAMSNMLSVVRGFHEEPAEAKEIYYTRDEERQVKYSGNADLFRSPAAKWRDTMYINDADRLAEEILPPVCKGVVPEYTRLMRXLGRFLVGIVSEASGVAAWIPGRTKPGWPR

SEQ ID NO: 109946 - protein, 244 aa, Triticum aestivum
  unsure (1)..(244): unsure at all Xaa locations
  Clone ID: PAT_TA_4364.pep
MMPGSAPPAAGSGMFVPTQTAGTVLCCICGVSMQPNPANMCARCLRARVDITEGVPRNAAVVYCPDCFSYLQPPRSWLRAGPESPELLQILLRRLKHPLARLKVSLSGAEFVFSEPHSKRLRLKLRLRREVLNGIVLEQTHPVEFVVHDRLCDSCARAQANPDQWVAVVQLRQHVPHRRTFLYLEQVLIKHGQAALAIRVGSAXPGGLDFFFGSRLHACRLGDFFGTVGPIPXPTQAKQFVSHD

SEQ ID NO: 109947 - protein, 262 aa, Triticum aestivum
  unsure (1)..(262): unsure at all Xaa locations
  Clone ID: PAT_TA_4365.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRGGVIKNREKHKGTXETITVKMRQAHQLAPGWATWFPIGRGTQPGXSPPQGTGIRVPLFEDHRNREALSQLF

SEQ ID NO: 109948 - protein, 60 aa, Triticum aestivum
  Clone ID: PAT_TA_4366.pep
GDANLLKSKFQRAIQKNLNPLFKVSYVKIVPEFPRTASNNLLRRVLRDQLKKELANRSKL

SEQ ID NO: 109949 - protein, 123 aa, Triticum aestivum
  Clone ID: PAT_TA_4367.pep
QGPGRAAARRNHGGIKTSSVEIERVCNGADEGLLETAAVSIKPSGGGPEQLAILAVLKDRSTSYDANILKSKFQRSIQRNLNPLFRVSYVKVVPEFPRTASNKLLRRVLRDQLKQELANRSKL

SEQ ID NO: 109950 - protein, 224 aa, Triticum aestivum
  Clone ID: PAT_TA_4368.pep
MASSLFILALLLTVAATNAATITVVNKCSYTVWPAAIPVGGGTKLEPGQLSTIHPPAGTKSGRIWARTGCKFDASGKGSCTTGDCGGVLACRAGGKPPASLAEYTLGTGSNADFYDISLVDGFNVPMSFGPVGGSCRAVSCAADINAKCPSELKVDGGCMSACGKFGTAQYCCPPPSTPSTCGPTNYSRFFKGLCPDAYSYAYDDKTSTFTCASGTNYQLTFCP

SEQ ID NO: 109951 - protein, 136 aa, Triticum aestivum
  Clone ID: PAT_TA_4369.pep
MAPKAEKKPAAEKKPVETEKKPKAEKRVPGKDGGADKKKKKAKKSVETYKIYIFKVLKQVHPDIGISSKAMSIMNSFINDIFEKLAGESAKLARYNKKPTVTSREIQTAVRLVLPGELAKHAVSEGTKAVTKFTSS

SEQ ID NO: 109952 - protein, 205 aa, Triticum aestivum
  Clone ID: PAT_TA_4370.pep
AIHLADVRPGHPDHADVSNHDMLGTLIQSKEESVASMVYHYKHGFSGFAAMLTQDQATRLAEFPEVISVKPSRRVRTTTTRSWDFLGLNYQSSHTPASELLQMSNFGEDVIIGVVDTGIWPESRSFSDVGYGPVPARWKGECQTGPDWGINNCSRKIIGARFYTAGVPDEYLKRDSLSPRDHYSHGTHCASTAAGSAVGVDGEEA

SEQ ID NO: 109953 - protein, 103 aa, Triticum aestivum
  unsure (1)..(103): unsure at all Xaa locations
  Clone ID: PAT_TA_4371.pep
MSGRGKGGKGLGKGGAKRHRKVLRDNIQGITKPAIRRLARRGGVKRISXLIYEETRGVLKIFLENVIRDAVTYTEHARRKTVTAMDVVYALKRQGRTLYGFGX

SEQ ID NO: 109954 - protein, 259 aa, Triticum aestivum
  unsure (1)..(259): unsure at all Xaa locations
  Clone ID: PAT_TA_4372.pep
MGHFAFNWQGMEPAPAASLSGAGATLPLHSVQGAAAATNSADASYCLDPATYAPAVLPTIPPAVAEVGAKRRQDAENIALYLIHILHKCAEAIEAGDYAVAAGKLSEARTILATSVSTTTGIGRVASHFAAALAHRLFPASPHSSFTQDASPERAGELYRQFYDAGPYLKFAHYTANQAIXLEAFEGCDRVHVVDLAIKQGXQWPALIQALSRPXRGPASVRINRXXFRPRRRRSLASAWPKLARAMNVPFSVQKGTRG

SEQ ID NO: 109955 - protein, 207 aa, Triticum aestivum
  unsure (1)..(207): unsure at all Xaa locations
  Clone ID: PAT_TA_4373.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGIXKDGQTREHALLAFTLGVKQMICCCNKMDATTSKYSKARYEEIVKEVSFYLKKXGYNLXKVPFVPISGFEGEHMIERSTT

SEQ ID NO: 109956 - protein, 279 aa, Triticum aestivum
  unsure (1)..(279): unsure at all Xaa locations
  Clone ID: PAT_TA_4374.pep
GIHGLGKEATALFLDMNNHACEPDGVTFICLISACSHSGLVTEGKHWFHMMAHKYGITPRMEHYISMVDLLARGGFLDEAYQFIQSMPMKADVRVWGALLAACRVHKNIDLGKQVARMIQKLGPEGTGNFVLLSNMFSAAGRFDEAAEVRIIQKEKGFKKSPGCSWIEINGSLHAFIGGDRSHPRSPEIYQELDNXLVDINKMGYQADTXFVLQDLEEEEKEKALLYHSGKLAITFGVPTLNEDKTILXTKNLRXCGECHTVIXYMNLVRKKDFIGKKA

SEQ ID NO: 109957 - protein, 131 aa, Triticum aestivum
  Clone ID: PAT_TA_4375.pep
FDTLKERHAKRNPEDLIIDYDDQFPSEEDEEAPGSDEDSLVPYASDTQELSLFHESGEEEEEPIRADLGGGWGRIIYSPIRRGRQVQMDVCRATKRDASEGAFERVVVTQSKNPALHLQARKSLWGDLWPF

SEQ ID NO: 109958 - protein, 271 aa, Triticum aestivum
  unsure (1)..(271): unsure at all Xaa locations
  Clone ID: PAT_TA_4376.pep
MASPKACMSTYLIAVLCLVTGAHSAKAFNYVDALDKAVLFFEAQRSGKLPPGQRVAWRADSALSDGNASNVDLVGGYYDAGDNVKFGLPMAFTVTMLSWSVVEFGGEMPPGQLANAEAAVRWGSDYLLKAATATPGALWVQVADPYQDHRCWERPEDMDTPRAAYKVTPQNPGSDVAGENAXALAAXSLVSRPXDPAYSSKLLRAAWAVFDFADRYRGSYMDSLNSRGVPFYWFYSGFKDELLLAGTGLDPGSSPLPELANVDMNLINFNR

SEQ ID NO: 109959 - protein, 167 aa, Triticum aestivum
  unsure (1)..(167): unsure at all Xaa locations
  Clone ID: PAT_TA_4377.pep
LAAVGPRPSPYFLTAPPPDPAGRPRVRPPRRLEXQPQPVTIAAPTPRPPPPPPTPARSAEDLIDRPPSASSPAPRRPPRPPRRRPRPPPRAPPCPSSSGPPRPPRRPRCCGLPPVRGLIPPPLRPCPRRPCCRPRAPPPGPYPAQAPGRHFYLAVDRLQVQDDGHYW

SEQ ID NO: 109960 - protein, 183 aa, Triticum aestivum
  Clone ID: PAT_TA_4378.pep
RHGDDDEEQQLLRDAANVRPRLVIPPPPMPPRQPLWHSELHHNNWMRQNINRSDIEWEAISDLRADMARLQQGMGHMQRMLEACMDMQLELQRSVRQEVSAALNRFIGEQGEPKETIDDGSKWMNVRKGTCCVCCDTPIDSLLYRCGHMCTCSKCANELVRSGGKCPLCRAPIIEVIRAYFIM

SEQ ID NO: 109961 - protein, 234 aa, Triticum aestivum
  unsure (1)..(234): unsure at all Xaa locations
  Clone ID: PAT_TA_4379.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKAXYEEIVKEVSSYLKKXGYNPEKFPLFPFLGFXGDNMDEKSTNPDWSKGPTLLEXALGQINEPQEALRQA

SEQ ID NO: 109962 - protein, 247 aa, Triticum aestivum
  unsure (1)..(247): unsure at all Xaa locations
  Clone ID: PAT_TA_4380.pep
MQIFVKTLTGKTITLEVESSDTIDNVKAKIQDKEGIPPDQXQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVRAKIQDKEGIPPDQQRLIFASKQLEDGRTPGDYNIQKEXSTFNLVLAFRGGMPNLVEDPGGGRPILWE

SEQ ID NO: 109963 - protein, 120 aa, Triticum aestivum
  Clone ID: PAT_TA_4381.pep
RLFRPAAVGSRIGGLLSRGVNGYDINYVVDGRGLRPVAVVRDGASGRAMELWADQPGVQFYTANGLSGVRGKGGKVYGRYGALCLETQGFPDAVNRPSFPSQIVRPGKVYMHHMVFKFSF

SEQ ID NO: 109964 - protein, 228 aa, Triticum aestivum
  Clone ID: PAT_TA_4382.pep
MTTILSDTGGNVAAVPRAYEWRARYRAGTSYVCALTRRGSTRPARAPWRRARNGSWPVSAAGTSTAPGANCWRPSTRSTVRDAHPDGAARARALATPYYDRGARPPGGEHLREGRRPASSNGSTIYVNDIDHVVDGDARALRKVAAVRDGASGRALELWADQPGVQFYTGNFLQDVKGKGGKMYGQYGALCLETQGFPDAVNHPDFPSQIVRPGQAAYKHDMVFKFSF

SEQ ID NO: 109965 - protein, 257 aa, Triticum aestivum
  unsure (1)..(257): unsure at all Xaa locations
  Clone ID: PAT_TA_4383.pep
ALTAVCGALVPSLPPDGHHLAADKAVRDFFLASAADPPVPDEVAQLMSAMCLREALTLVRTVLWLLGTRLGTLALCGARCLSWSSPFVQRFAEMPVDRREDALRRWSRETMLPPLRLFFLLVKVFCLYVFYSWTDDNSENPHWRAIGYSPPTDEPXEQEDQANTKRPLDDGVVETIHQTDAFLPNQPREKGPRVTXDPARNVGRIECEXVIVGFGFGGGVAPGGFKGGHKVVGIEXGNYFTAGDNTPMRGPRLTSFT

SEQ ID NO: 109966 - protein, 259 aa, Triticum aestivum
  unsure (1)..(259): unsure at all Xaa locations
  Clone ID: PAT_TA_4384.pep
TIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLADYNIQKESTLHXVARLGGGMQIFGKNLTGKTIPFEVRPFAPMTNVRRKIREREGIPPEQEXLIFARKKLGD

SEQ ID NO: 109967 - protein, 149 aa, Triticum aestivum
  Clone ID: PAT_TA_4385.pep
QKHARTLQPTYDKEIHLTEKFCVSTLRSDKRSEKAKDLRDLALIGVDILKARVIAANGKVQKMLHKAKTGTSMARRLTFCKLDYDVTVSITNVCTALLKDFRGPNGGDNDGPASFMLPQCVEQANTLNGYCGHELMDLPGASSAVQRKS

SEQ ID NO: 109968 - protein, 228 aa, Triticum aestivum
  Clone ID: PAT_TA_4386.pep
KDNAPAILFFDEIDGLAVTRGHGSNGISVADRVLSQLLQEMDGLDQKIGVTVIAATNRPDKIDIALLRPGRFDRLLDVQPPDEADREDIFRIHTRSIPCSHDVNLNELARLTEGYTGADIKLVCREAAVAALDENSDIPEVAITHFKSAIDRVSPSDMQFYQELAAPFRRLVDDPDYPKTAGIPTRPPNLFSSFFSSGPWGEPVHLSASPSPPPPHLDSPINRSLNWG

SEQ ID NO: 109969 - protein, 371 aa, Triticum aestivum
  unsure (1)..(371): unsure at all Xaa locations
  Clone ID: PAT_TA_4387.pep
MQAISVTLFMSFLVLLTRGKDVQYRRQEEDNTQILTYHRVNKTIVMKDGDVYDCIDVNEQSAFRHPLLKDHKVQMQPNSFPVWMDIQTLPSDEPSIIECPTGTIPIMCTNGSGTIAAHSYDGQLESAGLIYQGDVYGVRGVLNVWEPKVNKYSKDSSAMCVEMKSGGEQHTDRIGAGVRVFPTLSGDTFVRFHISWYDGLYKKSCIDFSCPGFVQVNHRVGLGARMRPPSCYHXSQTVIHIQIFKDPVSKNWWVXYEHLAIGLLGQCLYSNSLRTKGDAAFWGGIVEGPTASSNSPQMGSGHFASEGYGGAAFVKNIQIANNEKGYFDTPNKSQVRPESSDKSKYTVERFEYSKYVGMRIFYGGLGSYKAY

SEQ ID NO: 109970 - protein, 255 aa, Triticum aestivum
  unsure (1)..(255): unsure at all Xaa locations
  Clone ID: PAT_TA_4388.pep
AVGARPLSARSDSGISPAPWTAAPSRGGAPSPAASARPSGWGASSRDRPPRLRLTAVQALTHPWLRDDQRQIPLDILVYRLIKQYLRATPLKRLALKALSKALKDDELLYLRLQFDLLEPRDGVVSLDNFRTALTRYLTDAMKESRILEFLHALEPLAYRSMDFXEEFCAAAISPYQLEALDRWEEIAGTAFQHFXQEGNRVISVEELAQELNLAPTHYPIVQDWFRKPDGKLIFLGFTKFLHGVTRRGATSRRN

SEQ ID NO: 109971 - protein, 331 aa, Triticum aestivum
  unsure (1)..(331): unsure at all Xaa locations
  Clone ID: PAT_TA_4389.pep
VPVRNSRVDPRVRQFIPTEKERKTFKFDHVFGPADDQEAVFAESLPVVRSVMDGFNVCIFAYGQTGTGKTFTMEGVPENRGVNYRALEELFRISEERSSSVSYSFGVSILEVYNEKIRDLLDDNSEHTSKRLDIKQSADGAQEVPGLVEAPISTIDGVWEKLEAGARNRSVGSTSVNELSSRSHSLVRVTVTSEHLVTGERSRSHMWLVDLAGSERLAKTEVEGERLKEAKFINKSLSALGDVIAALASKNAHIPYRNSKLTHLLQSSXGGDCKTLMFVQISPSSTDSGETLCSLNFASRVRAIEHGPXARKQVDPAENFRIKPKARKLLP

SEQ ID NO: 109972 - protein, 148 aa, Triticum aestivum
  Clone ID: PAT_TA_4390.pep
MEGRVAGDVELDSAVFQVTLTKNRYEAIACNGESAESVASGPFDQLVLHLEDAKNFQSRSSSGSFKLLLIGDAKGSTWFTKSTLERFLHIINSPDASKTANGILQEMSQLEETRKFHDYLQSKEQQNLMGGALTGGLSSTTGKPQQGN

SEQ ID NO: 109973 - protein, 263 aa, Triticum aestivum
  unsure (1)..(263): unsure at all Xaa locations
  Clone ID: PAT_TA_4391.pep
MADFRRPCSAVSDYSWSASEDRTLPACDVRSILTGANPAILSAARSARPIAGRCILRLKGHLHSVCSANCYPPAGARLPPARLGSSGRGRGVRSGRCIRTIVAPAHPVRDGSIIVSGSHDGSCKIWDAGTGSCLKTVIDDDKKPAVSCSMFSPNGKFILVATLDDSLKLCNYATGKFLKVYSGHVNRXYCIQSAFSVTNGKYIVSGSEDKCIYIWDLQGKNILQKMEGHTDAVISVSCHPTENKIASGSLDNDKTVRLWVQDG

SEQ ID NO: 109974 - protein, 257 aa, Triticum aestivum
  Clone ID: PAT_TA_4392.pep
MASLTNLIILLPLLLLATFSPTPSLCYVGPSAAGVQVGLASAMASLTNLILLPLLLLATFSPTPSLCYVSPSAARVHEGVTQTSAYHTYIVLVKPPPSGTNEEGHRRWYETFLPSSHIGESGEPRLLHSYIEVFSGFAATLTEAELDATAKKLGFVRAFPDRTLHLMTTHTPEFLGLRNGTGFWSDVSYRKGVIIGLLFTGNDDSYEYGGHGTHNLVTGAGNFLTDASEPWRGHGHLFPEIVQWPTIACPKWATPQA

SEQ ID NO: 109975 - protein, 225 aa, Triticum aestivum
  unsure (1)..(225): unsure at all Xaa locations
  Clone ID: PAT_TA_4393.pep
MPSRRLPRARSTAPRDGRRHRAALVRITGTGTGMARSLLGDALLFSAGAAVGAALPATLASPLTPPSRPPAPTVLVPPGDPAATGARVRRRRGGDVHPVDRPITRVAPRSAARGPGAHPGAAPAAPGAGARPRRWLAAPPPALAPPPGRDHVLTRLLKNKADYCRLNGVQLLYNTALLRPSMDRYWARLPVMPAPCPAXPHPEWVWWVDLDPRLTDMDFRLPLGR

SEQ ID NO: 109976 - protein, 140 aa, Triticum aestivum
  unsure (1)..(140): unsure at all Xaa locations
  Clone ID: PAT_TA_4394.pep
PGLRRLTLSKVWLIANTHFFXEWTADGYKSTGCINLECDGFVPVNYAPITPGDTIEATGGKTKVTIKIFKNKADGDWWLHFGYDNRNLTRVGYWPKIIFKSXADHANYIIWGGFTGLYSGDASPAMGNWTLAPEKNPHLS

SEQ ID NO: 109977 - protein, 236 aa, Triticum aestivum
  unsure (1)..(236): unsure at all Xaa locations
  Clone ID: PAT_TA_4395.pep
VDGRVLSLQDRVAVALVMLNSGVSPVTVGLSLGVNETTVSLVTQVFVXEAMCERAMHHLRWPGSAKMEKIKRKFDKIHGLPNCCGVVHTAHIKFGMQNCDHEENDGILMQALIDPDMRFTNICLGLPGSMMNKLSVMHDSDLFKMGEKGTSLNGNKLKVTSGGGLEIGEYIIGDARYPLRPWLLTPYQLENELSDSDSKVEFNRRHSAATAVMLRALASLKGTWKLPAGKRVAFKY

SEQ ID NO: 109978 - protein, 168 aa, Triticum aestivum
  unsure (1)..(168): unsure at all Xaa locations
  Clone ID: PAT_TA_4396.pep
ATRRNRPQGPSPRGPTRRPXRRRPPAAARGRRPPPPPIAGVPARPTPPATPTAGEHGTPXRPGGCAGRPCDAGPAAAPPRRSPSYRTPPPQPPSPPPAPPPPRHPPPPPXPPAPTSPCPPSPARSPSLSRPTPPPSACPPSARQQCEGPTGSQLAGILAFLFFLVDGA

SEQ ID NO: 109979 - protein, 221 aa, Triticum aestivum
  Clone ID: PAT_TA_4397.pep
MAGRSTEAAPTVVGGYELRERLGGRPPATSVWRAERLSTGALAVVKQVRLAGLPARLRDSLDCELRFLAAVRHPNIIRLLDVDRTPGCIYLVMELCEGGDLAAYIQRAGGRVEEGVARNFMRQIGAGLQVLPRHHVVHSDLKSENILLSCPDSDAILKITDFGLSRVLHPGGDAETVCGTRLYMAPDVMLFQKSMTMHTCGVFGVNLYELLDGYPTGSRLK

SEQ ID NO: 109980 - protein, 253 aa, Triticum aestivum
  unsure (1)..(253): unsure at all Xaa locations
  Clone ID: PAT_TA_4398.pep
KRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYRIGGIGTVPVCRVETGVIKPGMVGTFGPTGLTXEAKPGENAHQSFL

SEQ ID NO: 109981 - protein, 230 aa, Triticum aestivum
  unsure (1)..(230): unsure at all Xaa locations
  Clone ID: PAT_TA_4399.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGFAFLERLSVDYGKKSKLWVHSLTHXSPGLPFLLVEPYQQCSLSNPLNSLSHTDGSXLLDNEXAIYDIXARSLDIDRPTYP
